United States Patent 9,567,581 (SELECTIVE REACTIVATION OF GENES ON THE INACTIVE X CHROMOSOME) - sequence listing, part 59

SEQ ID NO: 6326 - DNA, 360 bp, artificial
  synthetic oligonucleotide
tagtcggctaatattaaagaagtagaaatttcaagacttgcttgttgattagatatttaggggacagtgggtggagagtgtcaagaaaaaggtctaggtgcctaatttgcatgatgaagcatatgatagtagattaggtggaaaagcatgtttgtttcttctagaatggtggaagagatttcttctagaagtttatttcttctagaatggtgaaagagatttcgagttggagttaactgtggtacatcaaagtggagatgtacaatgaggcaactggatttgtgggacatggactcagaaaagagaagataaagatttagaggttattggcaaagaagttgcaaccatgagtgtggacca

SEQ ID NO: 6327 - DNA, 1571 bp, artificial
  synthetic oligonucleotide
gaattctgatactatcttttactcactctctgtgattctagaacaggtcacttgccctctctgtgttctgtaaacaggagtgtccatctctgacttgcctcccttccaatactgctgtgaggccccagaaagatacggaatatacagcttctttgcaaaccatagactctgggcataggtgaggaattatcatagtgaggtaattaatatggcttgaaagaaggaaatgtagatcctgtcctggttggaccaggctgcatttttagtcactatgctggctcttgcagagctctgggacatggctttgggttatgtagatgacacttgttaatgacaacagtctatagggggaaaaactcagttacgctggggaatccaaggtagctagattggctagtggcaagcagagaacagactctgcctggaattggtaatgagatcgccgaaatggaagagaaaattgagccaaagtgtaaatgttcaagcagtttagggaaggggtgtgtgtgtgtgtgtgcatgcatgcatgcacacatatgtccgatggggagcaggggtctttaagagcaatgagtcttgtcatttgcataatagctcttgacaatttgcaaagcattatcatagccaccatctctgaggtcagagaacagtatctccttttccaagataacttcaactagaccaccatcttagtcttgacctttccttcccttcctttctcttctcttcccttttccttccctttgttttctttctcttccctttccttccatttcttttctttccctttctctcagtcaatatctccatccaatctcagttccctgaggatggttgtagaaactgagtctcagagagtgagaggagcagagatggaacatgaattttaggctgatgccctatttttctttagtatttaccttttttattgtgtataaaaccagtaaagcccattgtaaaatgtttgagaggagaggaaaacccagacacgtatgaagaagaaaacgtcagtcatccataatgatcaatattgggtccatatttccttccagctttttttctatgcaatttgacatgcttgagattctgctaaatgtaaatttataaattccagtatactttccactgcatcatgatctgttggtttccttttctacactaggcattgcctcttccaaacttctgtagcctttaaagccccacttgtcaaatagggtgtgtagtaatgcccccttggcttcttgcagctgaagtgagaatcctttgagattctaagggcaagggtattttggaaatctcagcatgtgatttgtggagggggtctcaagtgcagggtttggggttgaacagcaatagcctactctggctccttctcaagtaagcgcccctgtccactcactggagatgaatgtttccaggagcctccctgctaagcactcctttgagcagtctggctatgtcttcaccctctcatcctttccccctttgtcctttctctcctgtctccacttcgacctcaagtgacccttaagcaataacctgcaatggtgagtgggatttgatgatattaa

SEQ ID NO: 6328 - DNA, 1597 bp, artificial
  synthetic oligonucleotide
tgaggaggtgtcagattggccccacagcagcaggaaagctgagcatctgagaccagatgctgggagataccaaagtttgcctgaacaccttgtatggatttaagtttaatgaaaccaaggggcttcaggtggtctatgccctgcctgagtaagactgacgtatttaggctccctttccccctccaaaggatactttctggctacataatactttaggcaatgctttctgtgcccacccaggatgaggtgctgacccaggcccagctggggggaagctttatggatgttccaactgcttttcatccacgcaccaggctcatttgtgccagatgaaagggcacaataataacagtggcaatttaaatcgtgcttctcactttccccctgaaaagtggcgaagtgactcaccactgttgaattgtccctctctatccaccccctgacctctttgcagcagtctaggctggttccctgggggctaagctgggagctagagcttccagaggccctttagctgtgactgggatgacatcatgcccccccataaatgtgttccccaaaatgcgatgtattgctttaatttgggtttctcagatgaggctgcttggaaggcattagagcagcatgagccccattaggcaagtgcagtgccccccgactcatgaataatataaaatggggtccattcagtaatcttttctgagggagaggctctgcttgtttttctacatgcagtttggtatgcagatgcttgctctatttgaaattcgccatataccaacttctggtagtgatattgtaaaaatgggtctgggggagctgtgaaatcattctgttactccaccctgattcttcacctccatttccctccatacccaaatcccctgaccctgtggctagaaaatgttcattttcaactctttctttcagcaccagcctacggagagctcccagaactggagctagtgaggtgcacttgtgcctagagtaattacagattttgaagtatcaacaaagcaggtaattaggtggagaaagtatccgctgtctgggagacaaagacagtaattatgatgagtactcttggtgctgtcagtaaactcaaaagaaagatttgtagagaaatgataatgtttgatagaaacttcaatgtctagcaggaatcaggggactcttagtaaagccacctggtatgtaatacaggtttaggaaatatggtagacctgagttcaaataccagctcagcctcctagggtctgtgtgatcttggggaaattacttaactactctgagcctgatgtatgaagtgtaaaaatagcaataattatagctctgtctaccttacaggatcattgtaaggacccaaggagataatgcatgtcagaacacttagcacaatgcccagtacacagtaggtacttaacaaatggcaacattattattattattacaactatccttgctacataccaggtattctctacagccgttcagagtttaaaaagggaaagaaatgattgcagttatgtatgatcatggcatgagaagtatgaagggtgtaattgtggtggctcaaagaagcgagccctcagttgag

SEQ ID NO: 6329 - DNA, 2161 bp, artificial
  synthetic oligonucleotide
gcacccacataatcccactataatcgggcagaaacatacaacctataagcgtgcacacacaaacacatgctgcatgtcaaagcgcaaaccaaatacacaccacaccaagcactccagctaaaacgtgctccgcgcacacaccccccacacccggccacacaccgaacgcacacacagatctaccgcacccgcgcgcgcgcacacacgcttacatgcatacatacatacatacacagcccgcccccgccttccctttgggcggaagagaagggggcgaggaggagaggaggggaaaaaaggaggggggatgagcgagccaggcggggcgggcacagatgctcttttccttttgacctggggtgttgcccccatgttccccattcccaagcaaagggagtaagtgagttggatccaaggaaaatccaggcggaacccaggaaaacaagaaggtctagggaatcagcgagctggcgcgaggtctccgcggggaccctgactcagcgcactgtcgaccccgccggaggctcctcctcccagtaccctccccctggccctttcactgccttgacctctgtccccctccgcacccccaccctcagccaggacatgtgcttctctccccggcccccacccgcccccaccccccgagccccactggagagaactggccactgttaagggttgagggctttattggtttcaagaagtaaggagttaagactggcagacaagctttttgcgaagcctgttctaatctagcttgaagacttttcttaatggagagctcactctttctcaaagcatcacattttctacgtaaagggcaatggctattagaaatccccgaccccgcgctggacacatagtagggctctctaaatgttcccccctcccgcttatgtcaccacatttggcaaggctgtctgcagcctagcactggctcgcaacagctgttgggcagtcagtcggtgagctcttttcttagcccactagccctcctgaaaacagcagcttcggactgggcgccacaggcggcagggggcgatagagtcgctaacggtgctttgcacttctggttctggccgcacagcccctgtgagaatctctgaggtgccctcccgccataagcggactatgcgagtggtggcggcgggggtcactccggaatgatccgcggccagatgactttctggctcctgtcctccacttgcttcttttctgtggagatggacagcaagggaaagggagatggacctccccctccgactaccccgtggcgcattatgtaaagtgtcatgtaaaaatacccaggcttcagagttctttataggttcgaatcccagctctgccacttcttagctgactaacgtggtaagtcgctggcttaggtcgcggggtagttgtgaggcttagaggaagtaacatatgtgaagtacttcttccagttaacatacagaggatgtccattccctccctctttcccccaccctcttcaaaaatataaagatatgggagtttaaaagaaaggggattagagtctggcaggggggacatggccaccagctgatgctcccaagccaggccagaaacacagaggacgggcaggagttcagttaacttgcaatatgctgtatttaagggaaatgcctgcaccaatgatttggtgatgccattcactggccacaagagaatccaggtcacaactccaatccttggatttgtgatgaggctgttctgcccatcacctcccctccttacaaggacttcctaactcacctccacttgtattcttttccttcttacagagatgccacagtaatatttttaaacttcttgtgagcactccttgggtgccaggaatgtctcctgttaacttatgtcccagcagcatctagcgctgtgccagacacacagtgcaagcgctatacaggcggcaagagatgtcctgggtgaaatccctaggaaacattgagactcgagggtacatgaggagttatcataaggaacctaaagagaggaccctaggcactgcagggatggagggcagtggctttggataaagagttattccattggacaaagagttattccattggacaaagagttattccattcctcctcaaagccctccacctctaagcctgtctggaagagcattgct

SEQ ID NO: 6330 - DNA, 3224 bp, artificial
  synthetic oligonucleotide
tccctcttgctgggctcacccatagtctcttatattcttgactcttctctttcttctccatttctgtccctctttgttgacaacactgtcccttgtgcatttacttggcccaagacaggagagaattcaattggggggggtgtaattgtgtatttgaaattctcccacttaagatcttgtgattataaccccatattgcccttgttgcatcagataagaatattaagctcttgtaaattatatatttttgcttggttgaatggtgatttgtatatatgattggtgggctgcagtttagaagagagtatttttggaagaggtattaaaaggtaagatggtttgggctggtgtagatggcctcctgacttctctaagtgcctagatatgcaaagaagacagtacatgaaaaattaagactatagtagtggggggcaggggtgggagaccattgccagccaggtcgatggaggactttgtgaagtcagcttctgttttgctcttgctgatcattgaactttgaaaaaaatgacctttttatctctgagtttggaagaccagaggccctagacaagaagaccagaggccctagacaggaaggggaaacaaaaagcagaaagagtgaggcaaggaggggaaaggactattccttgtgcagtccttgtgtgcaaagggccaacaaagaatgtcccctgccctcaaatgccacaccagtcaaggcagaagggaagcaaagtgctgtggcaaattgtgtgctgagctgggatccaggagttctggaccttcatcttggctctgccactaattagctgtgtccttgggtaagtttcttaaccatctgaacctccatttctgctcttccttcacttgtactgtgagattgtgtggcatggccaggggaggggaggttcagagcattcagagggaagggacccttgggctgaatcttgaaggagagctctgctttgaataggggagagaagattgtggggtacagtgagaaccagtgggagtggcccagagaattcagcaaacaggtatacgtaaggcactgagctggctgctgggtagaaaattgctatgaatcagccccctcctcaccgcggcaagctttccagagagtaggggaatctgagaggcagagccaagcgctggcagtgcctgcagctcctctcagcactacccgctgccgcccgccggactgtcgagcaggtcacgcagcctttccctggccggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatccc

SEQ ID NO: 6331 - DNA, 4258 bp, artificial
  synthetic oligonucleotide
ctctctggatgctcccctcctctgtctccaggcagatttagctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatg

SEQ ID NO: 6332 - DNA, 1313 bp, artificial
  synthetic oligonucleotide
agaataaagaaaaaggtagttttaaaatggaaagtcataaacatccaaatcttaaaaattcatgaatttagatcatattggaagtagtactggtcagatagtttggtggagatggagaaagagtgttttgcagtgtcagagtggcttcattaaacacaaagggagaagtgatttgcagctggaaatttcagattcaccataaaattaacatacatgcccgatgggttctcatctaataaaactgagagagagtgcttggtatcctaaaggcaaaacaacttaataaaattaatctatcgtgctcctagtgcttaggtactgcaaggcttcaatgatgcatttttcattaagtgactgggtaaatataattctctgtgttagaaagtctgagtccttattctaatttattgaaattagaaataaagaacttacttaatgactcatcagtgttgggaagacaaaggggagggcaccgttttatggtggcccctatgactagaagaggggtagtatgaatttttattgggcttgaaccaacaggactcttccgggactcatttattcttcccagacacctttgtcccaattttaggggctagacaaactccatactaccctcatttaaatcttctaatgtgcattgaactctctgcctttatgtaaggggcagactgagccaggaaaaaggagctaagctagagcctgacctttgtatttctgtcatgttttacagagtaatcccagcaagggaaagaactgactcagggcaggttcagcctagctagtgttatctttgtgtgtgttggaaggagcagagagggctaatgagaaggcatctgcttgggttgatgtgaaaagaaccctgggacaaaggtctcttatcccaaaagatatacctcacctgcctgcccctttcaccataggtttccaacatagttagtcattcagtcccttgaaaaaatagaagtcttcttttaacatgcaagcgctctcaggaggtataaattgttcatgtttcacaagtcctctcaagcgctggagtcaaataagactcatgcccccaattgtcacttatcttaggtaaattcttaatctgtcttagcctcagctaaaccatctgccaaatggagatgataatctctacctcaaaggttgttttgttaaatgaaaagcaaatgtgtaagtacccaagaaagtgcctgacatgcatcagatgtgtccttaccttctgtcacttgatctgtatcagtcaactgaggggggaggtggcaaaatggagtgtagaagtgggtcccaaagaatctagaggagta

SEQ ID NO: 6333 - DNA, 515 bp, artificial
  synthetic oligonucleotide
tgggcaaagaatggatggaagaatggatgaaagaatgcaaaacgctctaggcatacattagcagctaaaagattaacaaaatattttcactgcccttctagtaactaaaagactagaagaggagcaaagacatgtaagcagataaaaataaaaatgtgctaaagtttgataagaaaagtggagagaaagtggtcatggaagtttagcaaagagcaatattctcatctgaggggatcagcgaaagccttgtgggtaatgtcacatatgaactgaagtatgattggattcatctggcagctgtaaatactacatggttacttctctgacagtagagacttattcatctgtgtatctcctgtgcctaatacagaaataatgctaataatagttagtacttatgaagtgctcactatttgcaaggcatcacgttgagcatcttacaaacattgtcacattttctttcacaacactctggagcagtgcttataacaatagcagtagcagcagcaggggca

SEQ ID NO: 6334 - DNA, 438 bp, artificial
  synthetic oligonucleotide
ttgtattgctgagtagtattctattgtatggatgtacccaagcttgttgatccattcactagttcatggttgtttgcagattttggctataatgagtaaagttactatgaacattcacataccaagtctgtgagtggacatgctttcatatctcttgggtaaattcccgagagtgggattgctgggttatatagtaagcgtatgtttaactttataagaaattgtcaatcgcttttacaaaatgactgcaccattttgcattcccacagcagggtatgcaaattcttgcagttttcccttatcctgaacaacacttgatattacaggctatttattttatttttagctagttaatagtaactttctaaaaagttatattttctaattgcttttctactgtttaagaatattattgatttttaaaacatatctcccatg

SEQ ID NO: 6335 - DNA, 262 bp, artificial
  synthetic oligonucleotide
atatatatatctatatatctatatctatatctatctatatctatatctatatctatatatctatatatatctatatatctatatctatatctatatatctatatatatctatatatatctacatatctatatatatctatatatatatctatatatctatatatatctatatatatatatctatatatatctatatctatatatctatatatagagatatatagatatatatatatagagagagagagataatatatatata

SEQ ID NO: 6336 - DNA, 1197 bp, artificial
  synthetic oligonucleotide
tgaacttactgtttccttagcttgtaaacacttttattattatccttatcacacaaaatgaatcataaacatctgtttatgcatctctcccctactcaactgtgaagtctgagggctgggaatgtacattatttacctctgtatccccaaaacttagccaacagaactggcaaacagtaggtgcccaatacatatttgtggactaagtagattaatgaatttttaaaaaatgttttagcatctctaagacaaaaaaatgtgcaagaaggaacaaggcagattcaaaagaagaggtctgtcagttgaatactcggtgagatatctgtccttggaaagaagggattttgtctggagaaaactaggctgtgctaagaagaataactaattctatacagacaggcagccaagaacaggctgtggccaaagtgttgatggatgacagctggaagtatggcttgtgaaccaactaaaaacgacacatcaatctgagctgcaaataaatcattgggactccaaaggcttttgttcactttaaaatctcactctacatgaacatttaataagaacacttcaaattgttatagcactttactactttacactttacacattcacatacataatcccctgtaaacttcccaacacctgttacaagaacaacattatcaacccaattttaggatagaaagctgaggctctaaaaatttcattaattaacccaaggtcacacagatgataagtggtagaggcagagcatgaatagattttgagataagaaaaggagaaggaataagaaagccacaaaaaaagtgagcaaaaataaagaaaaaaatctacaatatgcacattatgtttcattctgggctttattaactacaagtttttgttgttcttttctcaataatagtaaaggggttggatcagagaagggggcactcctaggttaagagttgttcatctataatgtatgaggtatggtgcaagtcactttacatttagtatctataatagccctatacggtagatgatgttatccacactttcaacatgtagaaattgagatgcagaagatttaatcaatttgcctaaaggtctgtaagagttggaaaaaaatttgcacccgtttgactctaaaaccagtgttatttgtataacatcatatgcttaattcctgtgttgtgttagttacatgtaaga

SEQ ID NO: 6337 - DNA, 616 bp, artificial
  synthetic oligonucleotide
cccagatctttgtagctccgtgctgtaaatgtgtggcaagtggctcaatgtctttgactcctagctagttcatctataaaatgggcgtagtaattcttacttcacagggttgttgtgagaattaaatgagatatacaggtaaagtgcatggcactttacaggtatttaattattatcaatttttttgtagatacttacatattgaaaagtatatatatttgcaaaatcattttcattgatgcttttctagagggtgaaattttgtgtgcatttgagttctttttaaaggctgatgagttctctatttctatgaatatgggagaatgctagataaatataatattgatataatgttggtatgctcagtatgaaacaaaagaacccaaaatatacaacatgtatcaatggggttccttatggaaatttactgaattgtaataataatgtttgcctttctgttggaaagaataagatgcaaataaagtccttttaactgcctatgggcgggataagcaccagctagtcttggaggggttgagtcttacgactattctatggtgcaccctttgaaataagcctgttcttggccacatcaattcacagatggagggtgtat

SEQ ID NO: 6338 - DNA, 348 bp, artificial
  synthetic oligonucleotide
ataccagcctcaatgaatttatgatcctcatcaccagtatcttcaccctgctgctaccatttgggtttgttctcctctcctacatacgaattgctatggctatcataaggattcgctcactccagggcaggctcaaggcctttaccacatgtggctctcacctgaccgtggtgacaatcttctatgggtcagccatctccatgtatatgaaaactcagtccaagtcctaccctgaccaggacaagtttatctcagtgttttatggagctttgacacccatgttgaaccccctgatatatagcctgagaaaaaaagatgttaaacgggcaataaggaaagttatgttga

SEQ ID NO: 6339 - DNA, 1857 bp, artificial
  synthetic oligonucleotide
aaagggacttggcttctaatacttcacagattcacacagcttcagagcagtaagggatttaaagattgaatacacctctctccctcatacagatggtgaaatcgacattaagtcactgatttcttgtaattttcaagataagcaaaattaagtcaattttttcctgacctctctgctctctttacctctgtagtacttatgagaaaccagacctcctttttcctttggaatgactgtaaggtcagagaggaattagctaaatgatgcaatggaatttgcatccagcatttattgtgatgatagccttgactttcggtttattgagagaagaatgtgattgtttgcaggatgtttccttccctttacccatggatataattaaaggtttaagggaacttcagatcccagagagttagtaaaaaacaaaaaacacaaaattagttatttcttttcacttaaaagggcttatatccaaagatgatttacctggttgaacaaaataatctgacgtttctacttttaattaaaataacaggaatgtgaagacctccatatttgtgaaatggagctaatgaaagtgctgcctattatgactttggttcttgcttgaggatttttaagataaggaaagttattaaatttattctcgttctttccatatttcatttttctttggaaaaatgtgatatgtggttaagtgacaatagaatcaaagaaatgtctcattcttctttactccattgtaaaatgaactgtcttacaaacatgtaaagaacagcattcttcacatcccagaatgtatcctgcttgctttcttgttcttttcctctgatctgagctggggtaaaaagaggaatgcaagttagcaggcagaggaagctcttttcctatcctctcgtgagtaggaggaattaagatgaaggaatattatcaattattcttttgttcttaaagatgaattagactcaaaattattagtcaggagaaactcctcaaactgctatgttattcatacgctatgtcaaaatcttttgtaataattttaatgaagttatcctttactaaaatatctcattctaagtatttttgctaatgagatgcatttaaaaataagaataataaaataaagagaagatgaaaaagtacctatacaattaattttatttctgccttatgaacacatttttcttgctgctatgcacaaaattgctgaaagtttaaacagttgccttaatagtatgaaataatactgtgtgagacctttgactttatgcttcaccattgagaccagggttggagtgctgttgcctcattcgtctcaaaactgccgtttaagtaggtgggtaaagataaggagtcaactgtgagttgataaaatgctgtctgatgaccacaaggaagcccagggttgatgtaatgacatatccctactacatttcatttatctcatttcatgcatgtaaaatctgggaatttgactgctactttatgttgcaaaggcaagttataataaactttgagaaagatgtaaaaatgtaagtataccataaaaataggtaagctaataacattttcattgtacacttagttaaaatattttgagcccttataaatatggaaatacaaatttaaatgactgtccacataaagaaatttaacctgaagccaaattcttcatgtttaatttgaaacatatacagacatacttaatttttatcttagttcttattctgtcatatgcaaaatacagtggagctaagtatttcacttcagaaatataaatcacagggatctctaaagaattccataaaattttatctgataacttgtagtatgaacctgaagttgtgcaaagta

SEQ ID NO: 6340 - DNA, 4582 bp, artificial
  synthetic oligonucleotide
aaatccccaatagatgaatcatcctgaaaatcattctggcttttccaaatagctagcagtttatctatgatcataatttgctcttttctagatgcctccagtttatttttatgaaacatctattacagcactatgtctacaaaggcatttaggactatgtgcccttaaccttaattgcctcagattgttttgatttttggattcttttttcttctttataatttgtatgcctttttcctctctgtcagatttatatgaatcatttcctggtcactgacttcccctgaagtcaaactttagaatacttggttctaaagtgagacttctagtctaacataaaatgagaaagcaaatatccaaacctgttagcattctatatactgtaagagtaaatagactctccatggaatcctatggtgctcttctattggataagatacatggacaataggatacctattttgagtgctggagggctgttttttttctcttctttcttggttttccatttgtgttttagacaggtgggtgtatatctgtatttcaaaaatcacaatataataaaaatctccatataataaacattttttaaaagaccaaagaaatggctcattgattaattttttttgccaatactgataaatgtacaaatcacattgaaacccaataaggctctgatggtttcactgactaattctatcaaatattcaaagaagaaataaataccaattcttcacaaactctcccagaaaatagaggagtagatacttagcaacatattctatgaggtcaatattaccctgataccaaaacgggacaaaaacatcataagaaatgaagactacaggtcaacattcctcatgaatacagaggcaaaaattctgaacaaaacactagtaacctgaattcagcagcatatgaaaaggattatacacaatgagttgaatttatctcaggattgcaaggtcagtttgacatatgaaaaccaatgactataatacactatgataatagaataaaggacaaaaaaaaaataacccgcacattatcttctcaagagatggagaaaaagcattgcacaaagtctaatacccactcacaatcaacaaaacaaaacaaaacacttaacaaacaaggaatataccaaatggtgagaaactaaatgctttcacttaagatcagaaatcaggtaaagatatcaagtgcctgccacatctattcaacattgtactgatggttctagtcagtgcagtcaggcaagaagaagaaacataaagaatttgcactgaaaagaaggtggtagaactgtctttacttgcactcaacatgatcctgcatgtagaaaatcccaaggttgagcgtggtggctcacgcctgtaatcctagcactcagggaggccaaggcaggaggattgcttgagcccaggagttcgagaccagcttgggcaacatggcaagaccccatctctaccaaaaaatgtaaaaattagctgggtgtggtggcacatgcctgtggtcccaggtcccagctactttggaggctgaggtgggagcattgcttgagcccaggaattcaaggctacagtgagccatggccgtgccactgcactccaggttgggtgaatgagtgaggccctgtctcaaaaaaaaaaaaaggaaaaaaaggaaagaaaaaaaatcccaaggaacctatgaaaaactactagaactaataaatgagttcagcaaggtagcatgatagaagatcaatatataaaaagcaattgtatttatatatactagcaatgaataatctaaaaatgatattttaaaaagttccatttacaatagcatcaaaaaagaataaaatacagaggaatgaatttaataaaagaagtgtaaggcttacacactgaaaagtacaaaatgctgccaagggaaatttttaaaagatctatataaatgaagagatagttcatgttcacagacaagaagattcaatattgttatggtggcaattttttcaaaaaataatctataaattcaatgcaatccccatcaaaatcccagtaggcttttaaaaatagaaattgacaaatgaccttaaaatttacatggaaatgcacagatctcagaataaccaaactattttgaaaaagaacaaagttgggcaatgtgtacacttccttatttcaaagcttacctcaaagctacagtaattaagacagtgtggtaatggcataagaatagaaatatagatcaatggaacataagtgagagtacagaagtaactccttacatttatggtcaattggtttttgacaaatgtgccaagacaattcaatgaagaaaaataatattcttttcaacaaatgttgctaggacaaatggacatccacacacaaaaatatgaagtcggacccctacctcacactatactccatgcaagcgtacaaaaaaatagctcaaaatggatcatagatctaactataagaggtaaatttataaaagttctaggagaaaatctttttgaccttaagttaggcaaagagttcttagatacaacaccgaaagaatgatccactaaaactacacagaaagtgaaattccatcaaattttaaaactgttgtacttcaaaagatatccttacaaaatgaaaagacaagccacagattagaagagaaaattgcaaattgtatatcttataaagacttttaatcagaatttataaaaccctcttaaaactcaataataatataaaaactcatttaaaaatgggcaaaagatttgactaggcattttaccaaagaaaacattggaataagcacatgaaactgtgctcaacatcgttagtcattaggaaaatgctaattaaaattgcagtgagatactttatacccattagaatggtcataatcaaaaagatatacaataccaagtgttagtgaaggtatgaagaagtcaaaaaccttgtacatttctaatgttattgtaacaatttgaattggcagtttctgaaaatgttcaatataaatatatcataagacctagcaattacactccttggaatgtacccaaaagaaatgaagacttgtatccacaagaacacttgtgtgccaatgcttatagcattattcataatagctaaactggaagaaaatccaaatgtccacgaccaggtgaatagataaacaaaatgtggctgggcgcagtggctcactcctgtaatcccaagcactttgggaggccaaagtgggtggatcatgaggtcaggagttcgagaccagcctgaccaacatggtgaaaccctgtctctactaaaaatacaaaaattagccgggcgtggtggtgcctgcctgtaatcccagctactcaggaggctgaggcaggagaattgcttgaacccgggaggtggaggctgcagtgagcatctcaaaaaaaaaagtggtaaatccataaatggaatactgctcagcaaaagaaaggaacaaactgttgcagctcatgttagagcatgctttaatttaaaaatcattattttgagtgaaaaaagtcagatgcaaaataccccatattttatcatttcatttacatgaaatgttcaggaaaggcaaatctacagaaacagaaagcaaattagtggttgcttggggctgagcgtgggaacagggcgtgactgcaagtagggatgagagatgtcttttggtgtgatggaaatgttttaaaactggattgcggtaatgcttgcacaactctgtaaatttgctaaaaatcattgagttgtgcatttaaaatgggtgaattttatgatgtgtaaattatacctcaatagagctgtttttttaaataaatcacatgcacaaacacacacaccccaattttccagtttattaaccacaaatcccacgttgaccctaagaaaaacaaaagcacataagactgtgcttttttttctctccatacaagactatagcaacctaagaatacaactatgacatacgaatgagtaaatagctccagtaacagaaggtgacaaatgttataagcaccttcactgttaccacgctggtccaaactaccatggtctctctctcctgtaatatccttttatctagtctccccacttccaccatttcctcttgaggtctgttttcaccacagcagccaaaaggaccccgtcaaaacctaattcagattatttcactcctctgcttaaactgcttcgatggcttatctgctcatttagagttatgctataggtctttcatatgcttttttaaaaaagagatggccagtcggatatgcactcctggcctcaagcgatcctcccacctcagtctcccaaagtgctgggattacaggcatgaaccaacacacctggccctttaatatgcttttaagaccttcatatttattctcttcctctcttactgagctccagccagccataaaagcctttctgatgtttcttgaacaccccaggcatgctctcacctcaggccctttgcactgcatgctctctttgccaggattctctttcacatgattttgttgcatagcttaccctcccacctccttcaagtctttgtttagctgtcatct

SEQ ID NO: 6341 - DNA, 749 bp, artificial
  synthetic oligonucleotide
catatgtataaatcacttttttgcgaaagtttaaaatagtaaatgagtaaatgaagaatggattatccctttcctctctctttttccacctatactttattccttcagatttactggcaaaagttttactaaatagactgtgatccaaaacaggaaactgtcctaaagggaattttcatattctactttaaagtaaaaatccaaagttgagctcacccttggaaaaattagcctggccagtctgtcttcaattagtctctccacacatagggaagtggagcaggagagatgggcaagaggccagaatagcggcacaaggagactgggaaatggattccagggtttgtgagccggatagaaatagaagagtgagtctacatagattttaccattatcctttaaaaataaataaaacaaacctaaataaaaactaaaaagcaccacacaagtggttttacctaagtttcaaagagtagtctttgaccactgtggtgtaacttggaagtcataagttaaaaatactgataaaaattatggccccagttcctggcatctcttcattagtgccttattccttttggggttagtctgttcacttatagggtcctttattaaactgccaatagtcttggatgttagtcaaccttattaatataatgtcagagcttaaagggcctttcttatgtgtattttttttaatttcctgtacccctatgaaaattgcttttttactaattatgtacaaaata

SEQ ID NO: 6342 - DNA, 1325 bp, artificial
  synthetic oligonucleotide
tctaaagctatgattgagatgctgggccaggttgagtgattgtgttaattccccctccctaccccattttcagtgaaagtttcacctagcttcatgaataactgtgtcttgctctgtctcacttgctttggccttgtctttgtccttctctgtctttgtctctcctagtttccttatcgagctttccctcgggggactttttcattcttcactagcccaatatttcatccttgggttggttcatgtttctccaaaatgctgacagctccatcagagaatgcaaggatgaattgccacaaatatatttctgaactgccactagatggcagtgtctgggaactttgttaactcggtctaggcattcatgagtgcctgactgctgagtggtagggagtttcatttgattattctgcttttaggccgttgcaaccagttgctaacacaagtgctagacttagctggatctctttctccatgatagaagaaaattcatgtttgtaaagcacccagggctggaaaagcctgttctttaagagggttagcgttttcctctacctcaattctcacacaagttcctagcccttagattccttagattcccttttgttcccccttcagctgttgtttgttgtttggtttcattttttatgcaaatatatttcctccttccccagctttgttagtaagttggatcaattctctttcctctttttgaggatggacttgtagaatcatctgctatcaaagcttgaagaactcttagatgtcgtcgagtccaatccaatcatttacagatagagaaactgaggcaaagacaggagcagaaacttgttcaaggccatataaaaattcaaggcagaatcctatgggacaatctcatgacatacttgtaataatcaacaaaacaaccagaagattatttttgatccattaattgtggatctagcacaatagaggaaggggagggagacaggaggtataggacatggtgcctgttctcaaggcacttagaatctaggtgggaatatagacttttacacaatgaaaaagaataaatgcattgtgtgataaggtaatctaagaaaaaatgctaatgtaggcaagtggtacagggattcagaggaacaacagctctaagagaaaacaaggcaatgggtgggggtgaaggtgaagctgggagatgagaaattcaaagattattattattcagggatcaaggcctaataagtaggcctgacaagtagagggtaggggtcaataagaagtaaaagataagactcagtgataggctgggactgtactgtacaggctcttaaatgccaggc

SEQ ID NO: 6343 - DNA, 582 bp, artificial
  synthetic oligonucleotide
tatttgtttatagaacaatcactactccgtgactaagaatggggaaatagtagttggaatcctgtaaaggtaaaaattttaaaagccaccacagattgctcttaaaggattctgaggcaatgcaattcaatgcaaaactatgcctcaaataaatgtctagtttacacacactttaggaacagtgacttaacaggttatttctcaagctagtataaataaatgaaaattaaatgttatgccaaatcaatctttgtgtctcctcaatagcctagatctatttgtagttacctcaaaaatatccaagatcaattacaattattgttggatgaatgtaaaatatttcaaaatcctggcctaaggtcaacagaataatcggggccttccatctctgagttcctgtctagagttgaatgactagatattttcttttacagaagggtaaacatttggtaacaatttgttgacccaattttaatacaagaaaaatagcactcataaattttactagcgtcataatatcttcattttattgctcatttgcaagcatttatataatataaaaggaaggctctttttacggtc

SEQ ID NO: 6344 - DNA, 1764 bp, artificial
  synthetic oligonucleotide
ttatattaaacatagcttgggtcaacaccagctctcttacctctgtccaccattgcgagccacatctgtgggacattcggggttttgctaataacacaaaaactggctcaatcttattgaactgctgaaataattgttttgtcttaaatttaaggcataaataggtcaatttgctattttttgggatactatagcttcaacattgtctcctgcttttaatttctggccagtgaaaattgcaaatgagactttattattctctctttcccacactggaggggaaagaaaccttataaacaaagtttagcctggtaaactgccttccttttatccagggtggcatgacctccacaaatgaagctaggcaaatttccatgccaccaggccactggggaatgttgtcaaaggcactaagaaattgctattccctcccctcagcattttaaaaaggcccatttgctctctggggtggacttaccttggaattactttctttccattttagtagagtagttagagctagccaacattttctcttctgttcttctctttaggcataattggtggcatgacccaggaaaaatagggtcgtgtactgactgatatgcaagatgaattcttacaataatgtatgtacattatagtctcagaatacatatgcctgttcccccattgcgttttgagatcacctgacaaccactatcctgatggatcttcaaaagtcagtgtcttgcaactcggattgaaaaattaagtccctggctgggtggagtggctcacacctgtaatcccagcactttgggagaccaaggtaggtggatcacttgaggtcaggagttccagaccagcctcgccaacatggtgaaaccccgtctctactaaaaatacaaaaattagctgggcatggtggcacgcacctgtagtcccagctactcaggaggctgaggcaggaggatcacttgagcctgagatcgtgccactgcactccagcttgggcaacagagtgagactctgtctcaaataataataataataatagtaataataataataagaagaagaagaagaagaagaagggaagaaggagaaggagaagaagaagaagaaagtcccgtccttctctcctactcagtcaaatgcaggtgtgtaagcaaacatttcaacaaacctaggggatatgctttttctgctctatgtcttaacgcttgagatggacacttacacaaatgtaaggctaggattctgggtaaggatgtagtaacctctcaagtagcatgttcttccaataaatataattaactttgatgtaggaaagaattctaaaagttatgtgatggtttaataacgaaacgattattgtactccaccaccaaacaaatgttgctgtatttttaaagatgtcgcataggtgaaaagttaaactcacgcatatatgagtgaaccagggtcttgagaagtttttgaactttcaacatattcgatcagaattatcctttcactcctctgctaagccacataactcatttattattctttgaaacagacagtcaacgtgtgctattggacattcaggcaaggccgtgctatggacaaaaggtgaaacatgtttttctgttttgaacttgtggaattattctcactagcctatcaacaagagtattatttgctactgctgtgttctagcgatggctccacaggctccagccccacagcagtatttgtggtcattccatacagaagcctctggccatttaagggtggttc

SEQ ID NO: 6345 - DNA, 225 bp, artificial
  synthetic oligonucleotide
actaaaaaggaagagcaaactaaacccaaagcacacggatggaataatatattaaaaattagagcagaaattaatacaatggataataggaaaataatataaaaaaccaacaaaacccaaaattggttctttggaattacaaagaaaatttacagacctttagctagactgtccaagaagaaaaaccgaagactcatattactgaaatcagcattaaaagctgga

SEQ ID NO: 6346 - DNA, 1763 bp, artificial
  synthetic oligonucleotide
aggactaaaagatggttgaagcagatgcgccgaaaaatgtaacaaagaggctgaaataaaattgtataaatgaagacaagagtgaaactctgtgtaaaaaaaattgaagacaaagccaagtttactgctggtaacacagcagagtaagtatcttgactgacccttctgccttaaaaaaaaaatgttgaatgaaatcttcaaaagatcttaagagctgcaaagagcaaacaaaagagttagtaatttccaggccaaaatataagtcaaaactgaaacccagggatttagcggagcattaatagtacttctgaactaaaggtatttactatacctggggaatcacaatttgaattttcatggcctcctgagctatgggtgacggaagattaagttcagcactattcaaagtaaaaagtctaatattgattatataattatcatgccttgtaggcctaaaagaacagaatacaaacaaaaatcatcgcaagtatatctatctctctatcacaggagaagagcaaatgtatttggtgttctaagatttaatagttctccaggagagtaagaatatgatcaaaatatttttgataagttaagcatgcatgttgccatttcaaaaatacccattaaaagattagacacaaagtccataacttccaaattaggagagaggaaaatggaatgataaaataaattaaatccttctaaaataatgaagaaacatggaacagagtacaaattgaaacagaatggctgagacaaatgaaaagcaaaaaataatttgatagatataaatccaaatagatcattagttatatcaaatgtaagtggactaaaagctccaggtaataagaaagatgttctgactagattagtaaaaagaccaactaaatgttgtttataagagatacatcagaaagataaaaatacagaaagattgaaagtaaaaatacggaaataatgcatgccatgaacatgctaaagaaaaattgaaattacctaggttaacatctcttaaaataaacgttgagacacaaatgatttctaaagatgaaggcaatcactttgaaataacaataagcttaaatcacaaaaatgatatgatgattataagtttttatctcccaacactatagcctcaaaaaaggtataagcaaatggcctataaaaagaaataaaggccgagcgtggtggttcatgcctgtaatcccagcattttgggaagctgacaggggaggccaggagttcaagaccagcccgggcaacatagccagactttgtctctactaaaattactaaaaattagctggacatggtggcacacactgtagtcccagctacttgggaggctgaggtggaaagattacttgagcctgggagatcaacactgcagtgagctgtgatcatgccactgcactccagtctgggcaacagagcaagactctatctcaaaaaaaaaaaaaaaagttcacagtagtcgaagatttttaatatacccctctcaataagccatagaacaaacaggaaagaaaagaatataaaaaagtatacatataatgatacatatacaaaaataatacatataacaagtctcatgatacatatacaaaaaagaataaatataacaactgtcataaggacaaataaagatcttgatacccagcaactgcaaaatacacattttttccaagcattcatagaacagttttatgaaactaaagcttcaacaaattttcaattttcagagccacaaagtttacttt

SEQ ID NO: 6347 - DNA, 1037 bp, artificial
  synthetic oligonucleotide
ctttaatgctctggagctggcctattatactcttagaacatactgtgccactttcagaaaaaaaaatcacaaaaataagtatttttgcctctagagtatctggcaatgagctcaaatagttcgtcaaccttcaagctgttttgtcagttaatcttccacttagcaaagtctcagccatgaggcatcagcttaagtggccatcagcccaatgtcacactggcctctggttgtttttttatggttcttccataccttcaacctaatttctttacctccaacattaataatgcctgccaggctggtaggcccatgctaatttgcattctctttaatggcacttttttatggccttcagctttgcataatggcacttttctaaagctgccccttccaaaaggaagagaatggtcactcctatgggaatgtgccactcttatttggttatttcagcaacaaaatggattcttattatcttcatgatgagcccccaaaataagaatagccttcaggattcatttcatctaggactcctcccttggtttttgaaagaaagcatctttatttcactggctcctctgttcccagattacaagagatgccctgcctgaactcatttatattaccctccaaaggctgtgtctacacttaccaaatgcagcaaaaagcaatggtcatttatagaaacaggtcacaattggtcaaagcaatgcaactaactgctaatgagacaaatgccaacattctaaaaggagcaagattctttggcctcttacaaattttgcatagtgtatgtaccaaaaatgcagtctacaagggggtagaaattaaaatacagttaaggtcctcatttttcttatttgaaaaaagaaaacctgaatcttttctctagcgccttttttcatttccattaaaacatcatacttatgtgtaaatcttcaatgtaaaaagtatttgaaataacttcggcatctaaatctttaagacgggaaaaaagagctgcagagttcaccttgaaagagtgacttttattaaatttt

SEQ ID NO: 6348 - DNA, 5322 bp, artificial
  synthetic oligonucleotide
atgcacaccttagctcttacagattatcagaactcacagaactggtcctgcaacctcctaggggatctgtcaacatccagagaaattctggaacccctaggctatccctattcttcaaagtgaatatttctggaggtgggcaggaatgaatgaaataaaaaggtgcccttgaggtagcaatgcatttctctagcaagttttatttcatttttgcaaacaccgtaaaatccagtaactgtgactttttagaacatggttgctctttgattagactagatgctactgtagtatcacccttttaataaccaagaaaatcctatgtcatttcaaataattttgcttcaatttgggacaatccaagaggctttgaggggttctggttatcttctggagaatgcgggaaggaatctgccagaggacagtagccaccaaacagataatctagaccacattaataatgtgtgtttatagacatcatactctgacctacatgttcaaaaggatcagtaaaggcacatgtgccccatggaactccagacaaggccatggctttcatggtgaccaagaccttgttttcacttctctgctatagtcatggctgtggaattctacttttgcccagaagagctttttaaatattaccacctctcaatacacctacaaggtctgtcagtatgagaaattcttttcaatattgccaaattgtttgggaacttattaaacaccagaatattgttgtgacaatgacttacacaattgtaccaatggattgaggtcctggggctaaggttttcttggggtggaagaaaaaatttgttagtattggaaaggaaatacaagtttggcagattctgacacaattccagcatttgagaaaggacagtgtaaactgagagaagagagagtgaagaggagagccagggggtgatgttccccttaaatctcaatggtaatctgaaagtcagagggctctagggctctatttgctgcagttggacagaaaaatccacactggttgttgcgttctaacagtcacctgcaaagcatccccttgtccagggtaccaagtgcacccgggggatggggatgggacacagacatgtccttgccggcccagagaccccatccagaggcctccaggccatgaaactcaccttgtgcaccccctggactccctgcttcagcccagatttgttttaaggagacttgcgaaacagtagccctggctggactaactgcaccccatagcactcacttcccccaccccaccaccacccactttacagtactgcatgacctctagcaactggacatcgcgtctggagggaggaaaatacccttgcttctggctacagactattaataaatcagcttttaccgcatcagcccaggctcacagaacatgggctggcagcgccccatgctggggctcaagctttttaaatattttttgtaaatcaggagaggctcctggtgactgaaccccacatggggtccagggcaccatcccagcccgcccttcggtccgcggggtgccccccgccactcccaaagagccacggatgcctctcatgcagccagtagtgataagcaagcctgggaaccatgagctctccttggatgtcggaaaatagcgacagagggacacccagtcgcccgggaagaccagagccagagcggggaaggagcgaggtgataaaagtccggcaagaagagaaaaacagaaagggtaagagagaaaaagaataaaagcgagagaggggaatggaaagaaggaaacagcgagcaaacaggagcagacaacatctaggacacaagagagaaagagggagaacaaggcaaatagacgaaataggggggaaagcggggggagggaagaatgcgggcgccgaaaggaggaagagagcgctgaaaggagacttcggaacccgggtgcagagtagaagaaagcagggatccagagacgctgcacggagagcgcggctctttagggctctccagtgcggagactgagtacgatgccccgtcccagcggccccgttccggccgctcggccgcctcccccgcacgctctgccaaccatcacgcaggccaccctgcggacagacagacggtcagtccggggccggagcggaaagcctttctgtggccgccacagcgcggcgaacgtgcgctactgggcgcccagcacctgcccagccggggtgcaaacgcccgggcgtcagggtgcgcgctaggtccccggcttgggccagccgcgcctcccagccctccgcccgcctaggcccgggtcccgctcgactaccggcgcgcactcacctggacggtctcagcctggcgtcgcgcttgccgtccaccacggagggcacacagctggtgagctcggtccagtcggcgtgcaacccgcagctccagcccgtggagaacctggagaagagccaggtttcccgcttacccggccggtggcaagtgcatttcttctgacccacgcggcactcgcacggctgctccagctggatgttacgcaccaagtggcggccgaaagtggtgcccccggtcttctggatgtgcaggaacacgatcaggtcatcgcccttgatgtcgaagtctaccttgcgcaggaggtcgccgcgggtgaaattgtagcggggcacgaacctggcggagctctcatcctccgagcggtacgggtccggcaccggggagctgaacgcctgcaggcggaggagctggcattctgtgccggggcacacgtattggaggacgatcacggcaaataggaagagcatcaccaaagctagcagcagcttgttggatttctcatccatgttcccgacgctgggggaaacccaagctcgttacgtcaatcccgcagctcagcccgcgctcgtcgtgcccccgcaccgcccccttcccctggagccgctgctgcgcccctctccccctcccctccgcaccgagtactccacggcggcggcggctgcggcggcggctcccttccccgcttccttccttcccggcaggctcagcgctgtggcttctgcggcacacacacacccccaccccgactccttcccgcgggccgttcgccccctccccccgccagagctctccggagctccccggagcccctccacggggtttagccccagtgggacccctccgggcccagtcgccccactcctcaactcacgcccccagtccgggcccccgcgtgtctcgctccactctcggtggctcccgctcccatccccatcccgcttcgtccgccggactctccgggctcttctgcccctatcctctttggagcgcacacctctgtccgggtttctccccgcatgccccgaagccctccttttgccggcgcccgcgcccgcttgcccacccggtaggcggcctcgagggagctcggagccgggggctcagagttaccctgggggaatgagccggccggcagcccgacttgctatcggagacgctgcgctgccggtgcccgcggaacagtagcgacggagccgcggcgtgggcaaatgcgcgccgcacccctccggagaccctagccgggccaccaatggccagctggaactttacgcccttctctaccccccgcggctgccttccctccccgtacagcaccttcgcgccctggcctgggagcgcgaaccccgctttcacctagaacgtacctggccatggggccgaaaatcttggagaagatcgcaccgagcacgtgcttcagcgagtggcccagggcggccaggccccgagtgagcagggcccggcagagggagcccaggtcccagcgtcgcctgaggacgtgcatccgcctgcggcggccccgggacagcagcgcgaaaagcggggcgcacgcggctcccgccagggaagaagacgcctttcggggcttgtccaggagcggccgggtgtggaatccgtgagacacacccctaggagggcccgcgcgaactgaggcggcgaccgacccgggccggctcgctgccaattcggcctctactctggaatgccggcggggacaggtggtgcggacgggcgctcctcgctccggttgccgcggcggctcgaactcccggactgcacacgcaggcagtgccattccccccttcaggcaactcagggtactaaggatcacgagcgagcttgaatttatataataatgcctcacgcctaagagctcgagccacttcacaagcagagaacctgggttttctcttttcttggagtacggaggtcactccgcttagcgcatcactccactttggctcgtaatttcaacctctcctaaaatagcaaaggcgcaaattggagcttttccgtctctctttgccaatttccattctccagcggaagcgggggcattttctgaaaaggtaagtcagcatgataaaaagacagcaggaccaaaaagcattacagaatgagaatctgaccttttttagagcacagactgtcttcttgctgaatcctgtgtaccaaaccctgtgcctgcaggagggcttgactcataaaaggtttgttgaatgaatggatacataactaaaaactccatcagagtgagaccgtctaatccaaggtaatgtgacacatgaggaaactgaggcccagagaggggtagggatgtgcccaaggtcacacagcagagccccagggtttgaacccaagaaacccagcaccatccacctatttcctgatactaacaccaccttctctaataaataggcacagatcttcctcaagctccagtgtccgaaaggctcttttctgctgctggaccaggaatgcagggtttaacagggaaagaatggatgttccttcaggaaaaggaccctgggaactcaggagtcagtctgtccccatctgattgatcaaaggggcttgctgtacatcaggacactggtgtttccgtgactgagtgtgcaactccctccagtcccactgctacagaaggggcaccggttggcagcagtgtttctgagcagtgctgttggcactggggccactgagtgggagaatgcagaccacgagctgagtcctggggtgggggcatgtccctcctggagacaggctctcccagtatctcccttgctgagctctgctccatccgtttcctgttctatctatgccatgaagcggcaagcctaagaatagtccagaagtcctgggaaatctgtccctgggcagcactgggataatcacttgcccctcctgagcctcagttttcttgtctgtaagataggaccaattatgtcccctgttttgaccaactgagtcaccgtggggatgaaatgtagaaacctttaggcc

SEQ ID NO: 6349 - DNA, 1638 bp, artificial
  synthetic oligonucleotide
tccaggaaaagagaaattactttagagaagccatacttgtcacagactaaatgaaaattaatttttaataagaaagagccagaccagaggctcctaaagcccttaactgggctttatagtaaaacctgagaaaggacttgcttctttaatacgtattttcaagatccacatttcacaaaatggcataaaaatgcagaaagctacagcattagagcagatgagggaaatgaacttggtaataagcactttgaatatttatcttctgtactgaagaaagttgccttaatggttatcatcatgtgggagatttagctgaagcagaagatgatattcaaatccccaatgagaagagacaaaatgcggttggtagcgctcaacaaggggttagaaatgcaacaggcatggggagaggggtctacctgttgtcgagggtgccagtttcaaagatctgcacagtgatcaggatggctggctatagtggtgtctcctgtaggttgacctcaggatggttagcaaatagtgccaatagtagctcacatactgaacactgaacatctgctgtatgtcagatactgtactaaacgctttgcatgcactatctcaattagcattgccagcaacccaatgagatagttacttctgttgtacttactttacaaatgagtaaactggagttccatattacagccacacaactaggaattatagaggtggaacttgaacccagatctatctaagtcacgagccaataataactctaatgtctccctgatcatcatccagctccagggtgtctgagtttgattggagaatatgagacatcctgttccaaaatacaatgtcaagagacttagataatcctcatcccaggcaggagagctggacagagagggattgtgtgtgtgcgtgtgtgagcacacatggacacatgctgtcatgcacatgctctgagagcagtgaagaagatagagagcccaaagcctgaattttagtaaagagggaagcagagatgaagacactgctgactagacaactcaatacacacacaaccttgggatgtcacccgcatgatctgacactgttatctttgggaaatgtcacaagcaactttgtccactctactaaacaatagccttctgaaagtctaggaccttggcttcttcatttttaaaaattcttcataatgctcaataacaatcacatttagtctagggcttcacagtttacccaatattttcacagacactgattggatctttacaataattctgcaaggctgctgttagtgtcctcactttatttatgaggaaatggagtccctcagggctgaagaaacatggctagggtcacataacgtgtggaattgccacttctgacctctcccttagctcccccaagcacacataccaatgtcagacaatgcccacagcacctcacaacggatctgggacagaagaggtgctcaagaaatgttagtttttccccttacttgccaatttatgacttaaaatgttttctttccactaactacattttaccaggtacccaatatcttcaacagagactagtccacattctcagagaacttaccatcgatataaggaaatataatacacctaatatgcaagagcctgagga

SEQ ID NO: 6350 - DNA, 2056 bp, artificial
  synthetic oligonucleotide
tttacacttccctaccatcatcctttgcagtttcctccccacttgaggacagatgtttagatctcttagttgattatgtgaacaggtggcaagaaaacatgggttcaatacctgctgcagtagttggcctatacacacaaaaatcaatttctttaaataattttcttaaaacaacaggtgtttgttaacttacttcctgaaaacccttacagaacagaaaaaatatgaacacaaatagcaggcattttacagaataacgaagccagatcctacatcatataaataacagattcctgtgggttagtttagtttgtcttcatatacaaaactcagttaccttccctattgttcaatctgctgtcatcttagatacacagagcttttcaccagctgtataaagaaattggatcaaagcttcctacaataaaatgaaaaataattaaaaatgatgtttctcaacttccctgcaatggtgtggcattatggctgatgtccatgaaatattcaatgtggtgagttttgctatacttcctatattaaagcaaaaaaaaatttttttttttgagacggagtctcactctgtcacccaggctggagtgcaatgacatgatctcggctcactgcaacctccgcctcccgagttcaagcgattctcctgcctcagcctcctgagtagctgggattacaggtgtgcaccaccatgcccagttaatttttgtatttttagtagagatggggtttcaccatgttggccaggctggtctcgaactcctgacctcaggtgatccacccacctcggcctcccaaagtgctgggattacaggcgtaagccactgtgccccacctaaagcaaaaatttttattgagacagtcttgctctattgcccaggctgcactacagtggtgtgatcaaggctcagtgcagccttgcactcctggactcaagtgatcctcacacttcagcctctggagcagctgggactactagctaatgccaccatatccagcaaatttattttttgtagagacgaggtctcgctatgttgctcaggctggtcctgaattcttaggctgaagcaatcctcctacctcggcctcccaaagtgctgggattacaggcatgagccaccatgcccagcctatattaaagcaaatttttaagagatttttatttatttcttataattacctggaatcatgagagtgtccagtcactttgacattttacctctaagatacagttttctcagcaggaaataaaaataattaacatgatttccttacatgtttctaaagaatacaatggtctcaatgacatactctgcaatgacatactctgctctctgggcatgcaatgtggcaaaacagctacccatacaggggaattgcttcctacaaaactgcagtcctcaaggaggagaaagaagaaaagaggagaggggaagaagaggagaaagtggaagaagagaaaaagagatgggaaaagggggtaaggaaggtaggaagtgtggtgggggaagaaaattcttgagagcagacttgataggggtgtgtgtgtgtgtgtgtgtgtgtgtgtgtgtgtgtgcatgcgcacaccatgcccaaactgacagggatattgaacttgaaatacactagctgaaatgcggagccaaatgagtaattaattacccaaaagaaattaagtttttaaccagaaaagaatgagacatcttaaagaggcagggtttagtaatttcttcatcagtggaaatggggactcgtgaataggttgagatcagttatagagaaagttacattgctacacagatgagttactcgaaatcacaaatctgtgacaagatgccaacccctacaaaatttccaagtggtatcaaaatgtttgcatgtctttgggaacttcctcttgatctacaattgaacttcacggaatagtagttttgcaatacattatcagctattatgtgaagaaagtgcttcatggataaagaaatataggaaaagctgagttaaataaaagagacaggtatttgtaattgcagggcttctcagaatc

SEQ ID NO: 6351 - DNA, 726 bp, artificial
  synthetic oligonucleotide
aaatgtagggtgccccaggcaggaggaagagtaaatgaaaaggtcctcaggtgggaatggacttggcatgttggaaacagaaagcaggccagcatgactggagcatggtaaaagaattgaagagaaagaagttgtggaagttttgtaaaagagcgggagactgaatggactagtaaccttgctgagtagcaccaagggctgacttaggctaatagtcatatatttacagcaagaccaatctgcatattttttctccagccacgtttagctgtctagttgccatggttcaggtgtgtaataggcagagccttgaatttaacttgcttgaaattttgccattcataagtaaccgagtaagaggaaaatgggagctgaaggtgtagagaaaaaaatgattataagtacggacccagaaagggtggaatggaacaatgaacagaaacacatgaaaaggcctaaatatcacaaaatactacggagtaggggagaagcatcaggggagtaggtgtccagctctcatttcagcagctacaattccatcccctgattctaagcagctgtcaactgcttgcagactttcttctcctattctcctcccaccttcctttctgttcttctattcattctcatcccggctccaaagctggaagtaactaatggaaatggaagtggagagttgaatgttaggggcacgtagactgcgttagagacagacatgatcagatg

SEQ ID NO: 6352 - DNA, 1812 bp, artificial
  synthetic oligonucleotide
tactaccttagtgaatagtagattatgatctacaactgccatttctctcccctatttccctaattcaatctcctgcttccatggctcttgacatacagtttcttcttcatgtatcgcttctagtccattaagactctcctgtctgctttccactctcttttcactctaaccatgtagttctctcttatcccaccccacctcttaagtggtgcataatatgaaactgaagggtttttttatttgttgtacttgttgagaattccttgttcttaatttaaaaagcaggtgaattcaatgctttatggttttccaaggaagcacctaaattaagttgctttttgtacatggcccttgattagtttttttctttgtgggtcagtggccctcaatagaaaaaaggtcccccagccctgtcctaggaggcttggatgggattcaatgaagcgtgcttttaaagcttaactctctggcattaaaaacaaaacaaaaaaaatcactcgaaagagccaaacttttttcaatcacaccagctctatgtaatttctctttagtcttaatatcaatgccttagttttcaaagctgaacaaagacaatcacaataaattactctcaatcctgctgagtgtgtattggttctttttttttgaggcacttcaaatcaatggttaaagaagtaggcattgaatatgaggaatctattccatcatttaacagcgctctgaggcaatctgtgaaactgtgctttctcattttatctcatttactcctctcaccaaaggctgcctctgatgtacaaatggggtgcggctaatgttcgtttattttcagttgctcataactcagcttcccatagaaaatgttataaatggtagataggtgctcaggccagccctcagcttatttactactaacttgactattttctctttctttctttctttattttctttctttctttctggtttttttttttttttttttttttttttttttttttttttttttttttttttttgatggagtttcgctcctgttgcccaggctggagtgcaatggcgtgatctcagctcaccgcaacctctgcctcccgggttcaagcaattctcctgcctcagcctcttgagtagctaggattacaggcatgcgccaccacacccggctaattttttatttttagtagagacggggtttctccctgttggtcaggctggcctcaaactcccaacctcaggtaatctgcccgcctcagcctcccaaagtgctgggattacaggtgtgagccaccacgcccggtgactattttcaactatgtctaacaaccattttctatatctctctcagaaaatacatttagaaatccaactagatgccaagaaagtgtctctccaattctccccacttttttgggaggtggggcagtaatagaggaataccggtagttaccacttaggggtcagctttctttctgtacctgcgggaaataaagaaaatctctagtgtttactcccccagtgtcctaaatggagaaaacagagccagaaaacattgcaagacactggtagagaacccaggctttgcctgcaccagtgggatttttaaggcagacactcttggtactcggactaattttaccaataaagcaaccaaatgcctatggtaaataagagagacaaactgttccttaagggtaaggaccgcagtgaggaacatttgagaagaacagactggaaagcactatgaaaactgcaaacataagagactatgattttgcattggcctttctagaagagtgcctcacttgagttatgaag

SEQ ID NO: 6353 - DNA, 1228 bp, artificial
  synthetic oligonucleotide
cctgcttagccaggagatcgacttgatggtgtctccttcctcaaccttaggctaagttatgtctaggaaaaaatgtaaagttctcataatgttttcttcctaagcaaaactattttaaatcatttttaattagcaagttctttctgtgaatatactgtttcctgttcttagggtgaccacaaattataggccaaaccaggacacatgggagagtgaaagaaggtgccactaacaattatactgagggctgggtgcggtggctaatgcctgtaatcccagcactttgggaggccaaggcgggagaatgcttgagcccgggagtttgagaccagcctgggcaacatagcaaggcccagtctctacaaaaaattaaaaaattacctgggcatagtggtgcctgcctgtagtcccagctacttgggaggctgaagtgagaggatcacctgagcccaggaggttcaggctgcagcgagccatgattgtgccactgcactccgggtaagttgacaaagccagaccagactctgtctccaaacaagaacaataacaactatgctaggacagcaggtgtaaagctgaactgtgctaggcgaaactggaacaatgagcccctttccttacctataatttttcaagaaaagtggcaggcacagtggcccagcactttgagaggcagaggcaggaggactgcttgaggccaggagttttaggctgcagcaagctatgacagtgccactgcactccagcctaggtgacaaagtgagaccccatctcttttttaaaaatgtaaaaagaaaattatctatttgctgagattcttttgaataaaatgacaaaaaacatggcatacctgttaaacaccatgttacctatcttccaattgtgaatcatcttaaaacactattggagattaactggatgtgttgttgtcttcttggcagcatatgaagttttactttaatttcaattatgtggatagccaacctaggcccaagacaccttggaggcagcaacacttcatttacacagctctgcagcacatttcccaggactccaaacatccacggtgattgtggaattcattctagcctccgtatccaacactaagggaaggttttcaattcataaaagcactgttaataaaatttaccatttttctatgtgttttgtgttctcatgacatatcatctaaaaattgtgttgattcacttagaacttcacttttaag

SEQ ID NO: 6354 - DNA, 3631 bp, artificial
  synthetic oligonucleotide
cgcctgggctgctccaacaatttcttcgcttctatttctagacagacgccagttacactccaaaagtgcccagcaacttccctcaattacctttgtaattaatatgtaattgatgactgcacttaatctccaaggttattaatagcccttccaaaaaatgacccccaaatcttcctaagcctttggaagcgcctggttgaaattacagtatttcctttgctggctgccggccccctgcccgccccacccggagaccagcacggcaaggcaaaggcgcgctccactcacttccatgaaaggttcggagtggaggctcagccccccccccgggctcgaatctctcactcctccgttagattacgctggccaccagccagctagattcgtggtgctttctgagcccccagggcgaacgggctacctgcgcggccggcggggctgcgcgcaacagttggccgctgctaagaagacagtgcgacccggaggggacccggccggacaccgccgccagcttcgctgggagggacgcagggcacccgccgaacgctgcctccccagcgctccgagaggggctttcacaaatacccccatacaccccccatcccaccccaccggcgccaaaatccggtgaactttctcacaggctaagccgtctctatttgcataaccatctccaaactgagattcaggtttcctgtaatcagtcctttcaaaggtctgtaattgaaagtgcaattaacccttaaaatgaggtaagaaaaaagaaagaggggaaaaatactcctctggtctgataccttccggaaagtaggagagttcccaaaagtcagggtttggaggggtggagagtgggggtagtcgtttgctttttaaaggcgacttctgaagcggttgcggctactaaaactcctaatccttgtcagcggtgcaagagaggcggggagagagttttaaaagaacatcaatgaaacatcaattcaagttccacgttttgcgacccccagaatctagcaagctccgggacgtttccctccaccacaccccactggcgacccccacccccacccggcctctcctcacccatacaacaaagcggggcgtcctataaggagttcaacccggaaaaggagaagtagccggtgacacgcactttgagggccacagtcctcaggggcttcccgggacggcgaataatgcaggggggagaggaggagcggaggcggggagcggagcgcgacagtcgcactgggcaacccggcggcgcccctccgctcgcagtgctgggaaggggggagcgctgcgcccgcggggaacgtcctgcgcccgggctgcctggctctctcgctcgctcgctcctgccctctcgactgcccatttctccctctagtgtacctgcgtccggcgcagggggcggcggggcgggggaagggagttgcagcctcccttcccgaagtgtcggtctctgcgcccacctcccgggtgtgcccacctaccgttgatctcgtggaggggggcatcgttcttgttgaagcctttggacacgtaaagacgtcgcacttccgagcaacttttcgacttgagctcggcagccagcagcgcggcgctgagcactgccagggtgcagagaagcgcgggcaagccgaaccgtgccatggtgcgggccggggcggacgcgttcccacctttgggaccggacgggaagcggcgctacggcagcgggccgagggctggcggagtcggggactagcgagtggagctggagggagaaggagttggagttggtggaagaggcgagcaggcggaggagacgcggggcgaaaagtagagctgggcctcgcgtcaggcaacggtccccggtgccaggcgccgggccaggggagaaggagggcgtggaggcggcgcgcggcccagggaagcagaggcgcgggctggtgacctcggggtttcgcggggcagcgaacccggcaagctgactggccggcgaggcggggacgcggggaaggagggaagggtggcaggcgccgcggggaccgcagagggtgtgggcggcggcgggcgttcgctgcgcgctgcttgggctgccctgcgctggtccgctcgtccggctggactcggctcggctgactctgccctccgccgcgcggctgtgcccttctcagctctgccgctgattgactggccggcgtgcgcggcgacgctccgcaaacttggccaagcgggcggcactcggggggagggggcgggcgtcgtgggggggccggagacaggcgggagcacgctgggccgggccgggagaaaacctggaagccgggttggatccggagcggccaaatccacttcctagggggccgcaccgggcgcccggcgctccttcgcgtgacacgccccacccggctcctccttcctcccctcctcctcggaggcggggagccagcccaccgccccccaaccacaaagggaaggccaactactccgggctgaagggcccaggttctggggaacgggacggcctgggacttgtcccgaagcccatgtctgagccccaggccttcttgcgcgcggccacctgacccgccgcctatgggcaaaagccgcgcggagccctcccgccgcgatatccgcctccccgctgccatcccgcacccgcggacgctcctatccgcgcagctcccgggctgggcggggaaggcacattactcgcattgtttcgctgcaggcagcagggggatttggggctccgagctcgtcctagagcctcacctggtctccccagacctgcttcccataggacggtactcgtgaaacaccagtttgtccaggaccccatcaggcatcctccttcccgcatccgcaacactccaacccctcgacgccactcccacccccgacccggttctactacaagtctaaccgaactctgaagcgggagaaacccccaaccgcgaggtgagggggcaaagacagggttgaccgcagagatcttggagaccatttggcccaacccttccttctattaagggaactggggcccagaaatgggaagcgacttggtaaatagcacgccggggaagggggcgtccagaacccgggactcttgactctcgaatttcatggaataatggtagcccaggactcccaaaccccctaccccctcaagccccttgagagagactgacacccctctgggactcagtccccacttttccaccagaaaactggaaatgggagagacttcccatcttgcaagctttgtcagattccattaatgagtgtttttttgaagctcccagcgctccttaaatgaagggaactgtgcagctcgggaacttgtcattaccgttgttattgttacaatctgctttaagaggttgggttgagaagtgcctcagacacctcgggagtgtgctgggaactgggcagataaaaagggctggaacttattatttggctagactctcaattcccataaaattacatagggcaaagatacgaaccatcattacagttatcaccctcagagggtttgttgagactttctccactgttgtttgtaaaccacgttgacatggctggctatgaggagctgttattttgaatacctgcttgcagactcttctacattttgttaaca

SEQ ID NO: 6355 - DNA, 3585 bp, artificial
  synthetic oligonucleotide
tcgcaatgttcaggctcctaaagggccttgtttagagaagtgctgcagcaaagcaggagaaggtatattttaaagtgacaggtctaaaaatactgctctctttttgccctttcacagctgcagattcccaatcctgatcctcactgggagaaataataaaatgcatatgtttataataaaaatcatatttccctcttcccgtgatgtctcccagttgtaggttcccatccgtttgctgtttgacctatcatttaacaaatgtattttaagaaaagtaatcttttctactgacatgtcctataaacgtcacatcctcagcattggttctcattgaggaacagagatgcatgttttgaatatttccataaatgcttttcactccattcccaggcgaggatttttaaatgcttgctttgagacaaaatatacagaccatgcactgtacaatgatgtaggtctctcgggcctgattgtcagagggcaaggtgagagtttgggttctggagaaatttgctacaattggcagctgaaacccaggcctcagctcttctgtgggtcatcattcaggtgtgctcagcgcaaggcatcctgggaagtcagtacttgggccttaccctgagtagagtgaatgggactctgagagacttctcttgaaggcactaagtgggattgtgttgacggtgggctaagtcaacattcattgtgcaaagcgcagagaaagcatctcttcctttgtcctgaaggatgaggcccaatcagagagcaggcacagatcctctgtcatttggaagggagctgatgttgtttagagacatctatccatcgttgttctatggattaaagaaaatgagtttaatgcactcagtagggcacctggcacatagtacgcactcaaggaagcaagatctgtcccacttacagaaagagcaaggaaagatatctcaaggccactgccaactgtgttggaagtccaggcagggattgtggcggggactaggaataggaaggagacatggaaatggtgtagtacaaggcagaacacaaacagaagagaattaagggagccaaggcagattacctacaggatgggagagaaaagggtaggaagagctgtgattaggtgtcaggcaggtagcgagttaacccctatatacttggtcatttcacagttcattcattcattcatccatccaagaaatatttactgagcatctactatgttctttttttttttttttttttttttttttgagatggagtctcgcctagtcacccaggctggactgcagtggcgtgatctcggctcactgcaagctccgcctcccgggttcacgccattctcctgcctcagactcccgagtagctgggactacaggtgcccaccaccacttccggctatttttttgtatttgtagtacagatggggtttcactgtgttagccaggatggtcttgatctcctgaccttgtgatccgcccgcctaagcctcccaaagtgctgggattacaggcgtgagccaccacgtccggtgagcatctactatgctctaagcagtgctctaagcactagggacacagcagtgaacaaaacagagaaggatcattctctaagagaatttacagactcatggcaataggcagtgagggagatttgggagtgggaaaatggtgtgggaattcagagctggctttcccaaacctagaaccctctgaatggagtcccagaagttgctcatctcagcccttcccaggtatggtttgtcctaaataatggtgaccatcccacccaagtttcttgtcagggctggctttgcaggaagataatgaggagtatttcagggggaaagatgggtttcccttcccttatttcacgtggccagaaatattttttttgcagagaagaaagccttacttttcccgtctcaaggcccaaacagaccggaggaataaaagctttaccaaggaggagctggatgcaagcagggaagaggagggagaaggaggctaggttctatcagtcattcaactaatactgagtgactcctctgtgccaaactctgtgctagatgataccacagtaaacatgtaacaacctctgtcctcgtgaagcttacattctggcagataataaactaactaaatgataaattatcatcactatggagaaaaatgaagcagggagaagggaaagggagacttggggaaagggttgcaaattcaattaggggagtcagggagtcatttacacaaggcactatttgaatgaagaccagaaggaggagaaggggtcagcctaggagatctggagtggggaagagcattccaggaagagaaaacagcctgagcgaaggccctaaagtaagtgtgctaggcaatttttttttttttttgaaacagtgtctcgctgtgttgcccagattggagtgcagtggcttaatctcagctcactgcaacttctacctcctgggttcaatctattctcctgcctcagcctcccaagtagctgggactacaggttggcaccaccacacctggcctcatttttgaggaataatatggaagttgtggctgaaatgtaatgggtgaggtggaaagcagtataagatggcactatgggaggtcagattggggcgggggaggttgttgaccatggtaaggactttggctttgactgaatggaatgagaagacataagaaggtgctgagcagaagagtgacatgccctgctctacaattcacatggatcgggctggctgctgcatggagaatagagtgtacgagaataaaggtggaagctcagagcgcgctagtgccataatgcaggctagagctgatgatggctcaggccagggtggtagagggggaggagatgagaagtagtcagattctggagatcatttgaaagtggaaccggctgggtgtggtggctcacagctgtaatcctagcactttgggaagccgaggcaggtggatcacgaggtcaggagttcaagaccggcctggccaagatggtgaaaccctgtctctactaaaaatacaaaaattagccaggtgcggtggcaggcacctgtaatcccagctgcttgggaggctgaggaaggagaatcacttgaacctggggagcagaggttgcagtgagctgagattgtgccactgcactccagcctgggcagcagaatgagactccatctcaaaaaaaaaaaaaaaaagaaagaaaagaaaagaaaatggaaccaacagtatttgctgatgattgaatgtaagatttgagagaaaatcaggagtccaggatgagctcatgtctttgatctatacaagtggaagaatagagtcacattaagagtgattgagaagatggtggatggggttagggaaggaggtagacaaaagtcaagaatttggtttttagcctgggcacagtggttcacacctgtaatccaagcactttgggaggctgaggtggtaggactgcttgagcccaggagtttgagaccagcctgtgcaacatagtgagactctgtctcttaatggaaaaaagtttggtttttgatgcgttatgtttgaggaccttatctgatatttgtat

SEQ ID NO: 6356 - DNA, 2410 bp, artificial
  synthetic oligonucleotide
atgatgaggtaagacctaaagcccatggtgaaatggcttaaccaaagtagtaactcaccaatgatgacacatgtagacattattgggcagaaacatttaggtcaggtaaagggggaaagagtgtattagtttcctagggcttccatatcaaattacctcaaattgggtggcttaaaacaactgaaatttattctctcacagctctggtggccagaagtagatctgtcttgtttcaggcctcttcttctgatccagtgacttgggtaagactcattgtttcagacctctttttctgatcttgttcagaactcttcttctgatccagtgacttgggtaagtcattttatttcccaggtccttaatttaaccatttgaaaaatgagttaacagtagttgccacccacatccccctcaggaagcacactgacatttttgacactttacaactaactttaagtcattttatttcccaggtcctcaatttaaccatttaaaaaatgagttaacagtagttgccacccacatccctctcaggaagcgcactgacatttctgacactttacaactaactttaagatttcttcaaacaagttcctccttacagtagagagttctggtaaactggtatgattcagaaggccccagaaagctctcctctatatggtgggttgaatggtgtcacccccccccacccccaatatatgtccatgtcctaaaccctggaacctgtaaatgtgaccttatttggaaaaacgggtctttgcagatgtaattaaggatcaggctagagatcttcctccagcacaggacagaaggagtagtggggagggaggcaacccagaacacctggataggactggactggagaggtgtcaatcctcctggattatctaggtggatcctaaatccaaagacaagtgcccttataagagacacacagaggagagacacaagaagagtaaaaggccatgtgaggatggaggcagagattggaatgatacaaccacaaaccgaaaaatgcctggagccaccagaagccggaagaggcgaggaatgattctctctgagaatctatgaagagagcacagccctgctgacccattgattttggacttctgaccatgagggctgtgagagaataaatttcagttgttttaagccacccaatttgaggtaatttgatatggcagccctaggaaactaatacactctctttcctcctctacccaacctaaatgtttctgcctaataatatctaaatgtttcatcattggtgagttactactttggttaagccatttcatcacgtgttgtcttcatgtatagcactctgtgagtaatgccctcatacctcagggctaaagactttactaggaatcttcctctagcacaggatagaaggagtaggggggagagaggcaacccagaacacctggatagtactggagaagtgttaaaaaggggggaaagatcaagaaaaagataaacagggactaaaaccaaattttctgtaaggtcagctttgaagaagtaatattaatagaggccgaatactactttaacagcaatagtcccatataataagaaggaaaaagtcttgcagaagcaaaaaatactaataatattgtctccgttgttggcccatattccagaaagtctgttagaagaatgctcagaccagtctaaaagcctcattctcactgctcaaaggcatttcttttgttatgcttaccaaattaggcatattttgaatacatgaaaaaaattgtttcaagctattagcaattgaataatcataaagggagctaggcaataatgaaagatgcagatcagtctgggcctccagcacaactctgaatttgatatgagcttttcttcacattcccccatcctggtcttcagcattcctggagatgttgtttaacaagctcccaggcaaatctttccaatgcccaactgcccttactgttaagatgcttctcccagctctaatagctaacttaaatttcagtttcaagccattgcgccttgtaattacattctcggccactgtaaataatccgtgccctctattatatctttcccctttccctatgataggaacctgtggaaaaaggaatcagttgccttgttagtacaacatacacactgcacctgagcaaaatgcaaccaaaagaaaatcaaacactcactcttgatccccgagtgagaagcgctgttattgatcttttcctttttcccattcttcagcttatccgagtgtctatactaacgtgctctagtgctgtggcatttatgccatcttggggaatagctgtgtaaatgctccagtaattttatacatcttcaacatagtgttgtgttagaacttgagtatctgaaggactgggaaggatagattttcctcctt

SEQ ID NO: 6357 - DNA, 1944 bp, artificial
  synthetic oligonucleotide
tcggaagcgcgggacgcgcgcctcactggatgcctgagttgagaagagaccctggaggccacaaacgtctcacggttacggaatacaactggccgtttcttctcagtgcacccctgacaaattaacctgtttgaaaccgactcttcttgtccgcattgtcagtgtagcaatttggtctaattggattctaaggcgggcgttaggagcccaaccgctggacagtcaatcacgcagggccattaatattcatctgttgacagcggcagccctcggctgatgttaaaatacgtcgttacggcacgatctgattgtgcagaacaaaaggcaggcgttcagaaactttcctccacctgaaatcatctcccctttaggatccagcctgtcaagaaggcagatgaatttgggagggggaggagttaaatatctttggactcctgctccctgggccagcagcaccggttttaaagcgatttcgctaacctatataagggatgctgttttgaaggaaaaggttcagtctcctcattttggggaccctcttactcaaaagtttgcctcagtgtgtcttcacccgccactgcagactcagaaatctgtcctcaactttgcttgcacttgggcccgtgagcttaggaaacccaggctgggtaaaggcggcggggggtgggggtacgttggggaagggatggctggagctgtggtccagctaaggctgaaattctgacacgtatgtgcgagcaaggatggcaaattcatgaggcaccagctcggctgtggggcgccagttcgcagagacccgggaaaatagctcccaccttctcgcccttccaaaaaacgggcgctcacgagaaggcgatccccacggttcctcccgctcacaccttccctgacagcagcgtgagactgggggatgtgggctccgtccacacacaccctctctccctccctcagtagacccagccaggccccaggcacaccgaccactcccaagtgcccagctgcagggcgcacgactacagcccggcggggctagcgcgctcagggtacagccaccacgcgcgccttgctccccgctgggcgctaggcacgctcaagggacccctcctcacctggcacgggagtttctggcacccacttgagtccgggctgcagtctctggaagaaggagcggacttggtgacaggtggcgtccggcggcggcggcgggggctgcgcctgtcccgggaagtccaagctgagcagcatcgccaccaccaagcacgcggtgcgcacggtcccggccatcctgcttcgcagggagctaggagagcgcgggagagtggcagccggagcgagagcagtcccaggactcggcaagcctggcagtggccctgaggagcaagagacgtgctgctacccagccgctgcaaaagtttcctcgcagctacctgggcgctgggcgagggcgggaaccgcttggcggcgcggggcagggcggggctgactggggtggggcggggcgaggagggacggggcggggcgaggcgagccgcgcggccagggggcggtggcggttgtgcggccggtagccggcggggtgcgggggcgcggcgtggagcgcggcgggggccactggggcaccgcggcgcggggaccgggcgaaggcagtgcgagaggagggtgcggagcccgcgcggtggctcccggcagccgagcccagctgcccgctcgcagccgctctacacagggcgctctggcataactactgcagaggggctgcaggctcgagcgcgctgattggcttcccagcagccgtccgctctgactggctctgggagaagttccccagcctcactcctccttcccgccgctcattggcctacagcctggagggcttttccctttaggatttttgtctccttttcatccttcctgggggcaggtgggggtccctgacttaggtcc

SEQ ID NO: 6358 - DNA, 537 bp, artificial
  synthetic oligonucleotide
aaacaatagttcatatggcaaatctgaacacaggatgttattgatatcaataaattatttttaactttttgagtaatggtaatggtactttttttaaaaaaagtgttcttataatatataattaaatatctatggaagaagtttgcctcgaaataatctattagggcgagtggagggttataaatgaaacaactttgcccgtgagttaggtggttattgttaaagttgtgctatttgctttaccactgcatatcttttgcattttcccttttaaaggggaaaggggagatgtcaatatttcttgtaatagaatagaaatctaaaaacagcctatttatctataataagaattggctaaatcaattaatgtagacccacacaatggaatattatgatattattaagaagaggtgtgtgctatgtgagtgtatctcctgatatggaacagcttccaagatagagcaagcaaaaaataatgtaaaacagtatgaataatatgcttccatttatgtaaaaaagggagataaatatacacat

SEQ ID NO: 6359 - DNA, 1509 bp, artificial
  synthetic oligonucleotide
agaggaatttgaaaatgctgaaaaagaacttttgcactacaaaaaagaaatattcacaaaacccctaaattttcaagaaacagagacggatgcttcaaaaagtgactatgaacttcaagctttaagaaatgacctgtctgaaaaagcaacaaatgtaaaaaacttaagtgaacagctccagcaagccaaagaagtcatccacaaattgaacctagagaacagaaatctaaaagaagctgttaggaagttaaagcatcaaaccgaggttggaaatgtgctcctaaaagaagaaatgaaatcatattatgaattagaaatggcaaagatccgcggagagctcagtgtcatcaagaatgaactgagaactgagaagaccctacaagcaagaaataacagagccttggagttgcttagaaaatactatgcttcttcaatggtaacatcatcaagtatccttgaccactttactggggattttttttaaaacttaaaaaaatccttccagtaggcaagtcattgagccaaatcagtgtttattgtattttctttgcgtattacttaaaatatatgtaataggatgttattttcattttcagtaaatcacagtatctataaaacatatacatgtttccaagcttctgctttctctttctgatgaagttattgcaggaatacaaatggaaacgaagctttggaaatctcatatcagagtgtgtgtgtgtgtgtgtgtgtgtgtgtgtacacacacacatatattcactcaaaaacacataatgattcaccaaatcatttatgaatacaaatcagcaattttgtgatctcgtaagcaaatatgtctttggcacgtgaatatttttccatctgtgttcattgatgttaacaataaaaatcttgtttatgtgtataagcctaacatatgcctgtgggtcttataactgcctgttcaaactcaatgggataccaaaaatgtatctgcttactttgggggtctaactttaattcggtacatataaacatctctggaaaaaaatgtagtttttttcttccccctgctgttttccccaggctttctcctttgacctggccacggttcccatagactacaagacgacttagagacattgctgtgaccttttgctagagccctgctcttgccagcagtggcttttgtgttttcttatgttgaccagtaaggggcattgtttacacagttcttccaaaactcgaccaggggaaaatttcgaagcttcctccccggcttacatcacaagttggcggggactgtggtgaagttggatgtcatctggataaacttttagtgagctggcttgatttttacagtaatccagccctgtaagggctccaggtgatgacaatttattttacacttatacatggtaaaaatgtactgcctcaatccttgggtggaagtgatgggccagttgactctttaccatttgtttgtatcagtcatcaagatatcctgtaataggagctctatttgcatgg

SEQ ID NO: 6360 - DNA, 957 bp, artificial
  synthetic oligonucleotide
agctgggaaggttgacataattaggaaaaaagcccagaaaagcagaggtatccatttttcatggtaaagatgataatttcaattaaaacacgattcctggatatatgtaatttgtaggccaaatggtgcccaatccctacctccctcaccccctcacttccctatccctaaaacctgtacctcaactcccgttcgtaagtgatgggagttaggaatagagaaatctcccggttgggttttctgagcaaagaggtaacatagcagctctgttatttctttcacgtctccaagggaaccatgactcacccttagctatcccccgggaatgtggccctcagagtgttcttttactgattcgtgattttgttatgtacacctggagtgatggaacataccataccagcttgtcagggttgctttgtgcaaagatcgatgacgtgtgtgaacccggatccatgcttggggtcctgagtttcaggtgccatggccagttgctagcaggttgtatgtgtgtgaccagcccctatgtgagtctctcagaccctgaaactccaaacaggcttccctgggcagagacattctgtccatgctctgtggcttgctgctcgagagggatagatcacatcctgtgtggcttcttcttaaatgaagaaggacattggaagcctgtgctgggcttctctggaccccccgatgtatatgtatgtatattaaagagagaccagggtctcactctgttggccaggctggtcttgaactgctagcctcaagaaatcctcccgctttggcctcccaaagtgctgggattacaggcatgagtcaccatgcctgatgtatatatttttccagctcccttcttttctgtatcatttgctattactacctcttagctattagtataaactgatcttgagttgtgtaaatctttctggtgattcactgtgatgggatgattgt

SEQ ID NO: 6361 - DNA, 2033 bp, artificial
  synthetic oligonucleotide
aaatgaccctgtgtctgtaatgcttatagcaaagtgttttccagttgtttgcttgagcataaattctttattttagcattctagcacaagtataaaatcatataccttatgtaagtttcaattcattcaacaaacatttaaagcaataaagacacaaataaaggcattcccattacactcctatgaaaacacaactcatcctcccaccccatcccatagcaacccctttcttctttgcttagggcccactttcctcctgatcttttcattgattcgtcttgtaatacttaccacatgttttgctatgaagatgagtggctcccagacctttcagttatcaatctgtcacaagtgcacactggtatctcgtgacatgatgatccccgagatgtctgagatctgtgcatccttgaccgatcccaaatttctgtatcacccatgacccctaaagactttttagagaattatattttgacaacataacaagaaaacgtggcatctcacacacacacacacacacacacacacacacacacacacacacacacaaaaccatgaaaaagtagagaaagaagaaacttcagctctaatcccaccacccttaagtaacaagtatgtctgttttgcaggtttcctccaggttctgctcctatttttcaatcatggtgtccatgtgattttgtggccctgattttttttaagttgatatcataagcattttccaggtttctgtatattctctatcattattatttgcaatggctgaaaaaggttccattgagtgagtgactagattaagtcaacccctatagcttgacacttcatttgtttccttaagataatttgattgaatctacagaaaataacaaacatgggacagaggtttaaaatgaatttaaatcatgcttttttggtttgtgcagattgacttgtacacggctgggtaacttatagtcactatttagtaatcctggggccaatcttgggcctcacccaggaagtgtccaatgtataggccaaagctcatcataagactagccagtttcaccgggaatttttgtaaccaaacacattcacctccatttcctgctctggtcactactgcatagtcggttctgatgaacaggtaatgacataaggaacacagtatgaggcctggaggaagagcccccagagagtagcctcagacaaatccttaacctccagaggccccagttttcttgtctgtaattattttttggactgccttaactctgtttgtctttcaaggttgtcacaaattaaaaaaagaaaaaaaagaaaaaacaaagtatttggaaaagtatgtaaacacacgatacaaaggcaagatgttgggatactgatgattctgtggccacgcctttagaaggtctggtcttagggtaatagtcttgtctggatggcaggtgggggtggacatgggggaacaggtgagggagctgccttgggagactcaggcttcaaagcaacccagactctcactggcaggttgctgcagtgttctgagctccctgactccagcagtggagccaaggccatgtttccaaacacccaccaactgctcagattatagagctcagtagtggaagggggagtgctcaaaggcccaagcaaccacaggaagtggaagtctttcggggctcctccctcttggctcaatttactatccccacaggggttttaagcctggctgaacttgccaaagagatcagctgtggagctggggaggagggaaaaggtggcagataggtgaaatattatgaaagagctagccgatccttgtttattcactgaggagtaactaatgggtgggcctgagtgggatgtaggggggcagggagatacacgtttgctacacttgatgtatatatactcttttttgcttaagagtcatgtaataactctaaatacaaatgcatatataaaattctagggttatgagattaagtcatactgcaggccaatgggaaaaaagatctctaaaaacatatgccaacttgcatatagccaga

SEQ ID NO: 6362 - DNA, 3450 bp, artificial
  synthetic oligonucleotide
ctcaggtagagaggccccgggacagggtgagccccatagtcctttggtgggcataacacagagggaggagcaattgtttacacatgtgcccagtacaagaagggaaactgatatttaagactgaagtggggaaacgggagggaaaggagcccttatcctggatgttagacgctattaaggaccatgctattttgtatttgtgagaatgatattgaaggtaaggaggtccttatccttgaagatgcatgctgaagtgtacagaagtgaaatgtcacgatgtctgcagttttcaaatgatgcagctaacatacgcacacattatgagagagagaacagaaaggaagcaagtattgcaatatgttaacagttgttgcatcctgttgggggtggggggtaaacagacgttcgttgtaccgttctttcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtgcggggtggggacttcctggcggctctcagcaacccctggtccgaccagactcggtgggctcggctgcaccacggatgagcaaagaaaccggcgggccgcgggaactgagccgcgcgcctgcagccgtcgccacggcggcccgcggccttcccccgcattccccgagggaggccgtagttgtcgcggcctgcagacagcgcgcagggtagcccagaaccgcgtgcgggcgctgggggaaaaaaaattaggtgccgaaagaaagcagcaacgcacgcgcgcgcacacacacacgaaatcagtttacaaaaataaaaccgcggaatctgccgtgctcggcgcccgagtttgagctacttaactctcgcatgcattttactgtcatatttctgtagagctgatggaaaatctgaaatgtttttgcaagggcgatctcgcagacccaaggcgttgcaagcgttgcgcagcctttcgctggcgtctgcggctcttttccggggcgcgaggagggaaaagagtagtgtctttcagggtctgcaaagctgttttgaaaagttaaccaaaaaggttttaaatagcaagattttcttttcaggaaaagtttttaaaacggctgatactcgtccagttttggtgggcgctaaaaagtcttattactaagctacaagtttccctgttaagattttcaaaacccctcgtggacagggctgaaagtttgccgggctgtgagacgtgactgaacacgcttctaaatcctcagatagatcatttataaagctctggtgcccttgggatgaaaggcttcgctgagtttttaagacttgccttcgtgggtaaatttgcttgggttgctacacgtaagcattcatttccccacctaaattagtaaaagggcagaagattccaacgacgtaagataaaagttgggtttatggcatgttctctaaagacaaattgcaacagctttctttattaaactccttttgctacctcagcaaattggagagccagttgaatattgatgaattctttgagggtgagtaatattgctacaggccggagaaagtaagggaggacaagcttaagcatttactcaagtgaacaaccttcaaatgtttttcaactatgatgtctcaaggattttcttaggacctttgaagcaaaccctgattctgcaaatggcttcttatttggtaggcccttcccaacctgacaaaactcacaggatataaattgccctaagaagtggtgagaaacttaccctagcattggaaacaggcacagcccaccacctggggtgttaggggggcctccaactggtagtcaggcaacttctcacggggcaactaggaacctgaaatgaaaattgcacaccatctattgttttttttggtcccttctgaaatattgtttcaaggcagctgttttcaggaaaatagcacatattttcctttctctttttgttccgtgaaacgttcggaaattatattgataaggaataatcatagtccgccgagggagcaatagctttgaaggctctgaaggcacagctgagaaaaataaattagctctagactagagatactcagcaaggaagttatgcataacatggtatttggcataaattttggaaaatgttttctggaaagcaactgtgaatgaatcttgggaaatagatactggagaatcaagttgcattaaaacttatttttttgtaaattacaaagaagatttctagaactttccatttttattttaactagaaatggtgtttaagattgtgtttttaatgaaggccttgagttagggaaacaagattttccttatgttgtaaatatccagaagtctttagagagataaaatcaggatagagttacaaatttaacagaaagaaaacaactggaattgtgttatgaagcttctattgtgtttttttgtaaaggctttttttcatggttcaagcagtggctagcagtgagtagtaactgtatactataatatataatgtaagaatgcttgtcctactctcagattaaacaaaaaagacagtgtcctttggtaatttttattttatgaaattagttataaaaatagttatttgcaaaactcagaactttgggagaaaaactctaatcttaacttctcctacccccgtgatcccatcaggaaaaagtagaatgaattagtaaatttttcctttctgccaaagagaagcttagtaagtcattagtagctgttgcttttgatttctagatctcttttccctcctcaaagacgcagaatcactgccttcagtgctgcctggatttcttctttaaaccaggcttttttttttttttttctgggtgtgtactattattgtcttaattattcctggatttttgcccattaaatcaaaaattgtctcagatgacggcaatgattggaactttttgctaaggagggcgagaatgaaggggtgtaggacagtctcagcgtctctttacaccgtgctggccctatagtgcaacctgtaagtgggcaggacttgctgtcctttgcacagagcgtgaactgacagagcaaaatgtaatgacaggagcatggagaccaaaaacccatctcttgtaggtgtggtggccataatggcggttcaagtatagtactaggctagatttagtcacttgctttcaccataaaattatggtaatcagtttcacctcacacttctagaactttcc

SEQ ID NO: 6363 - DNA, 1032 bp, artificial
  synthetic oligonucleotide
aacaataataacaacacaaataagtaaattctgatgtgagctggtcctggatgactcaacagttaagtaaagaaaccacctgctctggaatactgcataacatttgctgaggtgccttttggaagctgagataatcaccccatcactactgcactattgtcttgatctatagaagaccaccttgtcttaaatgtgctttaggtgggttttctttcccttcctgcctctctctttttctctctctccttctttccttctttctttaacatcatcccacaacctgggcctaattgccctgaatgaaaacctcctccttaagtagttctggactaggccaaggaaacaactgtttttgttcaaaccccaaaattaacacccaagtttaaggctactcttttccagagagctaagccatccatttcctccccctccctcaagcatctttcctgtactccttctcctccttccccaaagataatccaaatataattataaaatgtctagaatttctgagaaatgagactgttgtccctcaagcaatcattttagactacctcacttcccacccccacacgttcacttcttgtattatgttgcactgagtcagtctcaaaggaaggggctcaataatgtcattgagtttaggggttcatttagtacaactctccaaatttgaacacggcagaatctctttcctctgactttcataaagccaagaacagctcaccatgtgataggagaaataaacgaagatgactaggcatgtgacagcacacccttcagctcagataaagcttaaagaagaggtcactgagacccaggtttaaggttgctcatctctaaggggagagaaaggagattagggggaaagcagaatgtactttctaatgagcttgcgaatgcccagctcattggcacactttgagacttactccttcttgctgagaacagatcctcaaagcagggcagcctcccttctcctgctacctgcaattcctagggaagggtagagtagtgtgtgtgtgtgtgtgt

SEQ ID NO: 6364 - DNA, 703 bp, artificial
  synthetic oligonucleotide
tataacactgtatcaaggaagtaaagaattcagcatgttggccgggtgtggtggctcatgcctgtaatcccagcactttgggaggccgaggcgggtggatcacatgaggtcaggagttcaagaccagcctggccaacatggtaaaaccccatctctactaaataatacaaaaaattagctgggcgtggtggtgggtgcctgtaatcccagatacttgggaggctgaggcaagagaatcgcttgaacctgggaggcagaggtcgcagtaagccaagatcacgccattgcactccagcctgggcaacagagcgagactccatctcaaaaaaaaaaaaaaaaaagaattcagcatgttaccctcatatcactaaaatggaacgttggcattcccttatgttcatttcaggtccccatcagcattactgaggcagccaggaaaagtccatttagcctagccaatgaggagtcattaacaagttcttgtgtgcccaaccctaggctagatactgggtgagaaagaagggagggaagctccgtgaaggagcttacaatctagtgagcgatgtgccattcacataggaaacaatgagcagagaaaggagaaagctaatatctgctgagcacctgttaggcgccaggcaccttacgaaccctgtaaagcaagttttgcccccatttaacaggtaagcaaactgaggggcaa

SEQ ID NO: 6365 - DNA, 918 bp, artificial
  synthetic oligonucleotide
ttcatgcctactatgttcctgtaaaatgggaaactaaccactggatgcttgaaaggtctcagtacacctgtaaagcaatttcagaaccaaactttctttatccactgagcaggagattatggggtaattctgaatcccaggactgaaagggagctcacagccactttccagtgacgcccaaagatctgaatatgtcccttcccctaggccacagttatctggttaaggctctatttgaggaagaaaggaaaacttttcatcaggtgtatttgtgggattttagtaccatcatagcccatgggtaggtagcttctccttccttcaaagggctctgatttgccccctaattcatgtatggagttggcccgcacttctcccaaaagtagatctccagccactttgaggcttatgtgcaccagatctggagacgtttttagtaaaatatcaagtgaagtcttaatggattgctcaacaattttattcctagaaaacaagtcattaattacccacacctaagcattatcgttggccagatcacccattcattgaatttaacaacatttaatctgcctttaatatatgccaggcactcttctaagtgctttgtgatgcattaaggagaaaagcagaccaaaatacgttctggcataacaaattaggtaggtaaatataagatgaaaaaggctatggaaaaataaaaacagcataagggggactcaaaattgaagtcagattgtaactttaaatcatgcttttaacatgctgactctgctgcttcttcagttaaattcttttcctctgatggtgccttcagggctgccccaggcctctgccatcttataattcactcttggtaatagaaaacaaggaatttaaggtgaattgttgtgtctccaggaacaccctacctacagtaac

SEQ ID NO: 6366 - DNA, 1061 bp, artificial
  synthetic oligonucleotide
ttgtcatgtggattcaaattaccattcatttagattataagtcagtattttgtacctaagcctttgctattctctcctattccaagtttcaattgaaactccatcttttacttcacagcagctttcttttgatctattaccttgaattttatttgacctgtttcatattaccctgtaatttcactcttagctttgaaatccaaatgaaaacaaaatagtgaatttaaacagcacttttatttgaaattcagctttagtttcttaatcttaaaaaggaaatttttttttcatgaaaaactaaaacaaggtattttagcccacttcctctgccttgaatataatgttctggaatttaaattttacgtcagattaacattagtcaaactaaattcctaatgtcattttaataatactaatatttaaacatcagcctacatttagatatcaaattagtaatttacagcccacatttcattgaagaccagtaaacttgatcagagataaaggaggagaataaggggctcagaaaagaggatgtaagcaacaccagctgtcaatgaggagaggggtggtcagacaaggcgagagtgagtggttggaaacttcacctggttgtccttagattgacactttgaaatactattttgtagtcattttgggttatagtcattttcacctgtataagttatctgggctaattttaagagaatccacttttagacttcagcggaaaccaacataaatgctgcttttgctaggttcaacccagttcaattttcgtttaaattcaaaagactccactgaaatttttccagtaaacactttactactttcacctctctttcttcatttggcactcaatagcagtgtttcccagtattaatatggcaaaactttatgaaatttactttatattttagctctaacctaaacaaatctagtatcaaaatagatgctgaaatgatttagtgcattgatttcagcacagaatttattcactcaccttccatagattagagaatagctttgaattgaacaccacctcattttcattttgctct

SEQ ID NO: 6367 - DNA, 792 bp, artificial
  synthetic oligonucleotide
ccatcttctccctgtccagctcgctcccactagtgactctaactatctttgcctgcatgagacgtccaatccatagatcttcctttgttttcactgtcccccacccacttgatgtcctctctccccaacttactgagctttccttcgatgcttagtcactgtaatcactctcttgcatacattccagctcctcaccctcctcacatctgcatactcacttgacaaaatcccgaacctgtttcgattcaactctctgcctgctctgcacctgcaactgacatgtggctgagggaaaatacaaaaccacgatggctgatgactggtctcactttaaattaatgactgctagccacaagtgagtccttagagctgcgtgcctggcaaccaaactagttccctagatattccttctccaagtctcctaaaagactgttacatctattcctctctcttcaaagtgccaacactccctctcccatcctcattctatgcagatgatctcatttcctattttattgagagaatagaagcaatcggaagattaaaaggacttctcaaagctcctacaaccaaatatgttacaatggaagaggtgtctcccatctaggggcaactcttccacttgtctactagattcccacccctctcacctactcaagattatggctataacatttctcctgtcttctaaatcattaatttttcctgctctaccagatcattttcatcagtgaacaaacgtatctcttgacccacttccctctctaagaactgccccattttttctctttc

SEQ ID NO: 6368 - DNA, 1051 bp, artificial
  synthetic oligonucleotide
ctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaaggg

SEQ ID NO: 6369 - DNA, 3716 bp, artificial
  synthetic oligonucleotide
caaatgctgttactattaataatgataataatatacataccacgtagctcagactgcaatagataattccatgcttcctgatcctgtcccaactcaaaagttacctgaaagccttttctttttcttctcccttcacctttaccctaaatgtcctcatttgtgaacagagggctggggatgttttaccaggtgatttagagactaaagacaggaggccaagaaaacaaagcattttgcaacccaaatgctggcagagggatttgcagttagaaacgagatcaagttttttaggcaaagaataataattgtgtgtaactatccaacaaagatgcttgtttggggagaaataaatgcaggactcattcatattttcgaagtctttttaaagaccagaatgctggcgcttcacagaatgtcagtaccctttgtgttcctgccctgccccttcccctaccttcctcagctgttgtgggggagaaggcctgtttcagaagaagacaaggtagggtctattcccttgaggtgctgataaaacgttgtccagttgcagacacccctccccctcccccaagcttgtctcctgatggaagaagccagaaggcaggaacaaatatagtctcaacagactgcagctactacagtgcttgaactctcccctcatttcttacaagtggaaacagccttactggaagagtgatcttgcaagaagagaaaacatctatcaagagtaaggcaggccgggcgcggtggctgatgccagtaatcccagcactttgggaggtcgaggcaggcagattgcttgaggctaggagtttgagaccagcctggccaacatggtgagacaccgtctctactaaaaatacaaaaattagccaagagtggtggcgcatgcctgtaatcccagtaactcaggatgctgaggcaggagagtcacttgaacctgggaggctgaggttgcagtgagccgagacggtgcccctgcactccagcctgggtgacagagcgagaccgtgtctcaaaaacaaacaaacaaacaaacaaaaaaaacaacaaagagtaaggcaaaaactgaagcagcatctcatgagaatctaagccggaagaccatagtcatggcagtttatggcaaagagggaggcatgtggaccttgaagagcatcaggttcaggaggggttaaccccaatcacgtggcttaacacactcctccttcccccgcttcaggacagcttgtggttgggggaaatagtgcctcctagatgacaaagttatttgaatgctagttgaaaacaatgctggttcgagccagaatttccacatttttcacttaaactgtctgtgcataatttccaattctttctgggtatgttattccacccccacctccatctctgccaattctctgggtatggtagaaaggaagcacttttattccagtcaccaaagtttatgaaaatatgaatgacattaatagaatattttgaatcgtgtattgctttaagataggaaagtcagttatctttttctctggtggcctttttgcaccatactttccttccttccctcccttccttctttccttccttccttccttccttccttccttccttccttcctttctttctttctttttgagacggagtttcacttttgtctcccaggctggagtgcaatggcccgatctcagctcactgcaacctccacctcctgggttcaagtgattctcgtgcctcagcctcctgagtagctgggattacaggcacctgccaccatgcctggctaattttttgtattttttgtagagacgggatttcaccatgttggtcaggctggtctggaactcctgatctcaggtgattcacccacctcagcctgccaaagtactgggattacaggcgtgagccactgcgccgggccttgcaccatacttttcaaaacatgttaatggacactcacttcatggtaggcattttaaactgtgattctcaggaacaccagagacataaaaactaaaattatgacacatttgatagttcaaagacactcagatttaatatttaattagcttcctcctcattttatgaaggaagcgatttagaaagtgacttgtccaaagtcacacttcttgtaaatggcagagccactcattttattttattttattttattttatgtatttattttgttgagacggagtgtcgctctgtcgcccaggctggaatgcagtggtgagatttcggctcattgaaacctctgcgtcctggattcaagtgattctcctgcctcaggctcctgagtagctgggattacaggcgcccgccaccacgcccaactaactttttgtatttttagtagaggtggtgtttcgccatgttggccagactggtctcgaactcctgatgtcaagcgatccacccacctcggcctcccaaagtgctgggattacaggcatgagctaccatgcccggccagagagccacccattttaaagtcccatttttcacaatgcaaatgataatcccagcagggtgtttttttttttttttttttttaagatgacatctccctttgtcgccctggctggagtgcagtaggaatgtacaggtgcacaccaccatgccaggctaaattttgtatttttagtaggtacagggtttcgccatattggccaggctggtctcgaactccagatatcaagtgatccgcctgccttggcctctcaaagtgctgggattataggtgtgagacactgcagtcatccccagcagcttttttgtgtgtatagaaatgaacaaaatggtggccgggcacagtgggtcacgtctgtaatcccagcactttgggaggtcgaagtgggtggataaccagagctcaggagttcgagaccagactgggcaacatggtgaaatccaatctctacaaaaaaaaaatacaaaaattagccagatgctgtggcacatgcctggtagtcccagatactcaaaagctgaggcaggagaatcacttgagcctgggaggtggaggttgcagtgagccgagatcgtgccactgaactccagcctgggtgacagggcaagaacttgtatcaaaaaaaaaaaaaaaaaagaacaaaatgattagttgctatgagaattaaatgagataatatttataaagtggcatgcacagtagctcgttccctacactacacacgttttctttcctttacacacatatatatttttgagacagagtctcgttcttgtctcccaggctggagtgtagtggcgtgatctcatctcactgcaagctctgtctcctgggttcaagtgactctcctgcctcagcctcccgagtagctgggattacaggcatctgccaccacgcccggctaatttttgtatttttagtagagacgaggtttcaccatgttggctaggctggtctggaactcctgacctcaggtgatctgctggcctcggcatcccaaagtgctgggattacaggcgtgagccaccacgcccggcctctttcctttatattaatgtctacatatcaggtttacatagttataatgtttatgtccataccatgttgtgatctgcctttttcacttaacttaccacatacttaccactttaatgcctaaatagcattccatctggtcgatagactacatttttaagacattctaccattattgaacatttggattgttttcagtttttcaccattataa

SEQ ID NO: 6370 - DNA, 723 bp, artificial
  synthetic oligonucleotide
aatactcccaaagtgccttgtaaaaaatgaacaaaacattacacaaataacatatgcactttgtaactgaaaggcattgagatcacttggatttaatttagctacagtgattctgtaggactctaccagccacaaaaccggctcagccctaggctttctggagatactcagtagctttggtcctaagaataatttctgatggctgggcatggtggctcacacctgtaatcccagcactttgggaggccgaggtgggcagattacttgaggtcaggagttcgagaacagcctgtccaatgtggcgaaaccccatctctactaaaaatacaaaaattagcatgccctggtggtgcgcacctgtagtctcagctacttgggaggctgaggcaggagaattacttcaacccgggaggtggagtttgcagtaagccgagatggcgccactgttttctagcctgggtgccagagtgagactctgtctcaaaaaaaaaaaaaaaaaatttctgagaatggatcctgattatgattacactgcgatatttgcaaatgcaatgcttacctgtatgagactcacttgtattgatgtttctgttcatgatggttttgtgcatattttaagggagccagagtaccaggtgtggtactcagagactgtcctagaatactcagagaataatcagggaaagccaactattctacctcaggtctttgttataggtgggt

SEQ ID NO: 6371 - DNA, 2094 bp, artificial
  synthetic oligonucleotide
tcagataactagaaggcattcaaaaaattaagcaccaaagaaatgcaatatgagaatagtagctggaaatttactttgttcaaaactccaatcatctgcacagcacccagactaagacagaacactcccttgttttaactgctctaagcacacccaaagagtacaccagcctgaagctggcttattatgtaagaagggactgcagcattgcctggcatgtagcataatactttgctgaagagaaatccttggaaatgcctcagctgaagcacaagggcaggcccaggccttacattttggagagaggtgctctcagtcacagaattccagactgtggctggagcaaatgatgtcatcagagatcctcttaccatggtcaatgtcaaaattaagataggaagtccaaggacactatgagttttccaggcaaatataagtttaaaaaaaaacagtttgaacctttgaatcttgcctttaaaattattaatactttacagagcataaactgaaatttatcctattttgtgaggttttttttgggggggggttatgcaaagtttttattgaccaaaatatacataattgcagaggaaaatatattcatttactgtatttttactcccactacacattaagaaaagggaaaaatatcatgtgagttacccctctatccaaaaacaataacaaatcaaaaatgaaaatataagacctttgaagaggcagagataaacttgagggctctccgctgcagagctaagaaacgaaatagctcaaatacctgttgggttcctaaatgactggaaaatgaaaacttgtaattaactacaggcactttggaacaccttgtagaatacaggtcttttccatctacaaaccattcctgcgacagatctctgtacttaatgcagaaaacatctccaaatgtatggatgctcggggttgggagggcatcacagtagtattaaaaatggtactgttgactcctgctctggttctgggggaaggaaagaatccagtcggatgcaaaccttgcggccagagctggacaactcgcccctaagtttggcgcgtcctcgctctgcgtccttggccctcatctcccccttcccggcaccctggatctcagcgaactgtgaggccctggcagagaacggaccccgcagctggggctgcgagccacggcagtggggaagaagggcggttcctctccaaagggggtccttcggcacccacccccgggccctcgcgcgctccccttcccctgacccttttgcccccaggcaggtcacctggctcggccgctgcccgcctgtcctccagctgctccctcactccagccgcgccgccgccgcctcctggaagccgttcgccctcccgagtcacggggccggcgagcgggcgggcaagcctgtgccaaggctgcgggaacagatcaacccagccggagctgggaccctgccctgagcgcggccgccaccagggcgaaactggagagctgggctaggctcgccccagcggggaggggcggctgcaactttgcgcctggacgcgggcgaggagggggcgcccgtctccaaactctgtgccgcgcccgcaacctctccagcccagggattgttttttaatctaaagggaagtcagagtcttgtcctcaagttcttgttgccatagccgtgccgctcggcgggcggaggatcgcggggccgaactgggggtgccggaggcgcgccccgctgggtgcgctggctgcgagccgggcgagggtgcgcggggtggcgagtggaggggagcgactgccgggggagccagcccgcgaagcttctccagaccacgctcagctacccgcgccggtcccctcctgcccgcagccggagccgagcagcggagggaaagcggcctggaggcactgggccagcagcgggtaagcagtgacccggacctggatcgcagaagtaggaactggaagtgacagcggcgcaggcagagcagcagcagcagcagcagcagcagcagcagccctggtagctgtggcagcagcaaaagccgcggtgtacccgcggcggccacactgcgcatgctgctgccgcccgcttc

SEQ ID NO: 6372 - DNA, 2547 bp, artificial
  synthetic oligonucleotide
ggagttttggtcgctagcgctagcgcatgcgcgtgcgctctctgtttctgtctgtttacgaccgtcagtttctgtctcttctccagtgtctctcgctagcgcactttttttctttatctctcgggttgtgtgtctgtatgtgtctcaccgtttcctgattctttctcatccttgtctctcacttatgtctgtctctgtttctccgtctctcgatagcacgtgcacgctgtctctttcctgttactctcatttatctcttccactctgtttgtcactcagtctctctgtgtgtgtctctttcgctagcgcactttctctgcagggcttgcgctctcgctccctatctttctcacagtcttgcccgtctctccctcagtctctttctgatccattctgtctctctgtgtctctgcctgtcactgtgtcgctcgctagttcatgtgtgtctccgtctttccctagtgctctcttgtctctccatttctctctcagtctatttccccagcagttcatctttgtgggtccctagcgcacctgttcaatgtcgttcgctgtgtctctgcccgtctccgtgtctctccaactctcttgtttctgcgtctccctcgggttctctgggtgtctccttctgtctctcactggcacgtgtgcgcttgctctgtctttctcggaccctcttgtctctgtgtctctccgtgtggtttctgtctctccctgcctaagttctctctgcattactctgcctctctctccattgatctctaacactctactgcttgtctcacctgtctctcaagctatctctttagtgtgtgcactctctcgttggtttctctgtccttcactttcctgtcaccccaggactctggctaaacacttgctttgtatctttgagtgtgtgcgcatctctatttctctacatctttttcccatggcccctcaccttggtttttctctggctggatctctgtctctttggatctctgtctccctgtggactttattttgccgtggaaaccacctgccgccccggccaccgcgggctttggttaaaaaacccttagtttatcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctcc

SEQ ID NO: 6373 - DNA, 1500 bp, artificial
  synthetic oligonucleotide
ggaaaaaagccagagaagtgctaggaaataaataccagctatttttctgtatagggagatgtttgagggtggttaatcctccggtgtcttctctttccctccagatgtgagcagagtaggtattcttggatttcaaagacatccaaatatcagttccccaactggaagtatgtggtggagctttggggaatgtggatttggcttccagccctgcaggctctgattctgatagccttgaaggagcccttcaactgacaagcctcattacattctggggagagtctttgggatgaaacagggagactttgggatgatggcttaagaagtcacctagtccttttccctaccttcataattcagtagcagcagaggcacgatcaagctgatgatattaatggaccaggactagagggcaagaagctaccaacaagaaagggcccaaggtcccattgacaatcacacgttgcaacactggtcagtagtgtgccggcctcaggcttgttcaccttgtcagactaattgccccaattgctgtaccaatagctagatgagggaagttgggaaacccaagactcagccaagtattagttctagtcattcattctagtaataaacggtgcaagagtccttgagtgcctactttatgcttgctgtcttgtattaaatccttgaggaagctctgcaagttaggaaacaataccgtattttctgaaagcatgacacagtacataccactaggaaatggaaaaatgctgaacatttaaccatcataccatggctaacaagatacatcttgatttcaaagatgctagaatgtgaaaaaaaatgtgctttagaatcaatgtaagacagtatcatccctgtctttacagaggggttaagtaacttatccaaggtcacacagcaaataagttttggagctgagagttaaagcctactctaactccaaagcaggggcatttcctaggctacatcaaggaagagtgcagagacaagacagaagggctcccagacccagctcagataaaatttttgaatctaggtgaaaggggactaggagttgctagaattgtgaaaagacaagtgcatttgcagtggtaatggtttctttttgtaggacagacacatggttcccataggtggtaaaaagactaaatcagtcaatctaagttctaagtcacactcctttttgcttagcgagttcataataagtcgatggggaaaaatatatggttttgttctggagtgcctacccatgggggtgttttacatttttcagtgttatgtgttactctggaattcacttcaggccaactcctagaagctgtgtttgcaaaactgaaacaaaatcaagtaccacctgggtgtgagctaatattgcacattctgtgggtttgggcagtacagaagttctggatttcaaagctatgtctatccaaataaactaatttggaagagaaaatcagcagaaaataacttgatggattaaaactagagagc

SEQ ID NO: 6374 - DNA, 563 bp, artificial
  synthetic oligonucleotide
tctagtactgtcattctggtgttttggttagctcactatttaaaacgcttgcctttttctgaactgaagttgtcttcagtgtatttcactccctcccaaggttgcttgatgagctgacaattgattcctacagtctcgctgggagatgaggaatttttacaatttcctactatctaaatacaattctatttttgcagtatctccatgccctagtttggtccccttgtttcttctttataatgatttagcttttctcaccttttctctacttgttgagggagattgactccaggaataatgtggacaggcttgatttcatctgtaccaaaaattatttaagcccataaagtctatatgtatggacattcacagtgcctgatattagctaccttttgttgagtgcttatgtgagcaaaacactaagctaagaaatttacatatattatcttatcacatccttacagcacccacttgaagcatgttatgggctgaattgtgtgaccctccccagttgatatgttgcagtcttaacccgtagtccctcaggatgtgatcttatgtgg

SEQ ID NO: 6375 - DNA, 210 bp, artificial
  synthetic oligonucleotide
ctatttattatttttttcttgtattgataatgcttttgctgttgtattttaaaactaattgctaaacccaaggtcacaaagacttctcctatgttttattttaaaagtttttatagctttatgtttcatatttaggtttatgatctattttgagttaattgttgtataaggtgtgagcttcagatgtaggttaatttttttttgcaaatg

SEQ ID NO: 6376 - DNA, 1476 bp, artificial
  synthetic oligonucleotide
aataccctaattcctctaccctaatgggctgtgaaagcatccagagaaaaacatgggaataaaaacatttggaaaaggatgacctctgactttaattataagagtaatcagtagaaatattaatggtaatgattactttttctaaatgtatgtctttgttctctttctttcctctttcattctaagatagattgaaaaatctcagaagacagttaccaaaagtagccccttgcccccaaatatttctgtggccttgaccagtggttcaggatcagaaaccctgcagaattaagaaattatagtccagatcgaattttgctggacacctagtttctgctctgttaggaattcatttggctgtcaggagagtttattaataaattcaggttttctttatgatcccaggatgacaataccaaccatgaaatagttacagtaaatgctaccctatttattgaacaattgttacgtaccatgtactgtgctgttctcacaaccaccctacaaagtagctgttattatcatccccattttgcagaggagcaaattgagacccaggtaggttacttcatttgttcaggatcacaaaggtggtaagagacagagaccatgatttttctgtggcattttgctatcagtggaaagggtaagagcaaatgaaaaagctgtcctactcccaacacctctgccagcctagatctagaatgaagactgttatacaacctgacacctctaaagagacaccctgcacggtccaccctacagaaatgtaagcacactttataaccaccaacgttggctagggggctaggggcatccatgggctcaaaaccaaatatcctcccccaaatctttcttatctctctgccttatcgtaacaaggaaacaaaaagagttgggaagactgacttatctgcatggatacttcctaaacaactgtgtattgtctcctgctcctaagttattccagcaaatggattttggttgttttcaaatgtaactttctgctgtgtgtcactgttatttgtattaggttggtgcaaaagtaattgcggtttttgccattgacagtagtggcaaaacccacaattagttttgcatcaacctaatgtatacgtatcctatatcccctactcagttgaagctcctaaaggacatggatcaagtcttagtcatcttgtatcctcctcctttgaccttcaaaccagactcgttatcccatacccaatggagccttatacatcccactagacagtccccagagttccaaacagtgcctagcatgcaataggcactcaatgcatacttctgtgcttgctgtatcttggtcctctttgcagcgaaacactaaacctttcactttgtttttgcccttactcattcacccattcattcattcttttatacaactatctcctcccttggggttcagagagagtagaaatttctctttctcagttttctctagtctcattc

SEQ ID NO: 6377 - DNA, 6319 bp, artificial
  synthetic oligonucleotide
ccttcctcacccaagtctgattgatgctaactaatgtcgagttagttcctttaaagaagttatcttgctaccaagtgtgagccagtccataccggaggtggaggacggggggcgggggcccgggggcggggggcggggagagggggacgaggacggaaggtgaggaaatggagctgggagtggcacctcacaccaaacaaaaacgacgatcgttacattgtatttaatttctaattaatcctcaagagaaatatagccgttttccttaccaatggatccctgttcttactgtgggtatctcgcgcgcgcgaacggtccccaccttcccggagcctcgcagctctaaggagagcaaggagtccccagataactatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggccttagagggtatggagctcgcggcatcccgcttagtttgaagttgcagccttcgcaccccaagacttcccccttccccagggatcagctgcaaccccaatccaggcggcccgctccccctgccgcagcgccccctacggtctggaggtgggccctgaaaggttccgacgggcgcggggagcccaggggtgggggccggggaggccgagggaagctggtgtgctccggtccccgtctgagaagcggtcacccgctggggcttggcttctgaaagtgcgatttaggtagctgggagtggagatttacgatcctggaggacagagcgtgaaagggttatcatcatcagttttgactgaaagaaagaaaacatatctttaacaaaaagaagggctcttgccattcacccgcgttgttaggacaacgtgaactatccttgaaatgattagttccacttcaaaggaatttacattcaacagtgaaaactcagcctctttttatttattcgaaaagacttttcactacggagaaaagtctttcctgctatttatttttccgcgttcacggtgcacttgtattaaatcaacagagaccgcgcaacgcactcagtatgcggaccagtccagggttccggggacgcaggggtacaggtagagcgggggagggggttgttggggttggggtttgcaccacgcaggcacctgcctggcccaggggatggggtgggaagcagtggatcaggtctggggccgtggggggaatgcaaccgaagaaacctcacccaagcccagcccaagtgcagtaatcagagattttgaatgctcgcgattctcatagagcctggcactctctacgtcatttgtggagaaagtggacctgaagttccccagcgacaccttaggaacatctgttaaaaactgatcaggttggcgtaacttcgctgggcaaaattaaagcctatctccacaaattgagaagacaaatcccacctcttagtagcttgggacgtttgctcacacacactctctcagggcccacacctccgcgccccaccccccaccctcaggtcgccaattgtcgccaaatccaggaaacctctacccaaaggaacaacagcactaagtttacgagcggcgcgtcctcccggggcgggggagggggcgggggagggggtggggagttggggaatgctacccctctaactgtccccggagtgccttgagctgtggctggaatacttcccacctcctccggaaacgagcagcagcaaccaactctcagcttcacctcacacacccacccgcccaaccccattcccacctcccgcagcaaaatcttttcttcaacccagggctaagtttttctcaccaaggacaatgatgttaagctttcccttgatggtcttttccagcttctaattaaataggaaaaaaaaatctgggttggacattggattcaagtttttctaccattccttaacatatctggatttgtacctggcaactggccccatatcttgaaatattgtcaacatgaatcgtaacagttgtcctttctaacacagtttttggacggctcctcagtaggttcagaagcagtgaccacaggctgcttggctgggagttaaaggtggccgctgtttgccacctggtaacaaaggtgtaagttggagcagtgactggggcaagcccttattctcctgtgtttcaggttgaataagaactcaggttttgttcaccattctggagctactctcatgttccttcttcctcctggatcttcctgggcttatttcaccttcttggtctgaaggtttcctttgtttcttctcttgctcaaacctaatcctgaggcatcccctgctccctctctatctctatcccctgctccctccctatcatctcctgttccctctctatctcc

SEQ ID NO: 6378 - DNA, 2401 bp, artificial
  synthetic oligonucleotide
cctaggtgagactggaagccagctccagattccgatttgaatgatgtgtgacgctgtctcttccctcaggtagacagcatacaccttccgagctccctggcctcggccataattgccagccgctcctctgggttgggcctaagagcagccggctcccggaccgcggtggcgcaggcgggctctgcggcgagccggggagagcgcggctgccggagaaatatgctaatggcggcctctccggcacagtcctggatttggtctaggctttctggcttggccctggaactctcagcaaggacgggtcgagtacccaagccgtggagaaagcccaggaagggcacgtgctaggatctcacacctgacccgcggcagaggctgctcgggggtcagacctggcgctggcgtttctttctgctcttccgcctgtgttcgggtagccacaggcttcccagaggcctggagctggtcgcccatatgcgcgtgagtgctcatctcccagtcacaactgttggcaaaccgactactacagccgtcgagttcacacttgaactggtttacgcctggaaatagaaacttcaacgctctcaccccatcctacggagccgctaagcaatatataagaagggtaataacgtattcgctggagacaacaaataattccccacgttaaaataactgattgttttcagaaatttattttttacataaatatataaaacgaattcacgccgatccccattgcacccagcatttgagaaattaccgagtgatctgtagctcagagacagacaccggcgtggtccgagtgttacagcaaagtctcagcacctgtaaacttgcaacactgagacaaatgaaacccctcgcgccggcatccgctggcgcacaagctcctgcggcccccgtcgcttgctctggaactcctagctctgggaccacttccctacccgcagatttcgccaaaggctattgcaaaaacccaccctttgtctcataaaactacaaagagccacacagccagaggcaggcttttcggcaggctcctcagccttccccggagataccggcgagtctcgggtgcaccaggcaggagcaagttttctccttactgggattggggtgcgcctctcttccacccggtggtcctgtgcgcaggggtgtgctgaggagactgtaaaaaagctactaaccggcagggcctgctctccacggaacaaggccacagggagaagaagaggggagcccctgggaacagaagaacacctggcagggctggggtggggattgcagctagtccatgacccaactacggtgtgaacctggacccggaagctgggctgtaagcggagctaaggtttcttctcctccctatagggctagcctaaagatgtagtcattacggaagccaccttttgggaatgaatcgggatgggcagcaatttccgaggggtgtggggtggggaagagagagcgagagcgagcctgagggtaggcgggggctagcaaaaattcggagagctgagcactcccctcgccttcggctcccataaggacccacccctgtcaacaaatggtaagtcctttggggaatgctagagaaagaaactggcaggtcagagataaaggtgcgcctgggcgctggggatggagtgggagggcagggaagggttagtggtccttgtcccgtggaaatcgtacatgtgctcggaaggcttgtgtaattggaggccaaggggtgcttgtattagtgtgcatgagaaagagacagagagacacatgagaccaagaagctgaatggacgtgtaagtcgcactggacgacaatttcaaaatgcagagtttggcttattatgcaaacgaataaatctcacacagctttcacttgttcatcccctgcagaccgtagcggtttgcactctcctggttcaagttcgaagtggaacgggaaacaaaagcaggcaacgattccagcgcggcctgaaagacggaccacaaagcctcctccctcgtctctcctccgggagccgggaagccaatgtgacgatcaaaagcttccacatcgccccggcggggcgcgccctcagccctgtcggggaggtggggaatctgcagaaatctaggtctggaggctcctgccaatttttccttgaatcagaggaaggcgcgggttatagggccctttctcccgtgggttcaccgccgggagaaccaagtttgtatttggccattcagtgccacccgcgcctgccctaaggctccgaggtccattaggccagtaatcgtcccaactggggaaatgaatggttggcctggcctgggggcaccggttccttcctgcctgtgggcgtctctagctgagcctctggttcagggctctgagctctgccaaggcccatgtcatt

SEQ ID NO: 6379 - DNA, 211 bp, artificial
  synthetic oligonucleotide
tcactctctagcctccccttccttggctctcacaaaatctaagataacatgtatgatttctgccatgtgtccaccttgccaaccacctggttgggagaagtcctttgcaatcttttctgcttccattttgatgctccttgctgaatagcatgattagatacatccatctacagcttacattgaacttacatggcctctttcattatgatga

SEQ ID NO: 6380 - DNA, 943 bp, artificial
  synthetic oligonucleotide
ttcatccagtgagtcttgtcatattttgtttaaacaagtcaccattcttctaatctgtgttctcttagaatcttttctcttcattgggcatgtaagcatccagattagaaatgtctagagcatagggactgtgaaaaaatatgtagatgaagcctaaaaagagattcaaaggtgatagacgatagaggaaatttaaggtcaggccaagaaattcagatttgggcctatagaaaatgaacattatttgtagacttttcaagagagaggtgatgttatcagacttgttttttgggggacaataagtcaggtaagattgtgtaggatagatgatagtgagaaactggtggcaggaggaaagtaattttaggaggatattttaagattgcaggcaagaggagaaatgggactgtggctgtggatgtgaggatgaaaattgaaggggcataggcatgcaagccattggagatgtttaaatccacagggcttgatgactgattggctctgcatggtgaaaaaagataaaggagtcaaaatgacttcaaactttcttctgagctaggaacaattgcaggaagagcaagtttggcacaggcagatataatgactttggtttgggccatattaagtttgaagtgttggtaaaataaccataaggatgtgtgtattcaagagaaggattaagtgtagagatctagatatggcactgattatttcatagctgatagttcctttattccgcaaaatttattgaacacttactatgttccaagtattaatccagatgcttaatgtacgtgagtgtacagacaaaattctctgctttcatggggctgacattcttgcagggatgaagtagggagggggtagacaccaataaacataataaataagtaaaatataagttagaacataataagcgttatgaagaaaactggtatcaagg

SEQ ID NO: 6381 - DNA, 1810 bp, artificial
  synthetic oligonucleotide
tgctactgttactgccttacttctagacttcatattctcttgcccatgtaattagaataatttactcatgggtatttccctccaatttattcttcacacttcaagccaatgtaaccactcttacaaatttaaccatgtctcgcctttgcttaatacttttgatagattctcgtagggcaaaaaccaaacaccttagtctggctttcagtaatgtcagtttcctatttctccagctttatatcttgccattttccccccatacatttgtgctctatttgtaccaaaattttaaagttccctagtcacctgtacctgctccatgctaccatggctttctgattaaaatacttttcctctttcattctgggatacatgtatcccagaacttaaagtacattaaaaaatacaaaaaaaaaaaaaaaaaaaaaaaaaaacctttccctcaccccttgtcctttcgggaaaaatatttacttgtttgaaagattcaagattggttaaatactgcagtctcaacatccagaacagtgcctggtatggagtaggtacttactgactgctgttgagtgaataattgtatgaataaataaaggtgataacccagtttaggtaccatatagagacaaaaggagaaagaattttaggggataatgaacgtggagattaagaagtgtatgataccagaataaataattcctctggtctcataaagttcaaagagggaacaaagtagaagatataatcctgaaatcagacaaatgatctgtttttagcagtcataacatgctggtgggttgaaaggaagcaacttttatattttaatgccatacttcctcatcctgctaaacacataggtcattcccttcttctgtgacaagtgctccttagatggctgaaggaaaaggactcagtgtgaattagattaatcagcttgcttttctaacatttaataagcaaactgcactgaggaaataggatttttaatacagtaggagagtaggaccagggctgtgtgttgaatcttggcatgggaacgagagatggacaaatctcagtggtctttgacgtgagcaagaaggcatatgaaagcacaaaatggattgggtgaagggagacaaggctaacagggagatgtgactgcatctccctcttagccttagtttatttactatagtttatagtttatatagtttatagtaaataaactataaacagacttatgaacctgggtctaagataatatgagcacacagagttcacaggggaaatgaaagggctgttagaattccagcaaaagagagcagacaaaaggaaggaagataaaaggtcagaaaagaggccttcacatggccattttgatggttagcacagaaatagttgaatgttgaaacttgttgcctcatgtatttttctattgctgaaagtttctaacaaattaccacaaacttagttgtccttaaaatatcagaaatgtattattcttacagtttggagtgttagaaatccaaaatacatcttgctgagctaaaatgaaggtattggcagggctgcattccttttggagctctaggggagaatccattttcttgcctgtttcagcttctagacactgtccacatttcttagctagtgaccctcttcctccattttgaaagcctacaacactgagtcaaatctttctcatgctgccatctcactaattctctttcttctactgccctcctccacttgtaagaacccatgtgattacattgaacccagatagtctgagataatcttgccacctaattagcaactttaattccatctg

SEQ ID NO: 6382 - DNA, 892 bp, artificial
  synthetic oligonucleotide
actcttaaatccctgtcttagctgtatagtgaatagtagtcttgactgactctggtggtggataaataggcctcaatttccttggaaaggcatattctttaaatgaattcctagcttaaaatttgtcctcagtcctatattgaaacatccatttagtaaacaggatgttatcaaggaaggaaacaaaacataatattcctttccttattattgaaaggataatagtgatgcccaatatgtcatgaatagaggaggaaattggattctattcttaattcattgttaatgactaagcttcacaaaaatacttagtttccattatactttcttctgtgttaattgtggaaacaatggggtaagtcttcctgtagaaaccaattatcttacatgacacctcttaattctgtaattcattgatcctcaggaagttgagaatttgaaaccaggtttggcagtaagcagttaattaaaattgtcttagtttaatggcaatgttaataacgttgaaatcatcaagaatagaatatggaaacatcacaactagatatagatgtttatctgactttaaagactaagttcactggtaactctgttttattgagcacctactatgtgtcatgcactgctctgactgtctctatacatacaagcttggaagtgagaggaagaataaaaattatctgcttgaattcagttaaacaaactatgtgaaagaagagcaaggaagatgaattctgtcaaaaagcaaggtgatttgcgaatcgccagttgcatccaatcagtcagctgttacttgactattttcaaaacaactgaatgcaaccaactgatttaaaaatcactaacactctgactaaaggtcaactgattggtataaatatagcctattttc

SEQ ID NO: 6383 - DNA, 1221 bp, artificial
  synthetic oligonucleotide
atcatttccttccaacatgaggcttttctaatgtatccattcctccaaaagagggttaatgctggaatgtaatataaataagattggctaagaaggacaagccaacattacggatatctcacaagctagacagaagtctaggcttactatgtaggcaatagcaggttattgcaaactttaagttttataatataattctttttataatacaataaaaattgcccttatggctactatgggggtgtgttttctggatctcccttcaagaaagaacctgtcactcagctataaacaatgtatttatctgacagcctccaccaatttgcttaaaccaatttgctcaaagacagcaaatgtctttctcatagtcacacaaaaagctagttgccaagcaatggttgaaaccaaagtcctcctgatttcacagagctccccctttctatttgtgtggtaaccatactggatgtctcattgattctagagtattcctgttatcaagaagcttaatccaacaaagtgcctccatctataattctttgcccttctcaatgaggtaacatgcagctcaacagaaaattttctttctatctgcagagatgatccttgatacgtgatgaagtgaaaatcaactagaggttacataatttagattatccaactccgaagcaagagaagacctcaagcaacattatttgattatggaattttgctgttgtagagaagtaatcaaattaatcttagaggttcatttatgggtgtgacatgctcatttcatcatactgaaactcctcaacaattttcagtacaaaatgtactggtgacttcttttcctagtattttctgattttattaaaaccttaaactctaaatgttagaaaatagttatttaccttgaattttccaaaatgtttcagagtcaggctttctggctttaatgttgatttctaatgatataggtgagctcctaaaaggacagcaaacttattgtttctatagaaaaaaaaatataccaggtgcaatagaatcgggtgcagttggatctgctttttccaaagtgccaggtttaatcataattgtatcttttggcaactcagtggctggcatttttcccttagtcattatgtaactcatgttcctacaaggtatcagggaatacaaggctttgtgaagtgccatgctattgaccaattctggctgcagcaaatcgtatgacaaatgaaa

SEQ ID NO: 6384 - DNA, 2081 bp, artificial
  synthetic oligonucleotide
ctgcctcccacgcagctggtatgtgcattcagacggcaagtgactcagggacagtgtcaacagggtgatgaaaactgtgacaagagaaaagggtagtctgaaggcagaaataactactgtgaatccaagtgttcattgatcattgttcttatcaggctgagaagttgcactttgggtgataggaggttttgctgaaaatgaatttgttagaatatttcaaggttcgtactcatttagatacttagacaaagaaatcccagcaggaagcaatcctgataatttacacacagcaccaggggttgtgaactaggtttcagatttccttgagagctgatatgtgctcagtgatgtattaagaaaatagaggatatgggagtagctgctcctgccacagaggaccctcatggcccacaccatgccagtgaaaagtagttttattctgatcctcctggcctttgcagcttctccaagacatgcttcatcctcacattttacttgcatttttgactgtctctgtgtcatagctgaagttttttctctcctcttccttgccttccctgctttcttttgtgaactcccttccttcagggttgttgattttcccctttctaccgcaccatctattttcccatgcctgatgtggcctccaatttgatctgccagattaccccaattatctcatccaactgaaagagttttcagctaggaagatcatttgagaaaataaaacttcccaagagtttgagctgcagaaaatgaaaatgggcttcctagacaggttgcaaggtctagttcacagaatataaaaacagaatctgtggcccattgatgaagatgttggagaaggggttttagtatctgatgaagctccttaagaattctgagattctacaatgttagcaacatcagccctctcattttacagatgagaaaattaaggctaaaggtttaaggagatgcaatacctgaataggtttcctgagttttagtccaggactttttccactatcacacactggcttctcaaacccactaccaatctcaatccctctggaaagctctccttggttaaatgaatttcaggcttaattacattctatttcaaatataccttgtcttgcaaaaaattccaccaccactgagtcccactcacacacccacaaagaggggcattacaacttttatgaaaaaatatctttgtgccaagctactagatgcacaattgctaatgaaaataatcagagttagaaaaagtcatctagggagtttggctgagacccttcccctttcagatactgtccataacccccttcttgatcacttgtggttgcttagacaactaggcttgactgaaactctaggttgacattgccaagttcaatattatgcaagatgaagaaaaacaaaaggtcagagtcttgcctttggagagcttagattcctgtagagaagatcacacataggtgaaaaaaaggatttaagagcaagtacaagtaagatggtagcaaataacacaattgtacgctttaaactgaaactgtaggtaagtgcttagagcacattaaagaaaaaaattagggctatttctccatcaaatgtttttcttaatagctgctctgttgagaaaaattgttccatcatcatcaacaaacattgatgagcaccttctctgctggctggggagaagaggaggcacctacatcaggatagagatctaggccatgcatcaggcagcaagtactcaggtccaagaatgttcaggtacacaggtatgcaggggaggtgctgaaatcagaaatcccgagggcccgaagagaaagagagggattttcttcaggatgctggtctcaaagtgttccttgaagaatagctaggaaacagagagggcaaaattatgctaggttgaggaaacaatatggaaaggacgtttcgtttactatgaggttttaggagccaacattgaagaaagagaagcccaattgtggaagaccatgaataatacattaaataaggatttgtactttatcctatagccacttgggtaccattgaggattttaaaaagaaaaggagagggataaa

SEQ ID NO: 6385 - DNA, 1014 bp, artificial
  synthetic oligonucleotide
gaaatgcacatatcattttactccataaactggactaaatggcttttccttctcagaattccttggaggatctttgttaacatcagtttgtgtcgctatttctagtcatatggcatgtgaattattttcctaaaatgtgtttaaactgatatggtcctcacaatcaactgaaggtatttatcaagatcattaaaataaatccatatgttatccattcatctgcatagatatttcaaatggatatgttttagtcaacattttaagccatttccctaacattccaccttgctatgcaactgtaaacctgagtgctctacaaatagccatacgcacacaaaagggattttcaaatgccagtgctgatgtttgtaataagttttccccagtttgtgtgcaaaattgtatttgttttatgtgctgggtagctagtggaatttccttccaaatgtctgtagtaaaagagccacctcttgagttaagctgtgaattttttaaagagggaactctcattaaccttgattatggacccacaagatccagcctaatgctgtggactctgagtacatttttggtgaattacagacggattatctgtgaaaagcacaggctgtgaagagactgttaattagggattaaattgtataactgattacatcatatttaataagttttatgaaatccagtttgattgaaaagatataccagtgccacttaaaaatgaacaacactatataaaccataataggaggtaaacatgaatgcaaacagtccagaagaaatgcagcatcagattgtgaacaattgaaaacttggacttcccatgcttggcatgtgccttacttctgtctcctttctcatcatatggagaagaattaagttaaagaagggaaactgcatggaaggtgatgtccttattcttgttcactttgtggttattattcttgcccacttctggtttaccttgctccttgtaagcacctgcatagcattttatgttttagaaattaaaattgg

SEQ ID NO: 6386 - DNA, 578 bp, artificial
  synthetic oligonucleotide
acacacacacacagacacagacacacacacacgcacacagaaacaatagggtagtgtttgttctgtgtatatctggcactaaatatgttggtaaatatattggtggtgtattttgaaacgttcttaagacccatgaaagtcaaatattgttcaagctgttttattcagctgttttacattaagaagaaaactatagtatagccagacttggagaactaattcattctggttttgaaattttcgaggaagaaaataacacttggatggtaatcatccagtttgtcccagggtattagtgacagagaggtttccatatgtgaagaacataaaactgaatagttacttgcaattggagttccactttattaatcgcagtaaggaaagaaaaattctctgttactaaaccccagaatatctttttctacaaaattgacacagtttcaatccatttatctttgtgtgaatgctttatccaggcctcagtaatgtgctgtgaagcgctgacagtatttaaggtcataaatatctactgtgccaacaagctgagtgattgactcaaaaggagctgagattttact

SEQ ID NO: 6387 - DNA, 1245 bp, artificial
  synthetic oligonucleotide
gtgactccttcaaaggagattgtattatgagatgttctgagtgataggtaagaacaactctatgtaatgagagaagaaacggtaaatttaaggtatgtgaaaataatccagtagagaagaaaaatatgtccccttagttcagattgcaatctgactgagccgttgggatcagtaacacaagctgtctcattcccatggcatcaagctgactctcagaaagaggactgctttctggtcttgcatctagtttgctatggtagtcccaggactacaaaacgtgacagtaaaatcactcctacaagttttccctggaaatccatgaatgaaaaaggcttgtcaaaggatttctacttgtctatacgttttgtctgccccaacttcaacccaagcaatactgtgtattgtgaaaaaggaaaactagaattttttgaaaggtaagtaattatatgggtagaactgctgctaatgagttctagaacattccaaaataaaaaaaataatagtaatgcttttggtttaactttgagtttttgctatcctgtttctaatatctgttatttcttattaaagtagacatagaacgggaattttttttatatttaagacacttgactttctatagtcaatgattatttatttcaagcagttttaaaacatttattacaaatagctttatgttattaaatattcatactgtgaagttttgaggaactctcaaaagcttgtgtacaactccttattattgctaaagaaaaccaaaggtaagaacaaaattatctctgcacaacaaataacaactttcttgcagtcccagaaagactcagcatatatcatggacaaaagtaaatatgttatgaaataatggctaattatgattctctgtgccacagatgtgcctacatcaagtctgtcccccatggcaacaagaaaaaaaaagggcggggaagggagggtgcagtgcaagaattctgagattaatcatggaaagtaaattgctatctctgtaacaataacaatgtggaggtgtcgtttctttatttaatggacaaaagggagaaaataaatggcaaaaactataaagttgaattcaacccccccaaaattgagggatatagaagtagaaatgcaaaagaaggtagaataaagaaaaagagataaaataagaacgctcttccagggatcagcattttccatcatctcaagaaatattccttcaaaaatgtaaaggcaatttgcttgcaagaa

SEQ ID NO: 6388 - DNA, 1974 bp, artificial
  synthetic oligonucleotide
ggttaagaatggcaaataaactgcatgctcgcctgaaggtctgccttgacgcaacctgacacctagagctgaatttccagtcgctggaatatcgcgctactcctaccactgaaaatgttcaaaagcaccacagtctgggtatgagcttaaatcccctcttcaacaccgcattttagtagcatgtaaccgattacactaagtctaaccaaatctctcagctctttgcaacaaggttctagaaatcccccctccccccgccccagcaaacatttcgaagctgcaccacaagtcaagtctgtcccaaaaagcttaaaagtcatcaaagaaacgcaatgcctagacagcagaagcccacatcccttggaggtggaagctggaggggaagggtctgaggcagagataaaagcaagagagggattccccaggctctcctggggacgggaggatggtgtctgcccagctctgcgcctgcaatttccacgccatacatatcacagccatgtctgggtcacgcctgcccagagcccaccgggcatgcacatatgtgacatgtccgaagctgagggcaagccacccagggcagagtatgcccccaggctctgcgcctgtcccagggcagttgcaatgcagcaagcgtgttactgttacggaggcaagaaagccagcgccttcccacgcacgcacacaggctaggtggcctcttctgcacaagatgggccaccaacaaactcacctatgctacatacctgctccccaccgcccccacctcactcgtaaagtatggggaaaagaaagcaaaagccctttccgacctggtcttcttctgcgcctcttcttggagccgaagagtttgacccgggaaaagacatttaacttgtttttgtcgcagctggtcttgcctttgctggggctgctgacacacttgcaggcgttggatttctcgcgctcgcgggcttgcctcttctgacggatgagcgagctggcgatagccgccgccatggccacgacgcccaccaccaccgcttcttttgctgcccctctctgggttcgcctcctcctccttctcctccgctgcttgtccgctgtctcgcgacttcgccgctttggtctccttagcctgcgtttgcccgggcttctccgcactcgggcttcagccaaggagggggctcagcatgccgtccgagctcctccggcggcggtccggctcccgcgcgggctgctggctgcctgggtcggagtcgacgccacagccccgggcccgggatcgcgggcgagactggcacgcggatgctgaactgcgcgactgcgtgtggtcggcccctgcgcccggcggacaccgtgcatgtccagctgctccggtccgaatttcgccggaccccctcgccctgttgcccttctgatgggggccagaggagggaggcgggcggagggagtgagcgcgggcgggagagaggccgggagctcgggcggccggacggaggagggacgaggcagcgcgcgggggagcgcgccctcgccctggcccctccgagtcttcgactagtccttgcaacttcttggcgtgataatcgggaaaagttggcccgtgccaggtttccgacagggatcaaacaggtaatggcctcgcatcttcgctgttgctgctgctctgggcgcggcacagtcgcagcacaggaattcagccgccgcaggcaccctccggaacagcgcgacagcctccttgcagccccctcccgcgacggcccctccctcccggggctgagcccgtaggctcggagccgcaggccgcccctcccacccccacccccacccccacccccccaagtccccggccgcccgttccggctaacacctgtaggggcttccgcactgccccagtcgtccaaatccttctcccctccttttcccgaaaggagcttcgggaggaaacagtgatggaggaggaactgagatgaggtagttgggctgacggag

SEQ ID NO: 6389 - DNA, 1565 bp, artificial
  synthetic oligonucleotide
aacaaggtgattttgctccttatgggatatttggcaatatttggacatattttgagttgtcacaactaggatggggtgctactggcatctagtgggtagagtcaagggatgctgctcaatatccttcaatatataggacagcccttgacaacagaattatctagccccaaatgtcaacagcaccaaagttgagaaatcctgctctagctcaacacagagcctggcactactgactgaaggaaaaataaatatctcaactaatttttacagctgaaaagaatcactaacagatttgctcactgggttttaggtctcacttgtgcttctcatgataatttggtgtaatttttaagccaatgttattcattatcaagtatgagaatgtgttgcttgatttgttaaaaccttctatgtagaaaaaaaataggtaacattccataaatgtaataaatactaaagctctggagcactgtaggggcacaggttggcttctgattttcccagtgtccactccctgctcctccaaccagcagtgattttactaaacaagagagaagataaagttcagttcgcatgttaaatgtaaccttcttccatctacctacagagatatttctccttcttcttcaaagtcctttctctaggttaccacataggtgagaaaaggatgacaggatatcaaaggggttcacaagctccctggttagctcacatgttccactattgagattccaacctataatcaaagcacaagatcctgtctcagcacagatttaatttaaacaaattcagggagaaaagtagtattggatatgctaaggaaaaaatggaatgctgctagaggtaggtccatgaatgcagtattttctttctacattttttttatttcaatagatgttttgggaatgcagtattttctgtcatgacattctcctgtcttaggaaaaagggcagtcagcaaaaagtgtctaaaagctctagtctctcatgttagtttagaaatgggtagtatcctaatacagtctgaattaagggacaatccaagtgcaagggaaaaaaaccttcaaatacataggacagaccttcaaaaagaatttttttcccaaacactctaccttacactatgaaaaatgaattcatttaatttcttatttttttaatcccaaaaacacatagcctatttcctcccttgaggctactaaggaagtagcatttgaccttggtgagtgggacactctgtacagaaaactttcatcatattttgcataggaagttatcatttccttaggatcaacattcacaaatcctagataaaaacttagcctaattacatagactctatatcatattgttaacagttcttcaccacaaaactgtgtatttgttctttttaaacactacttctttcattcagcaagaaacgttcactgctagacaaggaatcaatttctagcaaaagtgcacgtttgtaaagttggcagaaaacttgctttattggaaacacatgtaatgtcatcttgattgtatcatattaatgtggcttcaaagtttgtcagttttaaaat

SEQ ID NO: 6390 - DNA, 1454 bp, artificial
  synthetic oligonucleotide
ctatttgcaatactgtgccactttattacagagtagaatgtggtattaggcaatttcattcttagggttagggacaatgattcatgatctctgggtcctcagcacctagcacggtgccaggcacagcataaatatccagtagctacacacatacatatatacttttatgaggtggcaccatagcataaaattggaaccagcccctgaacacagacttgaaacaagtgcttcatatacttagcttttaagaatcttttaagtgtagtgattctcagtggggattgacctgcagataatgtgtaaacttaaaatgcagaagcctgattgccacataagagtgaatcataggaagcactcaaatactaagtatattttttagtgattactagtcactttgcattttctcattcactcctcccataacctaatgaaagcagggctatcgtgttacccatttgaaaaatgaaaaaaaagtgatgaggctaggagaaaataaatgattgcccaagggcacacgactagcaagtgatggaatcaggagtcagaccaaagtccatttgtcctccacttttctactgtcttacacctacttgagctattcaagcaacatctccagagccagagcttaagcttgtggtggatttttgtttgtttgtttgtttagtttccacagtgattctgattcatatgcctacttgagtcagaaattcggaatgatttaaatgagagagagagaaagtgatggggagggaagaaggaagcaaactgctcaggccattagcacagttctccaaatctgagtaaagctatgtgaaataacccatccatgtgaatcaagcagaagatactgggccctcacttcgctgcaaatcaagcatgctaacacttctgttgccagcggcttgccctaaacaatctgtcacctcatagcagagatggtccagccatttatggtaccattgcacagtgctcactaagcctgatagatgggagtacaaggacaatgacatgatctacatgctgtactaacttaatacaaaagggtagatgctattttcagttaacattgctgattttcccccactgaatttgttaagactttgaaaaatattctaaacttcagtgctattgcacaatcaagaagcaactactgtcccagttccataacaaatgcagatcaaatacatttgaattggaaaagtaaatttaatttgcaggtttctgtctacatcctctgcttctattttctttgataagattagtgaacaaagttcagaggactttttcagttcaaacgttctctcataatggcaaatcaatctgctcaggcaaacagaacatcaaaacgctaacaataaggaactatcattggaagctgatccgatttacacataaatatacccgctaacgtttaaatgaaactttacagaggaacaaaattggtgaaagaatct

SEQ ID NO: 6391 - DNA, 3037 bp, artificial
  synthetic oligonucleotide
agtttacattctggagctaatcccggtcctgagaaaggcaacggctagaaccggcaaagggtgggggggcgtcccctgcctttgccttagttctccccagcctgagcaccgctttgctgcgcctccccaacccgccgatgggaggccctgggcagaggcgcgcactccagggggaccagtggtcgggtgccccgggcgcggtggctgaaccccagcaaacagaggaagaggactgccccctcccgcggaggcccactcacgctgggcactagtgacaaggggacatcagcctttgttctcctggggcttggcgaggctgcgctgccaaagcgcagcgcgggcggcgccagggcaccagggttgctcacctttgcacgcggcgtgtcgaagggtgcaaactcctgccttcccggagggttggggtggataaggagtttaggattaggaggtgtcgggtggcggggggggggaaggaggtggtgggaaaggaggggggaggggttctgcgtctcgaccaggctctttgtttgcattgggggcggggagagggggctgaaggtgggttcaagcttgggttctgacagcagggcagattcctgagtatgtcaccatgttgcacgcgcgcagcacacatatgcacactcgcgcacacgcacacacatgcactcatacagacaggcggccggctgtcagcagacagcgcggttcccggcgctccaggctgcagcagcttcgtctgcccgcagcgccaccaccgtgcgtccagaggggaagtggaggaggctggaggcactcgagggtcgacaattccgcgaggaaggagggaaagtggtgcaaacctagatccaccccctagcgacctctgcccccccttttctcccggggtcgcagaggtcatgggcagcttaggctccgggaaggaggcaaggagccgccggagggcggcgcgcacgcgagggggcgagggaaacgaaggaaaggaaagcaggcggactcggcgggcgggcttacccttagaagcatctttctcctctttgggcttggtcacctttccactcatagatcccagcttgcttgacaaggttcgctcagaagacggaagtcctcgccgagcgggtcggacttgggagagtgcttagggcggcaagtctcgaccacgagctcccctcggtgtggttcggggcggaatccgcttttccccaccgctgccgccgccgccgctgcctacgagagagtggggaggaaaggaaaggggtgaaggaggagccgccgtcgccgccgccgccgccgcgatcccgagcggccggccgcgggaggagccgctcgccgcgctcaagaagtgaagagacaaagcggcgcggcgcttcctccgcgccccgcgccctcagcttctgcccgcctgcggagagccacgctcgcaacccccggggcggccgagaggagcggccgggactccccggcttcactgccggcctccctgggctccgcgcgggccgctcgctgggagttgcctgggtgggctgcccgcgcactggcaggctgctttcccccgcctctcccaatccgctgcgggccgccaactcgatcaaaataaaaccccgaggaaggctttttaaaaaatcaaaacaaagataaaaatattcacttaaaaataacaagcctccctgaaagggaaatgtttgaacatgtgatgagcaacgtgtgagcctgttacaccgcagagtcgcgcagcttctcgcccgcggggaatggggaggagagggtcgcctcttttctttctttctatttaatccatttccaggttcctattattttgccaaaaagggggccggagttgctcgccggcggaggagtgggagacgatggcccttacctgctctctttctctctctccctacacccacaccccctcggagctcgcccgctccctcgctcgcgctctccttccaaagaactctccggtcctagagagccacgaatcaacaccgcggcgcattctatataaacggcaaggtgtgggcacgcggagggtgggggctggcgaaggcggggcctcacaaagccgcctgcccgctgtagtaaaaggagagctcggcaggggcgcgccgacgtcagccgccggttggcaaaaccccggcgagccccgcgtagtgcgggcgagcgtgtctgctgggcgtaccctggcccctccggggcagggagggcccgcgggtgccactgtagcgggctcccaccgttggccaaggagatggaaggccggcgctccccccaccccggcccctgtaactcctctactcctagcgcctgctttcccaggcccgtgctggtcgccacctacactttggggactcccctgttggcaactgctcgcaccgagcagtggaatctcagtccgggagtcgacgacttttcgcttctggctagctgctcaagttgagacagtccggctctcagtggggagagaagggctctctgggatctgggtgtcagtaggtcagagagtgaaactgaccgcggcggctgccacctcccacccccacccccacacgcaggcccctcctcctagggctggtcgctcttgttggtaaactggaagcaaagagtgcccaccgcccaggatggccaatcccaggcaaacgggtgaggtgggactgggggcgagtgctgaagaggaataagtaggattgaaacgttgcctgaggaatacttgtgacaaaacccagagaaggtccctgaagattagaactagaaggaaaactgctcaagaattgttctacagagggcagatgaggaaggaaagagagagagagagagagagagaaagagagagagagaaagagagaaagaaagaaagaaaggaagagagagagagaaagaaagaaagaaagaaagaaagaaagaaagaaagaaagaaagaaagaaaagagagaaggagggagggagggaaagaagagagaaagaaagaaagaaaaagaaagaaagaaagaaagaaagaaagagaaataaagaaaaagaaagagaaagaaggaaaagaaaa

SEQ ID NO: 6392 - DNA, 957 bp, artificial
  synthetic oligonucleotide
ccaagcaaagatctcctctgaacagccttgaatacccttgatgagatataccctctaaatttgacagacaaaatttttttaaatttattttgatgagaaaaaaagatcatttgaatcctgagatttcacttcagtagtaaagtggtaccaaaccaacgtgagtttttgttttatgtaggctatatgattgaatgatcttttaaaaaactttgaggattggacagttgcggtgactcacacctgtaatcccagcactttgggaggccaaggcaggcataccacttgaagtcaggagttcgagaccagcctggccaacatggtgaaaccccatctctaccaaaaatataaaaaattagctgggtgtggtggcacacgcctataatcccagctactcgggaggctgaggcaggagaatcacttgaacccatgaggtggaggttgcagtgagccgagatcgtgccactgcactccagcctgggtgacagaatgagactctgaaaaacaacaacaaaaacacacctttgaggatcaagattcagaagtcaaaaaggtcatgacagacatcttagcaagaatactaaattttgtgaaacatccccggaaaacaatatgagagaaagtggctaagcataatgcctctttactgtattctaaaccttgcaccatttacattgtatttaaattgtcctgggagaaagctgtataaaagtttccacactaaataaaaatgcagataattagtttatatttgtgtttgaagaaagttatttgaagcaacttatacatcaagagtatagcttcaaataagtaatactaagtactgtaaagcacaatgcacattaacaaaagtacttttatcgttacatccttgatctaggatcagttgtatgacaacactcccttaccaagtttttggttctgacaaatgtaaaaccagagggatttcttgtcaaggta

SEQ ID NO: 6393 - DNA, 787 bp, artificial
  synthetic oligonucleotide
gaagtatttgagtgaggaattttctgtcaaagcaagaggaaatgttatgcataaggatttgcagtttcaaccatgcagagacataaatatcacatattaatagacgtgacctagttgcaatcatagtcggcctcattctcatcttgtctccctcacatgtttattctctatttggatagcttactctgaaagctcatgggatatctgtggatatgcaaaaagaatgagaagttgacagtgtgataataaacaacacagaaaatgaagtgagcttaaagaaatattttattattactaacttgacttaaaattattgggatttgctggttgttggtccttattacttttgctatctctaatttaaaatcatatattagataaactccttacatagttagattttcaattatacttaccaatggcaaatataatacagccttcactgaactacctgttgagtttcctatcactctgcgctctgctaaggaagagctgtaataaaactgcttagccaatctctttgaaatttagagctacacaggaacttaaaaagtacctagctcagaaattcttcattttctggggttatatgaacatctgagaatctgatgaaagccataggctctatccttagcacactacatgtaagtatttacatacacatatacatgcaattttgcatagttcctgggctttacagtcccctccataaaacctgtccatcgagcccagattaagaatctgtgttccaatgcagttttttccttttaaagataacaaagctgag

SEQ ID NO: 6394 - DNA, 1457 bp, artificial
  synthetic oligonucleotide
agcagttcatagtaccttttgatcactgcagaaaattctattggatatgctagactagagaagcacagaaggctgtatggtggtgatggtggtgatggtggtggtgatgatgttagaggcggaaaaagaggagatgattctgccagtagaaagggagtcactgaacgtgtttgagacaaagagaagggagaacagcagcttcagaaggacattggtgggaaagagaaacgtttaaagggaaggctgtctgacatatgaaataacttcatccctatgacattttcttataaaatctttgagaaaacctatgtcatttatttatatttagatttggatttgtgggtgtgtgtttttacatgtgatatatgttactgacctcaaagcggacatctagaaaaagcaagtttggcctacattcgggttatgtaagatatacatgggtatataaaacaaatgagacatgagattttagaagaatgtattgtcttgtttcttgctcttattcacttagcaatgtaagaaacatttctcatgttcatcttttatatacacatacaatcaattaaatacatatataattatatatacaacaaacacatattcctttaagaaatatttctagacgtcaaataggttgggatagaagatatacacaattttaatactctcaacatattattttgacattgttctccagagcagatacaacaacataattgcccacagtaatgtatgcacattcccatttcttcacatgctcatcaaaactatatatttttattctttttattttttgaagttttcagaggcaaaaacatagtatttgttttaattagaagtatttttgaggtttctctaatcacgtgcggaaagaacaatgtcaatgctaacactaatatcatctttagtctctcaaagcatcatggggaaacctctccatgaaatctgaaagaggtaccctaaaccaaacaacctcttataattcaattcaaacaaatctcttctgacttaaatctccaaatcacttggtgcctctatgagaacacttagtaatctgcttgtactaaatatatttatatacatctccatttatccccactggatcaggattatatttcattcccttgtgaacaactttgggacttagcacaatgttttatatacaaagacagtgaaggacgtatatattaagttgaagagcttttgctcttctttgaaaccttgagcttctgatggggaaatacagagacatggtgctgacggtaccagaactgtttttaatcctaattcttctcttttgagcttcggtttctctctatataaaatgagagagttaacccagctgatgtttctgatctgttacagatctaaaacaattgtattccaaggccccaagtgtgtgtagggattgagtgggatagggtgagagaggtgtgtgtcttcacatgagtctatgc

SEQ ID NO: 6395 - DNA, 217 bp, artificial
  synthetic oligonucleotide
agtcatgacaacatcgtcctgtttggttttaggagatttattattttagcttttaggtttagatctgtgatccaactcaaaataatttttgtgtatgaagtaagatatagagatggaggttcacttatttttccatatggatacccagttgccaagcatcatttgttaaaacaaccttcctttccccattcaaatgacttgaccccttgattaaaaa

SEQ ID NO: 6396 - DNA, 5216 bp, artificial
  synthetic oligonucleotide
atttcaggcatattacaatactagtaattaaacaaaactataaactaagaataagatactgtggggcaaggagtttatgggaactctctgtacttcctgttaaattttgttgtgaacttaaaactgctctaaaaaaataaagtctattttaaaataaaagaaaaaagtaacttccaccagggtataaaacatagactctttgggaaatgatgctcaaaactggggattttcctaattcaatttgagatggtgataaaacataaaatgttaagtggcaatgagaactagagtaaatgaaagagaaatgagtgtgataagcacaaataagtaaattaaaagagcataaaattaaatcaataaattaaacaatgattatcaatatacataaattgggatggctgtccaactcataattcccccaggaggccatgactgttactctctcccttcatctgagaaacgactcccccttctattattctacacattggttccaaatgagaactcttattttcctacacggccctgcccttccaacacacaatgattaatagtgattagaagtatgattagggccagacatggtgattcatgcctgtaatcccaacaggctaggagaccgaggatggaggatcacttgaggccaggagttccagaacagcttggacaacatagtgagaccccatctctacaaaaaatttaaaaattatccagtcatggtggcatgcgcctatggttccagttactcaggaggctgaggcgggaggatcacttgagcccaggaagttgagcctgcagtgagccatgatggcgacagagcgagacctcatctttttaaaaaagaaaaagaaaaaacataagtatgaacatttgatgtaagcagggccaaagaagtcctgccctagaattttcaaacgaatactgagtgaaggaaactttgaggatgccattcaaaagcagcagattgccaagagccctgctgctggggaaacattgaaaagaataaagttaacatgtatacagaaacagagagagacagagaaacagagagttccaacggtaatgtatatcctaccttctattatgtacgtaatgtatattttattttatgttaagtataatatgtattttccagctggacacggtggctcacacctgtaatcccagcactttgggaagctgaggtgggaggattatttgaggccaggagttcgagaccagcctggccaacatggtgaaaacccgtttctactaaaaatacaaaaaattagccgggtgtgttggcacacgcctgtggtccccgctcctggggaggctgaagcatgagaatcacttgaacccaggaggtggaggctgtggtgatctgagattatgccactgcactccagcctgggcaacagggtgagactctgccgaaaaaaaatatatatatatgttttccagttattacaggaattaaaagaaataatgaatataaaggcacttctaaaatttttattttaggtttgggggtatatgcaaaggttacagagacaaacacgtgtcacagtgggggttgttgtacatattattccttcacctaggtattaagctcagtacccaatagtgatcttttctgctcctctccctcctcccaccctccaccctcaagtagacccgtgtctgttgtttccttctttgtgttcataacttcttatttagctcccacttataagtgagaacatgcagtatttaaggaacttaaacaaatttacaagagaaaaacaaacaaccccattaaaaagtgggccaaggacatgaaaaggcactttttaaactgtaaaaaatattaataagatagttttaaaattttgccttggattctcggacgtcagaacaagcaggtttgggtagaaaactttagggatatggataaaggctagcttaagggaagaatctgacagggacttgtgggaacttttggcctatttttaagtggaaagcacagattctatttttactcccttaattttaggagttaagcctttcctttttcttcacctgggtaaattcccattatattattatactcacctgccttgaacctgtttattttttcacttttaaatgaaattgaaagcaccctacttttgccaacatttaaagcaaaattacttttattctttcatggattctaagttgatctggtttcatctttctctctctgacttcccttaatctcatattctcttgtatctagaattatctggatacaagaacctggggctgacttcaagccaggggtactcacccatctccaaaattatgtgtgagggaggaggggatgggaggatactatgggaatagagagagctatgtagcaactctctgcctgaggtaaggccctgctctctactctgccattcctaggagagcaaggctgtaccagcagccaggtccagagacagctgatcacatagcagggaacaaagtagaaagaaaggagagagaaggaaaatcaccgtctgcaagatgagtggggaagtgattttaagcaggggtaggggtattcagctgctcataagctagggattttatgttggatgtttattaaacctgttattgctctatttaataaagtggattatcccaaacattgacggctatataagttgcttctaaagataattctatatgctaatcagttcattcttaagtaaaaccttctgattatcttagcataccttctcattccttaattccttcaaaatgtttagtaattcacttgtcacaaaaagcccagaaaaacttgggcttttaaagaaaatgcaccatcaaaggatgaaaacttcatttattgactacataataacatttacaatattttttgttatagtttatagtacaattttataatcttttttgcatatcttcctagagcacatggattctgttaacccaatagttactcccaattttagtagccatttgggagactaaataacttgtaggcaatagctacacaactactaagcaatcagagcaatcaggtggcactcaaacaattcatctgatttgtcagttatttttctagaaaactaaatcatatagtttagaccaggtgtgttgttttcatccctcgtgcccacacgtgaataagacatacctgaatttttaatcccactcccattcacttaacccagaccataacaggtgcctaccaaactgtcacacttttaaagtatgacatttatgactacttttcatagcttctctttagcaaaaaaaatacgtatatttatgtatatttatatattcaggacctctcaaagctttaaggtagggaaaggagattggagagttggacaggggtggaaatgtcatttattgaatgcatactactagaattatgcccataaagagcactattatgacattgtgctaagtatttacatgcagtaggttctatttttgtcctcatttcacaactggagaaactgagtgccattatcctcaaagatgtctacatcctaatccctggaacctggtaatatgttatcttatatggtaaaagagactttataaatgtgattaaggatcttgatatggggagattatccgggattatcatggtgggaccgatgtaatcattaggataagagggaggcaggagagtcagagaagaagatgtgatggcagaggtcaaagtgatgcaggggtataaaccaaggaatgtggacgatctctgcaagctagaaaagtcaaagaaacagattcttctctagagactccagaaggaacacagctctgctgacccttgatttttagcccagttgggtaatcttggacttctgacctccagaaccgtaatgatacattttcactgttttaagccactaagtttgtagtaatctattacagcagcaatagggaactaacacattgaggttttgtgaggtcaggcaatttttcaagaccttctagcacataagtagcagaattaaaaccccgcttcacctgcctgttgaactagactcagtcaacaagaggaatttgcagaagttatagcagggatgacacaagaatcaggttggttgagaatctaaacctgagacctaaagcagaggtgacaaacttgaatgcctaccatgtgttagggagataatgtaaatgtgaagtaggcttaattaaagaacagcctaaattaggtggaaaatagcaattcatactcctcctatatgacgaggagcaacaggaagtggtggggaccatggtgaactggagaacattcaaagcagagggcactcataagtcagttcactcataaatcagttccagctacatgttgtcatgtggcaaggtgggcccagcattgccaactctttggtttctcaagagaagacagaaatccagattgtcatgcaaagcccagatgtttaaagatggaaaacaaattgaaagtttgttaaaatgctgcatactctaaacaaaacgcatctgtgcactgacaatttgcaacctctgaaccaaaaagcttcatagatctgaacatcaatcaatatcaataatatggacacgtccttatctgtgattgccggctatgagaatctagaggggacagaacactcttgagcaattttaacctgacaagccatatacatttaagattagtttgtatgtatctatgttgatatacatataagtatatatagagagtactttttctctatataccaatatttgtaacaactaaaattctcaagataatccattttaaagctagtatttaaatgaacaatcaaacagcatagggtatcagatgcacatatcaaagcaaatatagttcaagaccagtgaactttcccattttggtttgggaatattatatttctaaattcttgggtatgctgctttaagaacctctaatctgtatggttatataaacatgaaaaagcacaatttctttttccccaaaataaaaactgagattttgaaagtataattcatttttgagaacttgtcaaaaaagcaaagggatttgggcaaaggttagtcttgttttatttcaatgtgtttttgcttttttaaaaaaatagtttgcacgagagaggaaacagcattggttttaggttctcgcagacatttttctggagttccagcatgtgactgcttaaagacatctcagtaaaagcgaaccagctgcctatcacataggactcggagccatgtgtccaatc

SEQ ID NO: 6397 - DNA, 1639 bp, artificial
  synthetic oligonucleotide
tttttttttgtagtctccaaaaactatttaaattgctcttaagaccggaactagtttgtgccccatcaccacattgcccttaatgatttattacatctagaaaataatatagaccagctcaaaacaaaacaagcaagaccaaagagttctgtgtgatgaagatgcacagaccacagccttgaattaattcctctggtctaactgaagatgtttgcatggcctcctttagatttgtggatagcactgaatagggaggtatatttggaacatgtgttgtggctatctgatttgtgggaaattgccaccaagtctattttttgaataccaaaacttccactgcaaggcttagaacctactaagtcaaaactaccttgggtgcacaggaaggcgcgcacatcaattgcagcaccttgcagacttctctgaaaagctctggctgaacttcaggtctcagagttgcactctgttctgaggcagccccggtgccccagtcagaatggccccataggaacgcagccccacagcctgcagcatcctccctgctacatcaaccccaaagctgggcaacttcagcttgctaaatgtgagtgtatcacgactggcaagtgaccaagtccatgttaccccacttactccccttaatcaaaccatggcagcggccgtaaagactttgtgagttacttgtctttgcttttgtttgtccttccagacaaacaagagcttttgcctttgtagggaagcaacaagctcatggaccaagatgaaaagatgcgcttttctgggtgcaaagcccaagtcagtggcagcagctgtttccctacaactcctcccccacctgccctgccacggccctgctgctggtttccgaacctgagtgcctttttgacttggtttcctccacatgcgttatgggaaaaacaaaaacaaaaaaaaattgctttttcaacttcagggaatattacaagggaagtgcactcctcaaagaggctgggttctggtgtgtgagatgcagtgtgggaagatacactctattcccacttctccggggacgcaccaaagtgggtgagaaggggataggagacctgaaccagcaatggcagagacagtttcatactgcttcctgcactttcccacggtcctcctgcgggaccagagctcctgatctcacctcctgcgagctgagaccagagctgcacgcctgcagcgcggcagctggccagaggaacggagaacggatgacccagcgagttcgtggctgggagcgccactgcagcaggaaagtgtgtgtgtgcgcggcgggcgggcgggcgggcgaggtgggggggttgtatagactggaaaataaagtgcgcgcggggaggggtgtggactggaaaataaagaaaagccggccgggctggggaggcagcggctgagaagaagggcaagccagcccgaggccgccggggaggagatgagaggaggggacttacctgccacgaagactgcttgcaggaggcagaggtagttcttcccgtacttctcggcaatcctcacgcgctgcagggccatggccatgtccacctgcagagggatcgcctgggctatcggcatgaaagtgcagccatctgggttctggggcaggcctgggatcctgccg

SEQ ID NO: 6398 - DNA, 953 bp, artificial
  synthetic oligonucleotide
tgctttcctccttggggtctggaattttgctgtgtaccaggtggagggtgcctgtgtgaccagctcccactaaaaaccctgggtactgaatctctaataagcttccctagtagacatttcacacaagttgtcaaaactcatttgctagaggaattaagcatgacctgtgtgatttcagtgaaagaggactggaagcttgcacatggtttcctccagacttggccccaatgagccttttcccgttactgactttgctctgtatccttttgctataataaatcacatccgcaagcgtttctatgtactgagttctgccagtgaatcaacaaacctaggccggttttgaggacctctgtcacaattggtatagtgttgaatagtctaccaaacgtttttttcaacagtcttgtgaaataggtattattattcccattctatcgatgaagaaactgaagttcaaaaaggtgaacagagagtgtgcccagaaaataaatatttccgtgtttactatattatatattgctgttctcaaattttagtgaacctaagaaccacttggaatgcttgttaaaaacagtttcttggagtctgtcacccaagacttggattcagtaagttcaaggcccaggaatctgtatttatagtaagcatacaggattattattatttgagatggagttttgctcttgttgcccaggctggagtgcaatggcacgatctcggctcagtgcaacctctgcctcccaggttcaagtgattctcccgcctcagcctctcaagtagctgggattacaggcctgtgctaccactcctggctaattttgtagcccagtctgaaatgcataagcttcttggtggctgcttcctaaactgatcattcttcatctgttattactgactcagactgtgttaccaattcagctcaaaacaattaaacaagtattaattgaaca

SEQ ID NO: 6399 - DNA, 2465 bp, artificial
  synthetic oligonucleotide
tcacgctgtagtggcagacgcccaggacgtgtaggtaagggcggctcgaacgaaagctaaaatctaaaactcttcaaaaacatgttacgaagtttgaacttcattctgcgatcaacgagaagcccatctcccaataaaatgcaaatgcaggagacctaaggtttgttcccaaactgtcctaactgccaagaagtaaaaccaaccgttttcaattcttcccctcttatgattccttctctgctcacagttgagcctgtatctaatgatttttaagatttatgttaaatttatatttatattaatcagatattatgatattttattgacaaaagagatctaaagttttgctctctactgctttaaagattttcaaatagagttattttctagctttctagctttaccttttttttttttttttttttgagacagtctcactctgtcacccaggctggagtgcagtggcgcgatcttggctcactgcagcctctgcctcctgggttcaagtgattctcgtgcctcagcctcccaagtagctgggattacagatgcctgccaccacacccggctaatttttgtatttttagtagagacggggtttcaccatcttgcccaggtctcgatctcctgacctcaggtgatccacccgcctcggcctcccaaagtgctaggattacaggcgtgagccaccatgcccggcctctagctttacttttattgaacacagcaaatactgtaatttcttcactagtttatttgttgaacgactgctatgtggcagacattattctagatactggaattgggaggtggaggaggttattgtctttagttctaggtataagtctagaattcttaccaaaatacatccttatcaataaaataataaactaatttagacatttggggatacaagtgcttgctagtgaatagtaaataatatcgttccaaattcaattctgttaaacaagtggaaaaaatgtactttgcttatagattcaaacagatcaactttaaaaaatattagagacctgaaatttttttttgtttgcattatgctctcatacatacccattgtcatgttactgcagcctaatcacaggaattttaagattcctcaagatatagcagtattgggccaggcgcggtggctcacacctgtaatcccagcactttgggaggccaaggtgagtggatcacctgaggtcaggagttcgagaccagcctgggcaacatggtgaaaccctgtatctactgaaaatacaaaaattatccaggtgtggtggcggatgcctgtagtcccagctactcaggaggctaagacaggacaattgaatcgcttgaacctgggaggtgtaggttgcagtgagccgagatcgcaccactgcactccagcctgggtgacaagagcaaaactccatccccaccccccaaaaaagatatagcagtattgttgatttttatttgttataattctgctatttattctctcaatttatttcaatacgccacctatactcatgggtccagtctaatttgctcaactataaaaatgcaattccaggcatttttatgggatttttattccaggtatttttatgggaggccgaggcaggcagattacctgaagtcaggagtttgaaaccagcctgaacaacatagcgaaaccctgtctctactaaaaatacaaaaattagctgggcgtggtggcacgcacctgtaatcccagctactcgggatcgggaggctgaggcaggagaatcactcgaacccgggaggtggaggttgcagtgagccaagatcgcgccagtacactcaagcctgggcaacagagcgagactccgtctcaaaaaaaaaaaaatgcaattctgggggcaggatggctcacacctgttatcccagcactttggaaggcgaaggtaggagaatcgcttgagtccaggagtttgagtccagcctgggcaacatagcaagacctcatctttatttttttttaatgcaattccatacaaatcaaaatatactcagcaaaacatgaaattatgcaaggtgattttttctgtatccaaactcaacctgaaattagagctactctcacacacatccttcagagtcactcctttgtgagtttttttaagacaagaaaaaagattttggttctttttagtgcctcctcacagtttccaaagaaaacccaggtgttgtagaaagctgttgtctgtgactatgtaaagtaggccctcagccagcattttcattgggacaactccattgaacagaactgcaaaaatgaacttcctcctgcctaaactgtcagaacccctgaaacataacaccacctcttctggtggatcagctaactgcaacagaaagaagccccacaggtaggaattcagaggaaacagtcttgtttctgtccttattaccaacttgactagataatgcttgctacctgagggagagaa

SEQ ID NO: 6400 - DNA, 2619 bp, artificial
  synthetic oligonucleotide
tgggagcgccagtgcctggctgaggccgagcaggaggagcagctgccccccgagctgcaggaggaggcggctgcagagttggcagggctcaagagcgagaagcagaagctgtggcacctcttccagatctcggccaccgccgttgctcagctttacaaggattctgggtgccaacagcaaggactttccatgtgggaccccttccagaatgcggccatggccgtgaccagcctctacaaagagagcggggatgcccaccaacgaagttttgacttgggtgtccaggttggccaccagcgtcgcatcaaagatgtgctggagtgggtgaaaaagggccggagcaccattcgtcgcgaagacttgattagcttcctgtgtggcaaagtgccccccgctcctcctccacctcgcactcctaggacacccccgaagccacccactggggtcaccagccaggctgtggcaactgagtccagctcatcggtggacgtcgacctgcagcccttccaggaggcgatcgccctgcatggcctcagtggtgctatggccggcatcagcatgcgatcgggcgactcgcctcaagacagcggtgtcgccagcagtgggcgccgaaaaactagcttcttggaggacgacttgaatcccttcgactcagaggaactggccctccacctggacagtggggggatccgcaagcgcacctcggcccaatgcagtgatggcatcacagactccccaatccaaaagcgcaaccgaatggtctaaactgcctcattggttgcctgccgccatattgcttgagagtgaactcaaccgtcgacatgcttgtctaaaggttactggagaccatttttcttcccttctctaagttaaacaaagatttctaacaattttgccataaagaaactttaaaagtattccagaagaggcttcatatgactctgactttccaaaaaatataatcctagcagagaacaaatatgtagtagttagcaggatcatttaaagcaaacgtatctggtcaaggcaggagtctgatttatcttgttcacagttatattcctcagcacctagcacagttccaggtgctcaataaatgttcattgaatgaataaatgtgaccttatttattcttaaagggaagtcatagcaggtgtttacttggttatagaatacttttttctttgataattgttggctttaatggtctttgccaattcaattgcattgtatcaaaatgtaaaacttgacatctttgtgaaatctggagtcttccatttttacctcactataccatgcacctaatttctagaaagaaactgcaagtaatacatattaggctgtgatttttttaattttgaaaaattgttgattttggtgattatgtgatgctgcaaagaggtgctgtggtggttacgcaggtattacttaatattgagtcaattcagtgcttttttggggaaaactaaaccatcaactgagaccctgatgagatggtggcccagtggtgctctttttttttaggaatgtaaaaattcctttttctgaggttacatcttttttatgatctctgttttgaagtggaagaccaagtagtcagaatgaacttctgggtttttttttttttttcttttttttttttttttaagacagagcctcgcactgttgcccgggctggagtgcaatggcgtgatctcggctcactgcaacctccgcctcccgggttcaagggattctcctgcctcagcctcccgagaagctgggattgcaggtgcctgccaccacgcccggctaattttttgtgtttttagtagagacggggtttcactatgttggccaggctggtctcgaactcctgaccttgtgatccgcccaccttggcctcccaaagtgctgggattacaggcgtgagccaccgtgcccagccttttgaacttctgggttttaattaagggtacagcatggtataaccaaaagagtgtgaacttcgttttaaaaggaccaacagcagaatcctagctctataaattagctgcatgattttgaacaagttacttaatgtctattgacctcagtttttcatctgtaaaatggaactgtgtgtctcctaaggtggttgtgaggatcaggtgaaatttatatttcaagtgtccagcacaatcttggcacataaaatactcaataaaggttctcccttctctataaataaaaatcaataaaacattaaaatcattttattttagaaaaagcagaaaagtagatcagctttaaaatcagcaagtagaatctctgtgtttgaactggaaattactgtttcacattagaaacttgcctaaatatcacagatcttgtgtaagtgtgttgagctcatgagcactcagggtcaccaatctggatactagggcaaccttggagttcctgaagttgcctgaaggatgcactttgcaattaggggtaatgaaacatctaccacctctggcctgaaaaaatatgaggaggagggtgtaaagtagaaaaaaattggaagccaaggtcctagggcacctaaaaggctaaagtggttttaaatgaggttggggtagggtggggtggggtggtgtggaggcgatgaaggaggta

SEQ ID NO: 6401 - DNA, 852 bp, artificial
  synthetic oligonucleotide
atgtggcaagattttgagcagaggaatagcatgatctaatttatgtttttaaaattggcacataataattgtatatgtaatttatgttttaacaagatcactctggattctctttgaaaacaagcagaagcaaattaaggataaaatctcaaatactagttaggaggctattgtgtaagtccaagcaagacattatggtggattgggttaaactgatatgaagggagatggtgagagatatttggatatattatgagaatagagccaacataatttacaggtggattgggttagagttgtgagaaaaagagagaagtcaagatgatgccaagatattttgcgtaagcaacaagaagtgtggaattgccattaacagatggccaataccatagaaagtgcagattggtatgcgaagatcaagaattggtttttgaacatgttaagtttgagatgccaattagacattcaaatggagatacaagtatgtagttgaatgtgaaagtctggagttcagagaagagatctgatctcaagataaaaatctgtgaattgttggagaatagataaaagcatgaaactagataagattagcaagggagtaagtgtaagtaaagaaaaagagcttcaagaactgagccctggtgcattgttaagttaataagtcaaaaggtgagaagttcagcaaaggagatgaggaagaatggtcagtaaactaggaaagcagagatggttgagtgtaggtgtcctggaagccaagtgaagagtttgtaggatgatccagtgtttatgatcatcatcaactgttcatcaactgccgaatgtggctgatgagtcaacatgaggtgtgagaat

SEQ ID NO: 6402 - DNA, 393 bp, artificial
  synthetic oligonucleotide
atacttataaaacatttataagtttgatatgtagtaagggctcaataaatgttaactattataattattgacatgtatacagttaaaaatagaaggtgtattttttattcattctctacatttccactcttcaggaataatcactgttaacaatttaatgggtatccatccagttctttattatgcaaacacacacatatatacatatatgtgtgcataaatatatacacatatatatatgggtatatgcttatatatgtgtatatacacacacatacgtatttgaaatagaaatgggatcatacaatgaatactgtttaacagcctgctctgtatacttagcaatatgtaaatatatcattgacatccttgtaagtcataatgcagatctgc

SEQ ID NO: 6403 - DNA, 3717 bp, artificial
  synthetic oligonucleotide
aagtgctgtgagagaagaagcaacatagcatatataaagacctaatgtgactagggagcactagaggaacagaagtaagaatggcttctcagagaagcaagtgaggcttaagggaacatggaggaatattaggatttaaataggaggaataatgaagggaacaaatttttggcagagtgaacagcaaaatcaagggcttgaatatggaagttagaagaattgcatgagatattattgcatgtaaagctactagttgagtatttgacacagtgcagatgcaaagtaagagcaaaatacattttatcaatcatgctaagtgacagcagggctccaaagggaagtggaaggcagcatcaattcataaatgtaagcttaaggagagaaagaagccatacctttacagggaggcaatatggtgtgatggttaagggtacaagctttagagtcagacagagctgagtttcaaggcttgctcctaggatttactagatctgtggacttggttgagttagttagggtctcaattttctcatataaaatggggaaaataactgaacccctctcagagtggttgtatgaattaaatgaactcatccatgtgaagagcttcatatggtacctcgcaaataataaacacacaaagattgcgattctagatcaggggtatgcaaactttaccttggaaaggtccagatagtaaataattcgacatatgatctgtcacaactgcttaactttaccattgcagcatgaaaacaaccatgaaaaatatgtaaatgaatgggcatggctgttttccaataaaactttattcacagaaacaagtgacagatgccactatttaatcaaaatatataatgcaaactacatataaaattgtagattttctggtagataatttaaaaataagtaaaaagaaacagatgaaattaattttaatggtgtatttaacccaatgtaccccaattactatcatctaatatgtaatcaatagaaaaaattattagtgatagttttccttctttatatagagtatttaaatccaatattattttatacttaaagcacatctcaatttagactagccccatttcaagagctcaagagtgacatatggccggtggccaccatattgggcagcatagttctcaatattgaactaggttatctaaggaattcttttcacttctagtactctattaatttaagcctcaaagaaaataaattatagtttggggtgtcataagttcaaaatatttaaaagtgcttgacacaatatcaataagacaagaagtaaggttttgcatacctcagggaccacaaatatagcccaatttcccatgcccctctgacttctactccaaactacattcaggattgattgatcacaatacttttttttttaagctgattctagtcccaacctctgaatccttgatacagaatttcacacatccactaccaacgaatccatgcaagtaagcaaaatgctttctatgggcactttctcaaaggcaaaaatatgagcttgggagtgaaaagatttggggtcaagttctagctctggtattcactgactctataatctgtgaaaaatcactagcccattttgggcatcagtttccttacctgtcaaacatacattaataaaaatccttccccaaactgacagcatattatgagacactacattgaaaagtgatatgtagttatagaagattgtacatacgtgacattccccactctggaatttcaacctacacctgtaactagtagacatggtggtgcttttaagagatcagctagataaaacattaaagccacttatgcaggggaaattgacattgtatggggttgagggatctatggaaaccacagaaatagtggagagtgagtgagaaaacccccagtaatttaaaggaggtcacagcaaaagcgcagtttaccaggaggaagtacctcagccatcttcaatacctagtaaagtgggagcctgagacccttcttaaaggcccaagaaagtgagtgcagcatcttgacatgtggaaaccagcacacatgtaaatacaggcatagttctcacagtggtgaagtgctcatgccttcaggaggttttgcctaactaccaaacactaaaagaaccctgaactgaggctgcaggattgcttgaggtcaggagtttgagaccattctgggaaatgtagcaagactccatcttaaaaaattgtttaaattagctgggtgtggtaatgctgcacacctgtagtcctagctactcaggaggctgatgtgggaggatcgcttgagcccaggagttcaaggctgtagtgagctatgatcataccactgcactccagcttgggtgattgagcaagaccctgtctcgaaaataagaagatcaaaaataacctggattggtggtatgagcttctgctttccctaaatcacaggcattacacaatccctgtgatgtcagttgcaattcttgagagccacatcccagactcagtgcatttcaagttggaagagcccttgtagatcatcctgggatgtttgctgcctttggaatactggtctatgaggtattagtagcattaagatgtatatcatggtcatatactttagttaaaaaacactaaagggttgtgctactgcaggatttctcagagcctttataatgtgctgccatggtttgaatgtgcccccacaaagttcatgtgtagagaaattggtcgttagcgcagcactgttgggaggtggggcactgccctcatgaatggattaatgctgttatcctgggagtgggtttgttatcacgtgagtgtgttcattataaaaggacaattttggtctttattttgtccctttatctcaccctcttttgcctctctgccttctagcatagaatgaggaagcaagaaggcttttgctagatgccagccccacaggttctcaggcccttggcctcatactaagagttacaccatcagctttcctagttctgaggcttttgggcttggactgagccatgttagcagtaacccctggcctccaatttgcaaatgacctgttgtgggacttcccagcctccagaaccatgagccaattaaattcctgttcattataaattacccagcctgtagtattttgttacagcaacataaaatggactaagagatatgtcagggaatagtgtgacattctaagaagggcatatagaatggagtgattccagaacatattttactattgaactgtttggttgggttttttcctcccaaactggctttacgtcttaaaatctgcatgaaatatatatttccagtaagttcattttacatctgtaagtctagagagggaaagaagctggtcattcaactagtcaatggcagagccaggactaaaccttgttttccttgattcccaaattaatgtttttccacacacaccaggtcaaccctctgtcagtttcctctggatgcaaactataaaccaaacaagaagtattcttgatcagagagtagaaaaatgtcacaggaagctttcctagttgtcattactcataaataaggctgtgattattcatgccatcattggcttattattgaaccttcagtttactcacaagctttggaattagtaataagccatgaaaaatgacacttgtcaatcagcacaatcaaagcaaattacttttggatgaggtttaccccaaac

SEQ ID NO: 6404 - DNA, 2490 bp, artificial
  synthetic oligonucleotide
tcatttttaaactctatgtgcctcagtctcctcacttggcaaaagtactctttttatcatacctgtcccaaaggggttattttaaggatcaatgagttaatatttgtcaagtgtttagaatatgcactaaatgcaatgtctttcttaagtgaaaataaaattaataagctgaaccaattttaggggaacccagaggatggtgtcacttgattctgcctacaagcattcaggaaggcttcacaaaggaggtgacattggagtgggatcttaaagaagcagtggaagttttccagataaagaagaaagcatctcaaatcatcggaaaggcatgtgcaaaaaaggcacagagtcatgaaaaaggctggtatgactggggagtaatgagaaatgagtagctggaatttggtggcaggatatgaggctcaacatttagttttggatatgttggacaagatcttgagtgtcatgctaaggaattcagatttaattcagaggaaaggaagggagagccaacaaaggactttaagtttgagagagtaaaataatcagctttgttttgtgggcatttcattctcatgacagtgtaaatttaaagctgaaaaacctgctcaggtgtaataaaaaatatagtaaaatcaagtaaccccaattggaacaacctaaatgtctatcaacaataggatggatacattgtgtgttatatttgcacagtggaacactatgcaacagcactgataatgaattactgctacgtgcaaaggacatggatgaatctctcaagcctagtattgagcaaaaaaaaaaaaaacaaaaacaaacaacccccccacacacacacacagacacacaaaagggtgcatcctgtattattccatttatataaagttcaaaaatagacaacactaatctatgccattagaagtcaatggttatctctgagtgaggaatagtgatagaaaggggacccaagtagggtttctgggctgctagtaatgttctctgtcttgaatttgccctgggtgctggtttcataggtgtgctcactttatgatcaaattcaagacacagaacacttgcactttaaaccaaaaacaacatgctttttagtgacatatagtgtacatatgcagacaaatcacttactgtttcaaagtacaagtggagaatattcaaccctgcagagatccaaccgacctttgaccacagtgggatatgaggatccatgaacacagatgtctattacaaagcagctgccccaaaagagagagtttttcttttaggtatttccaggtgaccccaatattatgcttctagatgaactcagctacaattggttggtctgcatcatcacctgtgtttctgaagttcaaatttcaaggactttaaacattgcctctaaggagagacaaaggggaccaggatttgggaaggaagtcaagggaaactctagtcttatctataatggtttaagtccttacaaggagaagtgtgttttagtcaggtgtttattgtatagttaacactaaacctgaaaaaaacctatagctctacctagtcattacatgataatgaaaagtagcagatattacttaatcaggattgaaaattactggacctggcttatcattatgttaaattaatggcttgcctgtatatgttcttttttgattgaccttcatgtgagaaaggttgatggtgttggggacaatttgcagatgagaaaactgaagatctgagacattatgtgcgtggctcctgggcaaccatttattaatagtagaaaaccactatcatcaccctagtccaagccaccattatctcatgcttggacaactacatagtttactagttgtttccctagatttactatgtttcctaatatgttttctacactgaagctagagtgatgttttaagaatgccatgttaccctttgactttttaattttttattcttttgtagagacagagtcttgctatcttgtccaggctgctcttaaactcctggcctcaaatgatcctcccaccttggcctgccaaagcactgggattacaggcaccttttatttactaaactcttcaatggcttcctagtgatcttagggtaaggactcaaaacatcagcaggactttgtaggcccatgatgggtaggccccacatgtgtatctctccagccccatctcataccatgttcctccttgttctttatgctccagccacattgaattttcagtcccagaaacttgctataccccttccaaccacagggtcttggcatgtgctgctccctttgatgtggatgttctaaaatttattagtttggcatcagtcattttccgttcctccaacaaacacctgttaacaggtggacctacctaagttaggagcccaattctccttgtttccctttgtgttactgcagtttgaagctattttagtcttttcaaggaaaaaatgatcccaaagggacttaaaataacaaagcaagtg

SEQ ID NO: 6405 - DNA, 1307 bp, artificial
  synthetic oligonucleotide
agcagtctgattccattttttgatgtttgagtgctggcagcttttaagcttcagccccctcgtcccactgttctccacatctgggcaagcttttaagaaagcttgggcactacctcctttagttctggcaggattcaaaccacataagcccctgaccatgtgtgggaacccataccctggtcctacctcctagccacaataaaaccccctgtccaatctccttttctagctctctcaagccagttttgggccggcttgggatgcctgccctgctctcccttggagagccccaattatgcaattaacaaaccttttcatacactttttgtttgtgtttggcatcatcagtcttgacactggaccaaattttgggtagatggtcataacagaactcagaggtatgtgccgttataatcagcattttgcagatggggaaactgaagaatagaaaggtcaacataatatactgaggcttctaaaaggctacaaaattatagaaaccacttctgaaaataaatatactgctaatatttcaattcagacctaagaaaatgtaatagtttgtgtgtgctattgaaatgtaagtaaataatctataataaatctttgactcttagttaaagttcttgcccaaggtcacacagttactgatggggctgggattgaaacccaggcactaagactctggaatctacactctaagcatctcaaactgatattggtccaattgcaaagcctgtgctctttccactacagcaggaaagtaaacctggattgcataaagctatagaaaggctgtgtctagaataataataataataataataataataatagtatatgctaggcattgctaagtcttttatttaatcttttctacaactctgtaaagtcaatactattattgtcttcattttacagataaggaaattggaggctcagagagcttaggaaataatatccaaggtcacagaggttcttgcgaagcctctgcttactacctgtgtgaccttggatattatttgtcttgagaaactacatgggttgatttattagagttcatagtctaatgttcatttggaatgtggagttttggattcttccaggattgtaataataaaggtaatattttccctgtattgagtgataagccccttatatacattctcctatttaaacttagagccatgctataaagtaagtgccgctattattcccattttgcagaagaggtacttgagtctgagagaggttcacaaaacatattcaatgaaagcaagctaagctatggacttgggtagaagctg

SEQ ID NO: 6406 - DNA, 1185 bp, artificial
  synthetic oligonucleotide
taatcagattgttttcataggaaaactgctctggtttcaatatgaaagatgacctggagcgaggtgaccctggagccctggaggccagtgggatgctagtgcctgcattacattccagccaaagacaaggaccttcctgctgaaagactttaagttgattaccaatgatctctgcctgctgacattcaggcccctgtttattcccctccccttgagtgtggcctggacctaatgtctcactcctataaacagaatacagtaaaggtgttggatgactcttctgagattaggttacagaaaggctatgacttccaaaatcagctgccatgtcgtgagcggccctatggagaggttcagatggcaagtggcttatgtctctggccaaaacctagctagaaccagaggcctgcccaccagccacttaagtgaactgggaagtagatcttctgaggtaagccaacagccacatcagttaccttggaaatggatcctaccccagtggaaccttgagataactgtagtcctggctaactccttgactgcgtccttgtaagagatcctgaaccaggtgggccacaccaaaattcctgagccacagaaactggaattaacaagtagggtatctgttgttttatactgccaacatttgagataatttcttacacagcaatagataagtaatacaagccccaataaggcagtggcaatgaaaagcagatgaattctgaaaatgtgagcaagctgggttggagtgtgagaaggaaacagatatctaggcagacatcgacgctgtttaattaagatggaaaataaagtaggaggtgttgctttggggaggaatatgatatactagtttgctggccaaagtttgagggcctgtgggacacccctgtaaatatacttaggaggcagcaggattcaaagggcagaggtttaggacaatcatatggactggacatttgggagtattaatgtagaggtggcttaggaagtgcaacagtgaagccctggagatcctcaacatttcatcaaaccagtgttattgtgtgtatgtgtttttgtgtgtactatctatgtatatcttctcctaagcaactacttcgcatcctaaaaaaaaatttccttatctttgcagccatttttgggttttcattttacctcactgaagactctaaatatgagtga

SEQ ID NO: 6407 - DNA, 11048 bp, artificial
  synthetic oligonucleotide
ggagtgtggttccactgcgccgcggtagaaccagctacgcaaccttgagcaccgtcatttccccttttggggccagtttcctcctatgtaaaacaaggaagaggagggaggaggaattggagtttgaccagatttcattattgttgctgtttaagcagcagaacccttattacaaattaaaccttatcagaaccccaatctataaaatggattaaggttcggttgccctgatagacgtgagtggggaggagtgggggaggggccccagtttgaaaactctggcctagaagatgaaagtttcattctagttcagttccgttctcttccctattgctgaaggaaagaaaaaaaaatcatttttcatctgtatttaaatcctcctaatgtgctgattgatgaaatcttttcccttaagggcaatttggaaatcagacaaagtgaagcacaaagccatggatgtttagagagagagtgagcggtatgtgagacacactgaaagggtgaccctggcacttctaagaaggcagcagcacaatggactcttcgaaagaagcagtgtcagagtttattcccctgttggcaccgcctcccacagtgggggcgaattgcttgtttttaccctccctttcctggagtcatttcagaccaaatttgagtccacaattgctagcaattggaaacccagagtaacctacggacaggtattttattgaaggccaaacacggtaaaaatatggtggggggatagatgggacaaaagagtttcctctcgcccctgggtttttggagcacccgggttgaggggccaggggagatgaggctcactgaccaggcagcttgcaggtttgctccaatcacagcagcaaggattgaagcaccaaccagccgggaggggggcgaggtctgtggccctgggattgggagaagggggagtggtaccaaggctaagactgaacccgaacccgagcctggacgcgcggcaggaccaggaggaggactgggtggagggcaaagcgtatgggtctgtaaatcaacgccggccccctcccaccccatgctgcacagtgggggatggaatgcggggggtgagggttggcagtggaaatgtcttagggggctggtgctgccttcccagggagacccgacctttcttgaagaggcggagtgggtttagtctccaggatccgcagtgatgtgtaaaaagcgggcacgacccccgaagcctcagaaagccccctccccacccccccaccaggccctccccggcccgcaggtgaatgactggcccacacaaaggaagccggctggaaatgtggaattcggaccaatttacgggagactctgtcgcctagggtcccagcggacctcaagcaaagaaacctgtggtcagtagtggatgaggataaaaacagtgcaccaggccaagcttattggaaaggctgagtttagttattctgggatagcgaggtaacaggattaaagggattaaggaaatcacctcaaacagctgaggagggggtaaaaaaacactggttctatttgttttcttcctaggccccaaacagatacactggggccgtgtggctgggcgcgaaactaaaggcccttcggggggcacagtggaatggccaagggtcagggactggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcagacttcactaccgagcccatggggcccaggctcatggcggctgcggccgcagctgcggccgcggcggtggcgggctgctgcccgtaggcggcggccgcggctgctgtggctgagggcgccatgcccccgtagcccgaggcggcggcggccgcggcagcgacgttcatgtagctctgagcgccgggcggcatcattgggctgtactgcaggccggccatgtcgtagcggtgcatcggcggcagcgcgggcggcggcggcgggctgctcatgctcgggggctgcgcgtagcccagctgctcctgcaccagcgagtacgcgccgttggcccagccgttcacgtgcgtgtacgtgtccaggcgctggcccacgcccaccggactgctggcggcagcggctgcggccgcggcagcggcggcggcggccgcggcaccgggaggcaggaggccgctgggcagggagtacttatctttcttgagcagcgtcttggtcttgcggcgcggtcggtacttgtagtccggatactccttcatgtgcacggcgcgaagtcgcttggcctcgtcgatgaatggtcgcttctcggcgtcggtcagcagtttccagtcggcgcccaagcgcttgctgatctcagaattgtgcatcttggggttctccagggccattttgcgccgctgcccgcgggaccataccatgaaggcgttcatgggccgtttcacacggtcctggtctgtacccccgccacctccgctcgcaccaccgctgctgccgccgcccgagttcgcgccgccggctgcgttcgcactactcttgcctgcgcctcccggggctgcggggccgccggtgcccgccgcttgtgtgggtgtccctacggggttcttgagttcagtctccagaaggctgtacattgccggggcgggaagaaggtgcgccagcgtggcgggaggagaaggcgctcccggggctggagcggccacggtgaaaaggccctgggactccgtcggagcggagcttgggggcctgtgggccagcgagtccggcgggaagggtaggcttatcaaaatgctccgcgccaaatcagcaggaacccgcgggcttctcgcacctgatgagttctctcgaacaggtcgcattcacagtctgcctgggctctagctgggccccttatatacctgctcggattccccggggttggggcttggtccgcccctcgcaacccggaggacccgtgattgacaggttcgcagtgatgcgccctggccaatcattaccgagcccccgttcggcctggctggaaaaaaaaaagttcggggagccctttcgttcaccccacgcccctctttggcctagtgacgtggtaagagttacttaggaggcgggagtccacgaggcccactcagaggccaccaattagggtttcaaaaagtttgaaagaacgaaacctgaggaggtgacggggggaggggggagggggcacgcaagcagattggggggagggggcagaggggcgccttcggaatttagaaaacaactttgcaaccctgtcaaggcagaccggcgccccatcccccggccagcccgcaaagcttcccgttgtctgcacggaggttttctggccgcttctgctgccagcgctaggaacgcagggcaccaccagctacccaggccggcttagggactccaggctcattggaagtgctcctggctgcgtctccaagaagctctccctggaattggccgctggttgtccagatctttctctaggagggccagtgcgtccaggacgcagcgtgggtcaggggcccgggcatgggagacaggcttcaggactgcggggtgcattcggctgtgaggctcttgggggtttgcaggagggcgggcaagcagtcagtcgcccgtctcctgagcctgtcggaggcgctcgcacaaggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagccaagcccagctcggggtctggcttttaggaagtgagaacaacttatcctggggactctcggagacgccttgattttcaacagacaaacaaaaccaaaaacaaacccgcaacagtttgcgtttcttaaagcagtcatttctatcttttcccttgagaacaccccttgtctgtttactctggcttctagccaagattgtgtatttaggccgctgatcgagagccttgatcaaaaaatcataggcttaggtctattgtagaaccatcccttgtaaaaaaaaaaaaaaaaaaaggtcagaaaggtcaccatcatttcaacggggtggtagagacagcaccttccagttcctggagcattcagtaggaaccccagccccactccgccaacgcgtagcaccgtctccagcggaagtactctttcttacaggtcacagaagcagctgaagaccctaggctggtgggtgtagattgtaataacttagtcgatggtctctaaagaaaggttgctaggagctgcgaggtatgggaaaacaaggtcctcgaggtaccataaagtctcctgcgggctgtacaactgtattctatcgtagtttggtgttgctcttttttgggagggtgcgggggtacttttaaaaaagtttccgcattcaattcacttggttggctgagctgtacttggaaaatacactgggagtcccctcggcccacacgttggcgctcagtttccttccacccacagagtattcaggtgttaatcaccagctctcttttccctatgtgcgcagcaactccaaggaatttgacaacctttgccttctgcttttactcgctgacctcaccacccgaaagttgccattttcccggaggaaggaaggctctgcccatgcactgggtcccatttccagcgggctttgctgagccatcgctgtcagcctctttgcctctcacccccctcctacacccgtctttgcccatccccacaactctcctcacgcgctcagctccgcagactgccaaacccccacccctgcggagcaactcggggaactcggccccctacgtccaggcctgccctcccactgggcctgttgccctttccacttccttttgtgactgcagaggcacagcgctcacctgtacagaggcgaggtgacctgcaggaagccggggccaataaagtaatcttaaaatcgttatcagtatgcaatgctgtttgagtttttccatgtctccacaattccattcgggtccaccaggcaaggcagcgcttctcgggaaagggtgcctggaaaatcagtggacctccaggcacttccagcgtgaccaagcaaagctatcgccccaaccacagggggcgcaggatggcagggggttgggtagagcatcctggagaaaattttaaattcgaaggcagcactcagcggttccttttccactcttttatttatttctttgtttttctttttatttatcattttcttttaagagagtggaaagccgtggaatttggtgcgcagaatttctatgttctcttttcatctcttcaacgccctcattttttttttttttttttcatttcactaacctttgtcatccacctgctatgtgctgagttgtgcaccaagtacgggacggagaccctgcactttcccattccgtatcagatagtggcaatggcttgggaaagtctcaagaggactccggattcggagagaaagaaattttcgcctgatgctaccccatccccctagttgatctacggagaaatcgggcctcgcgagaagcgcaacatcttggacaaggacctggcgtgagcggggtcgctacgccccgacctgcaggggccacgctcattccccagcgcgcgcgcgctttcccacggcggcgcagagtccagctagcggagaggcggagggggaagcgcccgcgtgcctggagccctggcggtccagcgtcccggcgttgccgtctgagtggcctaaaagggaggctctggggccgctgctcgcgacggagagcggggacgcggcccaggaacagctaacgtgccgcttgctgcttgccaggtatggaggatgcctatcctcaggcagacccgtttccccgcgggctggcggccagacggcgcgacaaaatgagatctgtcgagaggtctggccgtgatggctttttggcgtctaggccgctgtcatcccaattccatttctccgaaaagcatcgccgagttaggacgtcggggctttgctaatgtgatgtttgtgtaattaacaccatctccccttgtttctgaacatatttcctcccgcagcacagaccagctttcatttgaaaaagcaacgggaagaacgtcccaataaccctttctaatgggaaaaaactgccccttttgtggaatggtttctttacaaagccaacaaccaaccttattttctagttccaatggctatcc

SEQ ID NO: 6408 - DNA, 1351 bp, artificial
  synthetic oligonucleotide
aatcagacaggtttggatttgaatcccagatacgcaatttacttactatgcatatttcagcaattgacttaaacctggatgcacttcagttttatcatctatgaaatggacaaaatttaccttgctggtttgttcaggggatggctaagcttaggcatctttcccatagtaggtgctcagtaagtgttagctcctccctacttcttatcacaagggcactgctgtctacaaaatgaaccttcatgcacaaaaattagagaacaacaacaacgacaataacaataacaaaagcttcctccaggtgtgaattttgtttcccttaaaagtaacaagatactgtctttattataaacaaatatatattgcacccctctttttttcatctttcttacttcaaatttatctttaccctctgtattagttagttcttgcgctagtataacaacatacctgagactgggtagtgtataatgaaaaggggtttcatgcacagttctacaagcggtacacgaggcatagctggcgaggcctcaggaaacttacaatcatggcagaaggtgaagaggaaggaggcgtgtcttcacatggccgccaggaaaataagagacagggggaggtgctacacacttttacaacaaccagatcctgtgagaactcactcactatcacaaggacagcaaaaaggaagttggctcccatgattaaatcaccttctacctggcccctcctccaactctgtgaattacagtttgtcatgggatttgggtggcaacacagagccaaaccatatcacctttctaatttcctcatgaattactgtggcacctcaactactactctgcaatatttctgccaagactggacaaagggcaacatgagtgaggtactagggaagaatcccatttcctctgcatcctaaatcttgccataatgttagcctaaaggttgaattccaacagcagggaaagaaggtggaaaagaataatttttattgatctcttcccgccgcaattttcttccttcagttcggcagcagtcatgtcaagggtagcggtggaaaaataaatggcttctctctgtgatctgtgttttataacatctctgtactcctctttcttcctccctttttactagatttacagaagaaaagcaaaggtgacagattagtatagtgatttgtgtgtcaaacataaaaaataataatggttccgtgtagactataataataatagtaatagtaacaataatggccggcatttttcaggcttttagaatgtgtcaggtattattctaaggcccttacacccattaactcattgaatcttcacacaaattctgttgagtaggcact

SEQ ID NO: 6409 - DNA, 1276 bp, artificial
  synthetic oligonucleotide
gcctttccttaaagctctttgataggattggtcaatataagccctgaaaccaatagaaacagctcacagacaacattctaattagcaaaggggcctatgtgaccctcaaagtatccctgtttctcttggcacagcctaaaaatcaatatgcattttcctacagagacacacaaatgccatttaaaaaaaaaactcttttctctctttctctgaaagtaacctgagctgtgagaattgttattcttactctgaaaactatcaccattgtttgcttagaggttctgtgatacagtgaacatatataggcttggaatcacacagatctgagtagaaatactaggtcctctactggctagctgcataatttggaggcaggtcattttacctctgtaagcttcagttttctcttcccaacataaagtaggtatgtgtaaatcagcacaaccgatttactgaagggagaactctgcttcagttcccattcatgttctatatttggagagagaaaatgaaataattcatcttatatcaattctgaatgaggcccaagttttttatttattaattagcatttgagatgtcaacagatgtgctctacatatgagtgaaaaatagctctcatagtttatcttcttgatgctctccaactgccaggcacagcagtctctagaatattgaacaagttaatggaggtgccgcagtgatgcactgttgtagttaggagcagaacattaggcacggagttctttaagtatttagttgtaggcatatatcctcaatcctaatgaaaaagaataaaatttctcagtatctcattgcaacagttaatagaattaaataccccaaaccaacactgtaaagttgagggaacaatgcatcacataaaaacaagggaatgtaatattttattatctgttgcccaaccaatatgcctctttccattgtaattaaacttttggtttgaatgagttttttttcttttgtaataatttagtacatttgcatgtgcataataagtataaaattacaattattatcatgtaatgcatttaatgttcagtcaatcgtattatcttctggtctaaaaccttaatatctattgaattgagagtcctgaacacagagtcccagattagctcaccaatgaacagaaaaaaaaaaacagagaaaaggggagaaagaggataaagagaaagagaaagcaagtgaaagagagcaaaaaggagagagcaagagagcatgagagcaacagttgctgttcaggaccataactgaa

SEQ ID NO: 6410 - DNA, 2394 bp, artificial
  synthetic oligonucleotide
tcacacatgaaatataaggaggaaagtgtggtaaagtggaaatagcttttggacttagaatgtgaaggtcaggacgcacactccagctctgtcatttactagatctgttacctgtggcatcaagctttagccacagggtcctcaatcttctcataaacaaaacgtgggcagtaaccactccttggtgttgttttgaaagtctgattagttactttatgaataaatgcataacacacaacttggaatatgccaaatatgtttagcagttaaccaaaagataagcttctatcttttaacagactgcaagtctcttgataaccagggtcaagccctgcccacctgtgtcctatccaaatcctccctatgcacctacttagcatattgcctggtacatgacaaactcagtcaatgttaagtgaattaaattttttgaattaggataaaaataacctgctgaccagtactgaagacagcttattctggtgtttgtccccaaatcttcattttgccccattagaattaggttgtttaccacgtataccctctgtggttttggttgtaaaagatgcatgtttcaggaacagattgtgttgactttttctgcaagatcgtggcatttgatggcactatatctcatgtggtaaaagactctaagcaggaccccacactctttgacgacaccctattttgcatttacactgttgctctgagagctactgtgaagggagcagtaagacagtagtctgacaaagtaaaaataaggtttatttggggtgtaagttggctaattccttgattcaaattttttccccctttgtgattactgtgtcttcgtttaaaagacagaaaacttataaattatacttttctacctgagagaagatcgaaatgaaggagtaatatgaaagatgtaattataatgtgccaaaataggatcattgcaagtcgttctctttttaagaatttattttgttgggaagccgagtcaggcagatcacctgaggtcaggagttggagaccagcctggcccacatggtgaaacccaatctctactaaaaatacaaaaattagctgggcgtggtggtgggcgcctataattccagctactcgggaggctgaggcaggagaatcgcttgagccagggaggcagaggtcgcagtgagccgagatcgcaccactgcactccggcctgagcaacagagtgagactctgtctcaaaaaaaaaaaaatttattttggatgacatttaaattaaactgcatctcaattcaaatacaaagtaggaaactctgatcactaactttgccaatctgtcaatagactatcaaaagttttagcaagacagaattgtccttttgaaaatcttataccacatccctagacacaaggagaattactttgttcaagttgtcaccttgtgacataaacttaaaactgccttcccccacagtggtaacagtccttattcatgaaataacttgtatgtgttggtagctagataactaacatttcttaattataacagatgcagatccattaagggaataatattgcatactccgaaaccagtcatgtgtataatcgtgagcaatgaaataatcatgtaaaactaatcataatggctgtcgtttaatgaacacctactaaatttaggttttgtttgtttgtttattttttgagacagagtctcaactaggaccgatatttatgtatttagttttttgcgacagagtcttgctgtttgtcacccaggctggagtgcagtggcacgatttcagctcactgcaacctccgcctcctgggttcaagtgattctcctgcctcagcctcctgagtagctgggactacaggcatgagccagtatgcccagctaatttttgtatttttagtagagatggggtttcaccaagttggccaggatggtcttgatctcttgagctcgtgatccacccacgtcggcctcccagtgttggaattacaggcgtgagccaccgcacccagccatagatttttaaatgatactttatttttcaaaactctcacggataggtagtatggcccatttaataaataagaaagtgaggctcagcaaagttaagtcagtcttccaattttgcgtagttaggaggtgcatagcttagtcagcttttcctgagtaaagctcttgttttttatcttatgccaaagccaggctaaaaacatgctggacttcaagcaagcctcctgaaatccagtcgtccaacagtcaagtaagtgcttcaagggcatgttaacatgcacagctgcactctagaaattatttttcagcacggttattttttttaagaatttttttttttattttttttaccagaacaggtgactctctttccacaatcttggtgaatcagaaag

SEQ ID NO: 6411 - DNA, 770 bp, artificial
  synthetic oligonucleotide
aataaaaaatcatgcaagtgtttaataactttaataagaaatgattcagaggataagcatacgaataactagtaaacacatagaaaggttaattgcgtttgtatcctggaaaatgcaaagtttttcttattcgtgtttgtaaatatacaaatgattctcatgcaagaaatattagcggtaaatgacactcctgacttgtttggtgctagatactatgctaaacactttacctgaattatttcatgttattgtgaaacagcattttgagatacacatccttaaccccaagctacagatggggaatctgagaaacagtgaggttaggtaggatgtactgcttaaagtcatataggttacaaatagtaaatctgagccagaacctggatctagatcacacacttctgtggcctctcattagtgacagcaacagcaaatacattcagtaggtagtagactctgttctaaacacttaacatgaattaatgaatttaattctacaacaggcttattacgtagttgatatgtgactattatctccattttgcagatgagaaaatagaggcagagagcgcataaatagcagtcagtagaatcaaaatttcaatcctggaagactgactccaaagtccacagccataatccacactaaaatgcaaaaagctaaaacctgctgcttggggagattcagagtctaaaatagaaatttgtctttgacctttaaaaaaatattttttcaggcataggcacagacaagtatgttattctgcact

SEQ ID NO: 6412 - DNA, 2812 bp, artificial
  synthetic oligonucleotide
taggaagacgtccactccaacctttgagcctactgatatgaggagtgtaagaaagtaaacaactttcacttaagtggtaatggggaatcagggttctgaagggttatctaaaatcaagttagagcatatatgtaagataaacattatgaaaggagatttagaataaagtagatatggttcataatagacagtgagttccaaggtatacagtgaaagattctttgggtttagaacactgtggagatggggggatgagctgggagtcttggcctgttgtggtgcaagtttcaggatgtattataatcagtaagcatttatatgtatttgataacatttcataaaggcctttatttaaaaaaaattcaacttttatttagatatattgggtacatgtgcagatttgttacatgggtatattgtgtgatgctgaagtttgaggtatagatcctctcacccaggtagtgaggatagtaccgaatagttagtttttcaacccatcctgcctctctcccgcatctagtagtctgcagtgtctattgtttccatctttatgtctgtgtattgaatgtttagctcccaattacatgtgagaacatgtggtatttgattttctcttcctgcattcatctgcttatgattatggcctccagctgcatctatgtcaatgcaaagggaatgattttgttgttccttatggctgtgtagcattccatggtgtttatgtaccacggtttctttatccaatctaccattgatgggcacctaggttgattctatgtctttgctattgcgaatagtgctgtgatgaaaaaacaagtacatgtatcttttttgtagaatgatttattttctttgagttatatactcagtaatgggattgctggatcaaatgatagttttgttataagtactttgagaaatctccaaactactttcaatagtggatgaactaatttacattcccaccaatggtgtataagtgttctcttttctcagtaacttaacctgcatctgttgttttttgactttttaataacagccattctaactggtgtgagatattttgttgtggtttttatttgcatttctctgctgattagtgatgatgaacatttttttcatatgtttgttggccacttgtacatatcttttgagaagtgtttgttcatgtcttttgctcattatttaatggggttatttgtttcgtgcttattgatttgtttaatttccttgtagattttgtatattagacctattagtcctttgtctgatgcatagcttgagaatatattctcccattttgtaggttttctgtttactctattgatagttttgtttgctgtgcagaagctttttagtttcattaagtctcatttatcaatttttgtttttgttgcaattgctttgggggacttagccagaaattctttgccaaagctaatgttccagaagggtatttcctaggttttcttctaggagttttataatttgaaatagtacgtttaaatctttaattcaggttgagttaatttttgtatgtggtcaaagggaggggtccagtttaattcttctgcatatggctagccaggtatgtaaacactgttttaaaattagatattatgtcttaaaattgatgatgccttagaatcaaggaagtatagacattaccatcaataaaacaagtttgaaatgatttagatgagaggtcagaaaactatagcccaaagtctaaatgcagcctgatgcctgcttttataaataatattttattggaatctagccacatctcttaattggtattatctctgactgccttgcagtgatatgacagagttgattagtgtaatagagtttgtatggcctgcaaaggtgaaaatatttactatctgtccctttacagaaaaagtttatcaaattttgatccatcgaattttattggggaaatattgttttaatgtaaatttattttatgtacccctcccagggactctgatttagtcagcctggggtatatcctaggacactgtgcacttcacaattgccccaggtaattctcatgcagaataactaaggaacagacttaaaggtactttgctatagatcgggcttgctcaaattttcttgctgctaagaatattcttgggtgattgacaaatcagtgagttgtaggcctggcaagtgtactttggtaaatatccatgggtgatttttatcttcagaaaagtttaggaaactttggactggatactcagtttaaccgggagctatgcctgcaattcaaataatcagcactcgatgattgtataccctttctttaagcattgttaggcactgaactattttctaaggggagtaccagtcaatcatccactgtcagttcgagaagatagcccaggcagaggttgcagtgagttgagatcgtgcccttgtactccagcctgggtgacagagtgagactccatctcaggaaaaaaaaaaaaaaaaaaaaaaagaaagaaaaatttcccagatctgttagacgtaagtttcacaaggcacagcacaatgtgcagaaagacatcaacctacagcatattctgagaagttttataagaagggtaaagagaaaatcctaaagtctttcaagaaaggaaagaaaacagaaatagaaaccaaaatagcattgagcttcttaacaccaacaccagaagctaaaagtggaaaaaaatctaccaaaattctgagaggaaattatcgagccaaatcaaatatgaagagagaataaagacatgcaaagacttaaaaaaaaaaaaaaaagaaagatagcccttgc

SEQ ID NO: 6413 - DNA, 788 bp, artificial
  synthetic oligonucleotide
ggaacattcttcaatgtctggagacatttttggttgctataactggtgggaggtgagtgctactgacagtgggtgaaggccagagatgcttctgaatatcctgcaatgcacaggagagtctctgtgcaaagaattatcaggcttaaaacaatagtgctgacgatgaaaactctggtgtaggatgaagccttccttgtcttagtttaggttgggctattggggtaggacagattacctcagagcttataggacacacagaaatctgaatgggaatagctgggactattggaaagatgttaaaggccgggacagtcagaaagtgattggctgaagaagaactcagcagaatccatttcccttgtcttttccattattgctagggaaagagaggatgccaaaacgtgaaggaatagtcacctggtgcaatagtagccaatgagaaaatgttgctggtgagaaaatgattacaacatatcataacaattatttttttaaataagaagccacagatgtgtagccattatctagctatcttctctcctgttagcttcaagctctctaaacacttccctccgggaaagaggcaattaatggcacctgccttaaagtttatttttcttttacttctttctctctgagaaacaggatttttttaacttgtcccttttcccttccttctctactaaaatcaagttggtgctatctatgttatagtttcaatgttaagtgaatatgaaagtgtcttatcacttatacagtcttacatctgttgagatcaaggcatcagt

SEQ ID NO: 6414 - DNA, 891 bp, artificial
  synthetic oligonucleotide
aatttatgaaaaacacctagaacttgtgttggtcgtggtgttttccttgtccattccactgtcctttcagaatggtagtgtatcattctcactgtaaacttgattcaagagatgaaagtttttaggtggcttctctcctgagattaccataacaggacatgcattgagtattttaatacatttatcaatgattttagaaactaagttaactatctaaagttgtcccccaaaaatggaggaggtcaaagacagcatgccattttaactgggactgaaaatttgcaactgatgctcctctgatatgtcaaaaccattttagcatcttatgcagatcatagataacgtgatgagtaatatgatctaaaatagaaacatagggatcactacttggctgaaaaattaggttcaaggataacgtgtcccaacttgaaatgacaatttctttttttcctccaaggtaatatcttgagccagattttatacctgaatataactcaaaatgacagcaacatttttgaacctcttcatatattgtaaatgagttccgtatagtttgtatcggaggtagtataatctgcatgttgtacctaattacagtaaaaaaaagggctattttttcattcaagtgcaactaattgtcagtatgtggaattgtgctggcagtctgtttatacacattatagaggactcacctattcatctgtttcaatgttttttgttttttgggtttttttttagaaaacattccaacacacaatgtcttttaccatgtaatagttgataattagatatgaaatttatggcaataacatcaacaggaccagaaactcattaagagaaacaggtggtactggggaaaaaaacgtttagcttaatgtaaaaaggctgcct

SEQ ID NO: 6415 - DNA, 592 bp, artificial
  synthetic oligonucleotide
atgcttcttaatgcagtgtatgtcaagttcaaataagttttccacatgctagatttcatcaggttcgtgatttttaaattgaacagttttgtagcttattccaactagaggagccttccctcaaattccaaacccaagttggatgagtacatgagaataaacagtcaatgtagtgcatgacatatgtccccttagttttggactcctcttttcacctattcagttttgtgcgagttaggatatgcatgacgaaggatgccatgaatttttcatttagaaaccatgtccctgagacaagttggtttattgacatgtcatcaagatagttcatttaagatatatttaatgagccctgtattatattccaagcactgtgcttggtaatacagacatacagatgaataagactaggtaggtattacccttcaagtgtctcaaaatctagtgaagaagttaagcacacaatgcagtttatggggaaagagtaagcatatgtatgaagggcagacgtagcatagagaggttggagtaaaagttactgggggtgggggacaaagcatggcttgaaagtttatggtcttactgaaacata

SEQ ID NO: 6416 - DNA, 291 bp, artificial
  synthetic oligonucleotide
gcggagacagaggagaccaaagaagagtttgggacatagtctgcaccgtaaggggaaaatcaagagtgtgtgtggtcacccaaaccaaggaaagaaagattttcaaaaatgagagagtaatcaactttgtaatctatgggatgagaaatgggatttgaattttttggtcattggagaaaataccaagaacactctcagcactctcagacaaatgatgagctactcaggagtgggttgagatgtgaatagaaagtgataaagttgaacaggtgtttaaacttcaaagagttt

SEQ ID NO: 6417 - DNA, 798 bp, artificial
  synthetic oligonucleotide
ttatctagtcaaatatccctttacccacttcaaaccataaacaatcagctttagtatcccacgtgtcacaggtgatacaggaacataagcactaatctgcactatattaaaaaataaattctgaccactataatgggagaacgaatcttgatgtgctgctctcaagaaaatgtagacatgggtccatttgaaaggaaatagaaaagaaaaagatctataaaatcattgggattgagtgactgcaagaatttagtaaaaagatcaaagaagagataacagatgcatctgactaaataatgactaagaagctgctgtgcaaactgtctacaggaattaaaattctaataagatttggaaattatagaggcaatttgaatggtataatgaaaaataatgggattaaattgggaaaggtacattggtacctgaaatagaaaataagcccccaattttcaatggatgaactatatcagaatgggaagtaatattagggaggcagtaagatcctttaatgcccagcacgcgtccacatgatatagttcaaagctccagaaaacagaagcactgtacagtttgaaaggggacaaaatgacctgggacatgtttgatcttccttttctctaattccttctcttgagtaacccatttgtctaaagtgaccacagctatcttttcattttgtctttcattgcctaacctatctggaaaaagcagatatccctttctgactctgtgaacaaacaagcaaacaaaactcagaagagtcaaatacatcgtagaaatcagaaggtaatttaa

SEQ ID NO: 6418 - DNA, 4207 bp, artificial
  synthetic oligonucleotide
gtgaatgggaagctgggtgcaatttcaatatcgttatctccaaatattaattaaatacataaaatacccaggaacacacaacaaggaaatgatgcaaagaaagaagtgtcgcacagaaactcctttgtttattttacccacgaggaatcagctagtggtaaaaccgaacatgtctcaaggtagacaacccattagccatgacccaggaggatttgcattttaagtagtttggttcagaatacagccagcactgctgagatgctatttggctgccatatagacgtgcatttcccctattcaccatgagagcatgattggcattgcaaaaagaagtcataattcttaactatgacatcacctaaagcaactttcattgtaaaatcaaaatttcacttgatattttttgccttgttatgaatgtggttttcaacagctattttggttcagttgagtcatttcttgttactaaaccaccaccccacccacctcaaaacaaagaaacccaaaagcaaccaaactaaaaaccaaacgcagaaaaaaaaaaatccttataatccgaattcagtacaaaaacaagaaccaggaatctcaacacatctgaaaatgcataaggagctgccctcctcctggtgattgctactttaagtagcaagggggggaaaaggcactagtaagagccaggaagttcccaaatgcagctcttgtgaaacagaggaagccacaagcagctggaggggcaggcaagagagagaaagagtccagttggtccaccaaggagagaggaaaagaggtactgaaagggcaagagaccatggaaatgtggagaaaggaagaaaaagaactcggagaagggagctacaaagagggtaaagggagcactgaatgtatgcgaataaagcctcacactccggtggtaccactgaaacatgcacatttaaacatcaagggaaaaacgcaaaaaagaaaagaaaaagcccacaaagtaccagctgggtaccaagagccttctctgtggctgctgggagctgtccgtcttcctctcggtgccctgaaagacccttggctctcacgaccagccaggactgaacaaacctagcccgaccaaaaacaaatcctgcatccaccggagtgcagcgcctggcactccgcgactgggaggagagaagcggcctgaggggggcagaacactgatgggcttcagggcggtgggccgaggtggctccccgagagctccctcgggaaaccccgctggcccgcctaaggctcggatggaggtggaagaggttcgcggagagacccggccattgccgcccgggtgcgctacctcgggcgggcggcgaggaggctggaggggctgctggcgcgtaccgcaatgttttgccgcatccctgttcccggagccggccgctcagccccctccgcgtcaggggcccaagcagcagcctggcggtccgtgtagcggaggcggggtaccgcgcgggatgtcgcgggggccttcagtcccgccgctcacacatttctccgcgcgctcccgtcccacaaggggcagctgccggagtttcagtggacctctctagacccaggcgtgcggtgggtgaggaggaagagaggccagatcaggccgcctcgaagacgttggcactagggagtcactgacctgcttgccacgggcagagtgaccctgtggttttgtggctgcgagcggcggcccaggctcccccttgcctgttctccctccctggccagctacaaaaatcctgctctcaccatgccagaaatcagctcaacatttaggccccttgcaaagtcgcgctggcagcgctcgcctggctttgcagagcttttagagttacccaccggctcttcctctggtattcctagtcttgccgagcgctagcaatctccgaccaacccgcgggccactgccccgagcctcagatccacgtctgcggaaagtggctgcgagtggggtgcaaaaataaagcccaacccagcccagcggcccgacagccggagccacccgagacctgtacaacttgccccgccgccctggccgcttggggtatggtggggcgggggggggcgggcagcgatgccaaggacacccggatcctttccggtcctcagcggcatgagaccgcgtcgtaggcaggcaagtgggaggtggagggcaggattagccacctcggccactttggccactcaaccggccccaaaccaacaggacccaaactaaaaataataagctacctgccccctcggctcgcgtgcgcgcgcgcgagatctctctctctctctctgtctctcacacacacacacgcaggcacacgcgctactgagctgagcggggaagaggcagcacgcgtgtcggtgcagcttgtgcagcccccgctgaaaattcacccacctctagagcccagcgtctggtgcagggcccgcggcgccgtgacctgcgctgctgtttccacgatggtatctatgtgattccggacagagctcctccgcgcccgctcgcccgtcaaacccacggagcagccccagcaggcgagcaggcgggccggcgggcaggcgggcagcggcgcgcgcgcgcacccgagcagacaccgcgcgcgcacccagcgcctagcacacgggctgcacctttacatacacgcgctgaatccccgcccccgctctccaccacccccccccaccccgcacacaagcagtccttcctcccgacactcgaccactttgaccccctcacattcctgagctcctacccccgtcccccatccagacatgcccatttgattcctcttctacccacacacccagaaagacagcgcgctttcctcccggcatccgccccctctttttgcctaaaacattccctagggaggagcgacccctttcctcaggcgtggagaccccagtcctctaacaagggcgcactcgcctccatcccccccaccacatacacacacactcgagcccttttcttctcttccagtcccctaataacgaaggaacacacacacacacacacacacacacacacacacacacacacacacacacacggggcattcctttgagagagcaaccaagaagccaggaaaagccaaagaaacactggagagcctgggggaggggggccgagggagatcgatagggtcgtcgagtctacgcggaattgaataattacaggatggaggggaatgagtcaacaacaatgacattcaaatgcaacaatcatacttggattttgtatcacgggtacggtacctttggctaattgtcaccccgcagaacggagggctcctggaatacttctccgtagcggtcgatcctggaaggagccttcttgggaaccaatttcctaggatccagtagtattcgcactccccctacctgtctgcgcgtaaggggccaggggctttaaggcgaaagtgtgaggctttagcctaaagtgagactatttagccgggttagaaggagacgggttaattatccgcaccttagaactccgtgggcctttggtgcagaatgggttaagccggatgatcttggagctgggggtggggataggggataggggataggggttgaggaaagagaggcgtgggactgggagagatgccgcacttgagaccaaaagaaaaaaaaaaaaaaaaaaaaaaaaatctactttggctactgagcatgcccagttcccagctcaagccctataagggaggcattgtgtgcattccacttctccgggctttggtggtgaccgggaggggagtttgactggggaagggggtggtagttgggagacattagggaaagggggttggagaacaaggtttgaagctttgggactgctcaggagggactgtgaagagagaaagggaagggacccacggagtaccttcgggagacggggagaaggagaggaaatggactaagaaaagtcacttcagtcgcccctcattgtgtataccaaagaggctttagcagctgaatctgaaatatccagtggctgcaaatccaacgtgtggattgtctaggccccttcttctaccctttttgttagtgcttccacaagagataagaaatattctgaggaagggccaatgttcaaaccagtttcatgcaaattgataatttcgttaataagcttgttaagaaaataaataaacctgggggaggggagcagagaggagttggctatcatgtatgt

SEQ ID NO: 6419 - DNA, 307 bp, artificial
  synthetic oligonucleotide
tgcacagagtaaactttgaattagatgcccttcagtagaaagtattataaaacccaaatgaagcatatttcaaaaataaggaaaattgtctggctccttaactgagaggtccagagtctggaaatgcttcagtcacaatgtgatccacagcttcctcatgtcatcagtagtccaattcctctgtgattatctcagctttgctctcctacctgggccatattcttcctcagactggctttcctcctggtagaaaaccggctctagtaggtctggacctcacatccacatctcaaatgctgaactccac

SEQ ID NO: 6420 - DNA, 1652 bp, artificial
  synthetic oligonucleotide
aaggagaaatgactccctattttattaactttattcatcatcacttattccaaatgtgtttggaaagcagatttcatcctttagaaggctcacttacgggaatcaacagaaaaataaaaatacatattattcacatttcaaaacaagatatggtaagaattcaccacatggtttggaagtagtttctaccacagagtagtgtggtaatagagttctaaatagtgtagtaattgcaagatatcattattcactctcatgacaatttcagagcaacagcttggtaaaggccgcacttgcattactaatagttctaagactttgctcattttaaaagcattcaatcaggaaaaccttcctttccaccaatgatttccaatcataagcctctctcagcaggctgtaatgcatttctcattatgatgctctatcccacctggcgtgccgctcagctacccctcacgattttacttcagattagaaatacactacctctattgtacagactttcaaatatcagaaaagaaacctaatttgggtctacacagaatgccaaatcactacataataatgtatcaaaagactatgtgataccaaaatattaatttgaatcaaacttacttttaaaaaatagctgtcataatgtttgtacgagtctattcaaagtcttatttaattttttaaaaagatagaaactctgaactacatcacgagatgatttttggcaatcactgtctaacataagcaaaggtatctgaatatgtccatcgtggaatctggtttgctgcctatacacctctatacatagcagtttcaattagggaatctgccttattctttaaatggccccagatgacataatctaattctaagctccagttttcattagtgtgccatagtctcaagcattaatacctacctcatttaatcgcattcatgtatacttttctagtctgactttaataataccaactttaagattttcttttttgcagtattataaatatcatgcctgggagaagtatattctaggatttcagtcagcaagcttagaggaaaggttggctgatcaattagctattcctccagcaactcacagacatccaagttttggcttttgttttactgttcgtgtacctgaatcacccttcttttcctttttccctgaaaaacttgtttctttttttcacttaagccgcctctgtctttcccacagcaatggcctctgtaagttgttttattttatccttcactagaccaaaaattcttctaaggcagagacgtatcatttatttttttcttctatactttgcacattaggaagcggggagctgaggtgctacataaggatttgcttaaattagaagaatgtattgtgaatcataaagtaaatattcacacctcattagaatccgaagacctaatgcctttcactttccttccaagatatctacaactggcctttatcctccactttgccatgtatttaatagcattgagcatttctatgatgttttgtcacctgttttctaattctagtttccatgctccccaagtcatatttacataactgttcactccacctttcccttgggaattttatagacctgatggtttttgagtcatgtctgagttcaaagctcagttcccatcct

SEQ ID NO: 6421 - DNA, 959 bp, artificial
  synthetic oligonucleotide
tcatttttactttactgtataaaatgagcacagagctttattaatatagaatggttgatcctcagagatcatctggtgtcaacccattcattttttcatgatgagatgaagacctagacaaggtaagcaattggctcaacatcacctactcaataaatgataaggcacaatctgaattcagttctatcacctgttctgaattttttcttattaatacagcacacttaaagactatttccaagtctttttttaaccatagaaattaagctccactgttttaagatgaacatcaaacagttgaaaatgaaccactagttaagttcctcttataaaactcatattgaaaaaagatacccttactatagaatatatggggaaaacataatatatgagaaattttcacacaattagtcataggcttggaagtagcattgatagcactctttcctgcttattcatactttgcagttctaatggggacagtgtaaatgtagtacgtctgttttgcttgccttttaaaatttaaatgccgctttctccctaaactgctgagattgtcaaggtgtatggccctttgcttgcttcacggtcaaataaacttaagctttcacgcacataaaagcatgcattgcttcagcttccaaatcatttcagcagatttgggttgctttaaatcattagttttaatatttaatgcaatgcatcatgatatctttggttagtgaattcatgaagtccctatagccagacatcttaaaaacattcagttactatttttcaataatttattactttttcttccaaataaatcaatcattgatatttttattataaaatatttcaagcataaagacaaatacaaataacatagcacacaagtattcatcacttaaaaataaaaatgttaatatttagccatatttacctctggtttagaaattgtggtaaaattaatataa

SEQ ID NO: 6422 - DNA, 1934 bp, artificial
  synthetic oligonucleotide
tgacatctgtttgcatttcatctttctcccaattgtcacccattcctaccatttctctttcctttcctttttaagtgtgatcacagctatcttggaccttctaatgcacactgaatttaatatattagctacctgcttggccacacttattgcagtccctacagtcctggaaatgacttataatccaataatccagtcatttcaaatactggtataatcacgcaattgaagatacatctatgccttcacttcttcaagatcctctaagagatagatatgtactataacaaagcccgatttctatcccttttacatgttacctgtagtgtatttcttttacaaacatgtttccctttaacccccccaaataaaaatttgattgcagtaatgtcagaagtctccctggcctctgtattaggcatactcagtctttcctttgtgcctttacccacattatccctgccacttgggggatgacctcgtctcccacctattcactaattaaaaaatcacaggtcattttcagatcagctattttatcttttctataatgtggtcctgtcagctactatgagacaccaagatctctcctacaagggattcttattaaacttttaagacttaattgttctctacatctgtttatcttttcctttttgagatctgttataaatattttagtttagatctaattacatcatacctgcattattacaatagtatgctgactggcttccttgatactagtttctcttttataattttaccatgtatactgttaacagactagacttcatcaaaaataattactcattccaggttaaatttcaaagcccttcactgagcatccatgactgtttattacccaactatatcttccagtatttctctgtatgaagccagtgttcaagcccaagcaatatgctttttgctctatagatatttcaagcccaggtctactttatatattttcttatgtagttctttcagcctgcaatgtctttcttttctcttctctgtttggcagatatttttatgacttttagacctcccactcctcttgaatttaacacccctaattttgctcactgtatcacctagggttttagttgcaagcaaccaacatggttctagttacttaagaagaaaataaactgaattaaagaatattggatcattcacagaatcgtctcgaggtaggtaggatgggactaaaggttaagcctttaggaataatgcctaaggccaggctacaatgttagattgatttagaaagaaaagaaagaaaaaaagaaagaaagaaagaaagaaagaaagaaagaaagaaagaaagaaagaaagaaagaaagaaagaaagaaaggaaaagaaaagaaagaaaagaaagaaagaaagaaagaaagaaagaaagaaagaaagaaaagaaagaaagaaggaaagaaagaaagaaagaaaagaaagggaaggaaggaaggaaggaaggaaggaaggaaagaaggaaggggaaagaaagaaagaaagaaagaaagaaaagaaaagaaaaggagaaacagccacagttgcttttccgatgagcactagaggaaatcactgccattgcttccactgtcccctgcccaggcaaatgttgagccagaaactaaactttgcaattgtcagtcccccccaaatcagacagttatacctcaacatttttcaacaaaatggatttcacatgaaatcaccttcctccattttctcatctcaaaatcaaagtctcacacaagtatgtctaggtcacatgaataagatataactgcagggaagctgaaaatgttttcccggggttataccctggagaagcataaaagtcctcagatggagcaagggcactaaaacattctaaaggtccatgcaattgggcaactcaacattctctcctacctctccaccttct

SEQ ID NO: 6423 - DNA, 803 bp, artificial
  synthetic oligonucleotide
caagcaatacatactatttttcagatacttagcaaacgtgttaggtaattcaaattaatgttagaattcattctgggacaatagttcctaaaatatggtggttgaggctggagagcagttgtattttatttccccctggcatatacttgaaatttaaaatgacattttacaaacaatgacaacgttcccccagacattgtatttgttttattgctttttggcaaaatttagttttctgtaattgtcactgagtcaatgaatactgcaccctcttaagatgataagtttagtatctgtactgtgaaaaaccggggcgtgtaaagcaagacggaagaaaaggacatgtgaggcatgttgcgaatagaacggaagttgtacgactgtgctgcaaggccaggaattgtgctgtgtgctttttcatacgttttacctgctgatttccagagaaaatgtatgaatcaaaaattactcgtttctagatgataaaaacaaggccaaagtaatgtaagtgacttacctctcttcacattttcacaagcagtgtggtttttttctgtctctgactcagaatacagtttttttttttcctgtgacactatagttatcctccattctaaccaacacaggtctcatagttatcctccattctaacaaagacatacagtactttgtaccaaatatatgaaattcagcaatcaggtataatatgtgggaagggatcgcggtggttggtgatgcttgtagcacaaaatccatatttgaagtcagagcctagtcctggccctcagataattcaagaagat

SEQ ID NO: 6424 - DNA, 326 bp, artificial
  synthetic oligonucleotide
gtggggaaaaatgaaaagaattgagaaggggaaagatgattattttaaagaacagattcccttttgtttaaataattacaatagttgaacctcctgcctttccccatgccccaggcctatgtgaataattgacagatatattacttcacatcaatcatcacctaagatggcacttctagtatctttctgaaatttcatcatactttcccccatctcctcttctgctaggaattcaaggaaggaaatacctaactagtcaggcagcatgagaatttacagttcattttgaaaaggctcttacagtattagaaactttgtttagaaat

SEQ ID NO: 6425 - DNA, 442 bp, artificial
  synthetic oligonucleotide
ataactgaagtctctttcaaattattcaacattcgtaagcaatttaattgcttaagggcaatctctgataaagatgaccccaaaaaggatagcaatttttaattaggagttaaaaaagtaacattttggagaattgtggaaaaaaaactgaaggatttagagaatgagacttgtttagagagagaaaagggacagaatgaatatgtaattactaaaaagcacccctctctccttttctaatgataaaaaagagcaatatcatcaaaatctaatctcagggaaagcagtaacaagaggacatgacctatcatctcactataccaattactatctcttgcccctttgtttttactttaccacgaattacttcattactttgaaaggattttttaaaaatctggagtcattatgtaagtattttcaattgtggtctgaaaaactg

SEQ ID NO: 6426 - DNA, 2238 bp, artificial
  synthetic oligonucleotide
tgaactatactcagcctttttcctcccctactgtcacacccacatcatcaccagatcgaaggatcaaagccaactccaagtataactggtatttgcttctctagaaaattagttgtcaaaaaatttcactgaggggcctagatattcacaagatattaacagagattcccctgaaaaaaaaaaaaagctaacgctgttttgacagaattcaaaagattatgtaactgttggatgatacgcagtgctgtaacccgatatagctaatgtaatttacacttaattagcataaaggtttatttaaatattggaaatctgagtatgtcagtatgactttgaattgataatttttggtatatcaaaaataagattgaaaagtgacactgcagtaggggactaggtatcagaatgaattaagacaagattccctacattcttgaaggctttcttttttttttctttaacccagcgatgctgcaattaacaagccgtgggagaacagagctccattatgacaagttcagctgtgggaaagcaaccaacaaaacaccacttctgagaaaggggaagcgatgtcagggagtgtcatctgctgacgtttgttcccactgttactcccctcccactcacagaactaggagctttcctgtcctttgacctctgaactccaaaagaatggcaagcgccagtggaacaggagtttctgagagtccagtgtctatggcatgtatttgacagctctgatgaaaagtatgagctgtgaattagacttcccctagcagagatgtttgtggataaggaacctgcttaaaacggtgaggcagtcagagtgtcagaggattgggagactgagactgacatgtgggcaacagcagcagaaactggggacctgtagccgggaaaagagacgagttggaggctacaaaatagatatcttcacacaagaaaaggaatattgtctgtgaagggacaatttatcaaggtaacagcactggaagtttgtgcagaatctagccatccatccatccgtgcatccattcatccctccgtcatctatgcagcagttttatagctaactatggaaagacgagctttgcgatatgtgatttctagcaacagccagcaggtgggtaaaagttttaggcatgtaaaggaccccccaaatcacactgctttccttattattcaaaatgtcttcatagcttatatccagtgccttattttcctatgtaagtagtaaaacagaaataacaatgaacagacgaaatctgttaactattaatatcacagacttgaagactagggatcttttctagaaggtatgcctgccttgttcattactagaaagcacacattcaagtttccacttagccccattccatattctgcctctaccctaactcctgaaataaacctactgttgttctgttgcaaatagatcatatttgggtcaattgcaggttttgcagctgaaaccttaatgagtgaatacaattgtactagaagaagtaactcccaggagcccagattcatgcttgcccatactgcagaataataactaccaattatttgttatataccagaagatctatgtagtgcatctcagataaatctcacgacaatcctcaaattgagtgttatctcagtgttttttgttcatttgtttgttttcttttgagatggagtttcacgcttgttgcccaagctggagtgcaatggtgcgatctcggctcactgcaacctctgcctcccgggttcaagcgattctcctgcctcagcctcctgaggagctgggattacaggtgcacaccaccacgcctgcctaattttgtgtgcttttagtagaaacggggtttcaccatgttagccaggctggtctcgaactcctgacctcaggtgattcgcccgccttggcctcccaaagtgctgggattacaggcgtaagccactgtgtctggctgagtgttatctccattttaaagaaagaaaacagaggcttagacagttaactaacttgtccattcacatggttagtaatgtacaaagctgaccccaaaccaggccttctccatcacactacactttctggatccctcctacccctcctagattaattactatagcatttattcaagtcatttcaatagagctattatcagaggtatgggaaaagagttcaatgccgaatacattgaagaatctggtttaagaaaagttaaacaggtttctttatggaagcat

SEQ ID NO: 6427 - DNA, 2566 bp, artificial
  synthetic oligonucleotide
ggaaggacaagaaaaaggtggttgtcagtgctgtgagaacgagttgaaaggcatgggaaatatggaaacagacaaattccaatgcagatccactagctggagaggtaattttgcgtctaattttgcacctctctcctcgcctccccgtctgctctccaccatcacgcttttcgacagtaagaaggatttggggttttgcagactctagcgggcatgaaaaggatagggggtggcaacgacttgaattaatgacgttctcctacaggatggaggggaaaatgacttagtgtcatcaaatgaactccctactcctggcataaatttatcaaactgcaactttatctcgaatactctggaagagtagaggagaggccctagagaaagcaagtcttgaggggaaacgcaatgctcttggcaaaaaccgcacctccctcttgaactacactgactcttttcacagagcgccttcctttaatagaatcacaaccacctggactactaataagaggaagaagaaaggagaaaagggaagggaggatggcaaaaatcacgctctagaagatccaggcaacgtcgtcgtgaagaataaagggaatcaaaatgggcactggaacgctgctaagggcttgctttgttaacacacttgcacaactcaagttcagctctatcttatgttgaaagtccttgtttacgatcctcgtaggaggttcttaaatatctgcctgcgaactcccaaagactgggcgcttactagttaggggaggcagctgtcccggagggtgtccagctcggatggctgactgctctttcacttgtcgttaacttccacccagtagtcttagtctccccttggacatggtaccgaccgtgtgccattcttatttcacttgaccgagcccgagctgcagcccagggtggaagccgcaagggctgggcagagttccaggcaagagggaccgagaggcgtgagcagtgctccgcagcgcttgtcagagaaatggagcagcggctcctttgtgggctcttacatccccgtcctgggtgcacagcccggatatttgatctgtggggtgattgataagtgagggagaggggggacgcgatccctccctccctcctccctccctcctccctcctcactccctcctccctcctccctccctcctccctcctccctcccttcttcccctctcctccctcccgctttacttccctcctccctctcgcctccctccctccttcctgcaagaagcgttgcccgttggctagctgctcggtggggatctgcctgccctgggggcgccgcccgcgctccccgcggtgctctcgctcctgggctgcgccagtccgaggcggtgccggctcctttgcctccccgagtcgcagatgctgcgggcgcctccgggaaaagatctgggcggcgcgctcgctcggtaagttctgagcactcagggacgcggtggcgacgcggccagtgagccggctttcctcagtccgttgcctttcccggccacctctccttgcgaggggcaccagcgtggggaggctgggcgccatccgcggagggcagctcgctggcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttc

SEQ ID NO: 6428 - DNA, 2397 bp, artificial
  synthetic oligonucleotide
actttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtca

SEQ ID NO: 6429 - DNA, 1270 bp, artificial
  synthetic oligonucleotide
aaaagcctcaggagatcaggcttcaattagccactgtcacttcaattctgtttttctctaagattttgccttatttttaactcacttttcaaactagctttcgctgtttcagcatttgtaggacagaaggttgctgctgtaaggaggtgggtcacatgaccaattttggtccaataagctacggctaagagggttggaggggggaatagaccaaaggtgagccaataagattctcttcaagaccaactatgagttgctttaacgggatgcttgaaccaagaccgtgaaaacttgagaggagaacttgtcaatgcccatttaagcaggaagtctttctccttttcctttgcttgttcaacctgaatcttcatatttgcctctgtgtacacactacttcattcattgtcattctccatttgtctctgccattcccgtaggtcagttttgatggctccagggtacggcacgtggccagacatggctgactcacactttttgcacactcatgtgtcttttagtccagaccagtggcagaaactagctagtgtctcctaataccagttctaacatttagggaaagaatgagaatgggttgttgtgaggatcaaatgggttaatgtagtctaatgcccagcacatcgtaagcactctatacacattagctattcttcttcttcttcaagaccctatttgggtgttctctgtccaatctgcatgctattatccctactctcttggccccagccagaataaatcacttctttcccgcccttgctgctggagcttacgcatgcttcttttttcactgtgtatgttccctgtgatattacagttatttactggcatgcctgtttctcattctagacgctaagcatcttgtgggtaggagccatttccctctctctttgaactgattgttagggatgaggtcttgtgcaacagcacctgatgcatggtaagggctccagaaatgtttgccagactgaatggaaggcgtctttaggggcaaatttctcttactaatggaaacttggggataagctgattttctttggccctgctcccatgccttgttgacttccaaatagcaaactacaaggcagacttctgaattacaggttatctttaagcacttagttaatgtgggccaaaggtcccctgggtcgttttagtggctcaccggtgcaggaggagtttaatcaagagtaacttcctaggaagcaagtgcgaatacaactttagctccttctggctccaaaaggtgactctg

SEQ ID NO: 6430 - DNA, 1772 bp, artificial
  synthetic oligonucleotide
tccatgtgctgttttattcctagctttgaaaactacccactgtaatgcccttccgtgatggccagtttgcagttggcaaacaattggtgttaatcagtttatagttgaaaatgaagctatttactatattgactccctagctcgcccagatatctcagaagttctcaattatttctaggtttaaagaaaccgttctttctcctttgctctctaccaccatttccaccaatcttgttcaggctctcatgcctttctgacttatttcccgacttctccttcctctctgtcctctgcattctccttttattccacattacaggtttggctgcaaactgcttcgctggtctccttttgcttccacagcctgccccagtctctttagccatacttagctgcatacactctgccttcttaccattttatgtacaggtggcatcttctgccagaaattctctgactacccatccctctccttcatctgcaaaacagatgaaggacactgctcaactgttctctctcatctagtgtttttgatcctctccttcctccttctcctttctccttttccctcgaagctccacccacacaagcagggttagtcaatacttcctctctgctcccaccaaagttagcgcttattccagtataagcagttactatgctagtattataatttttctttttctatgtcaaaaatcactgcacctcccactgacagtgaacccaccatcaaaggtgcaaatcttatcttgttcctgtctggattccatgtgtcccggcacagtgatgaacacaacagcagcattctaaatctgtctatgtgattgactgaataaaaagtaaaatgtagcatgtttagctccaaggtgcagcgttgtcaagctgaatcctaataatgtgcgcaacggaccctgccccttgaaattctgcagagcacaggaatcactagaaaaatgaacaatgtacttcaccagatgcttccagaaagcattatcatgttattccctgtctgccacccctgttttagcagtaaaatatatgaaatgggagaaattacgatcacaagatgaaagaggaatcagtgcttttgatcttatcagattgatttcagccctctcctaaacctcaaactcttcccatcttccagagacctaagatcccctgttagcatggatgcgtatctacttattttatggcttcccctatgaagtatgaatcataacaaattcaattctgctactgagaaatccagttgttctctttctgtattattcaggtaagataccatctgaaactgagagaagcataaggaagcttacagctcattatctagtaccagttacatgtggagcaccatgctaggcccaagggatgtagaaatttacatgatattgtccatgactttagggagtctacagggtgatcggcagagaatgaaaaataaattaacgttgccaacacagggtgctaaatgctatggtgacttgaaacctgtgagtaaattgtagtccagaggagcagcatttaactcacactgggttgggcatttggggacgggggtgcggatgtcagaaaattgaggcacagagagggaaagcagtttgtccaaggtcccacagttgtggcagcaccaactctcttgatgcccattgtagattctttttggtaatctgcattattacaagaagctgcatattgtgatttcatagctcctttggagaacactgggaattgtaactagggaattatattcaaataagttaattacaact

SEQ ID NO: 6431 - DNA, 1205 bp, artificial
  synthetic oligonucleotide
tatttctatacagaactcttgtttgtctgaattacttaagacacctctaaaaatggactgcaaatctcaactccaaatgaaaaataaaaccagaaaaaatttttctattcaattctcatttctgtttgtgctgaataactggtatgtatataataaactataataaatttcctagggagaaaatggtccttaaagtcctatttttttagctcacaaaatgtcctttactttctctcagttccttcacactagaatcaaatgcaaaataaaaatcctgatgtcttcagtgattttgaaggcaaatagaatgttcattcctaaaaataattcacataaatgccaaagcataaaatcagtcctgaacatagtatttaaagatggccctatcccacttttgtaaatatgagaaagaagttatcaattttgctgtggagacttcttgaataactagttgggttgtataactgcttgaagattgttccctcaaagaaaaaaaggtgatatctagattcaggctcagtgtgcaggccagtctgaaacacaaattaaatcattagagaaattcttatctgagagtcagagaataatcttcaaactcccacatggagagcaaagtggacttaatggaaatttcactagcatttttattttcctaggtgaaattaacaatcataatcctgtctttaaagttactattatttgaatatgagacaacagcaattctttttaataattatgacatttaaaatagacataaagattaacatgtattaattttatttctttatttctattttcttacctttgagaatacagtactctccaaggtaatccttagcagaagactggggcattgttgaaaatgttattataaaagagatcattattgctaggctggtattgtaaattatctatggactatcacattttacctcaatcagggtttttcctaagacactttcttttacattttcttaggttttgaaaatggtaggccaaatcactgaaaatatggtattgttagacaccctgagagaaaaccaacgtcatgaaaccactacccatgcgtttgaaataacattttttatagttatgcctattataattgcagtatttggcaactgattagtccctttgacagcctaaagaataagtctaaaaaggccatgcaaatttgtgatcagtaagtcagtgatatttattca

SEQ ID NO: 6432 - DNA, 630 bp, artificial
  synthetic oligonucleotide
tagacttgcaacctgctatgctttgtttggatttcacctaaatataaaactgtggaattaacatatgctctcatttcttcataaatgtttgtttaccgttatatccaacatgaccaatatattttatttttaaattctttattatgaaacttaacagatatataaaagtatttggttagttcattaaattagtttgttagtttattaaactagtttaataaaatcccatgaactcttcttgcatcttcttgaccaattttatgtcatgtgtgccccctcactggcttagttaaagcaaatacatgtttaattcatccttaaattaaaaccttaatgttttctgtccatggtgtccaaagagagtagccaatttttaaaatatgattattgctatataggtagaattgtatcttatagcatcgtaattaaaatttgtttatgaaatgattttacactgtgacaaactaaatttagtacttcattgatctatttggttgatttgtttaaatgaaaaatgccaatatcagtgaccaagacattaattaggtatttttcttttggatataactgtatataaatataatttaaggtttttatatttttatttttattttagtttgtcagtttcaa

SEQ ID NO: 6433 - DNA, 670 bp, artificial
  synthetic oligonucleotide
tggtatagcattcttaaaatcaccaaactcagaatgtacaggttttcacaaatcatatcaaatactatgcatgttacctttacaagcataaaataggtggacatctggataactatacaaatttttggcactggctttgccagtcaatggaaatttagactttgaatttttcattaaaaaatctgtccctacaccattacctaacaaaattgaagtatctttccaaattaggaatatatatctaaatgtgaaactttacactgtattctacaagtgataatgcatatctcctgtcttcaataccatctgcctcttacactgagatttactgatgaagaaaacaggatcctactgggcatggtggcacgtgcctatagttccagctactcaggagtccgaggcaagaggattcattgagcccagaagattgagattgtagtgcattaaaatcgatcatgcctgtgaatagcctctgcactacagattgggcaatatagttggtaaaaaacaacaacaacaacccaggctcactgataattggtaatatatctgtcatctgggtttcgatgcaactgtttcccctgacttcctattatcaggaaaggaaaataatatgcctttgtcagtcttgaattaatccaggctaatgtcatcattctcataattttgc

SEQ ID NO: 6434 - DNA, 687 bp, artificial
  synthetic oligonucleotide
atacacaattataaacaataaaagcaaaaagagatgagaactggatgcaactttgaatgttcctgaaatgacacatctcaatccgcaaaagggtggaggcctaatggcctcaaggtgtatgaccacaaactgtttccaatttagagactgactatgcagacacaggagcaatccccaggaagtaagactaaaaaatgtatgtaatacctttaaaaaagaaaaaaaagttacctgagacatcaggagctgcgcagatgcaggaaagagactccgcaatagtccagacaagttactaaaacaaaaatttaaaaaccaattgtttaaaaaattgaaaaatacacaacagaaaccagaaaagctgtactatattatgtaaaataacccgttttcaaccaaaaattgctaaacatgcaaacaaaaaggaaagtgcaactcattcaggagaaaaaacagtcaacattaattaactgtacctagatacttaatttagcaataactttgaaacagccatcatgaatatgtttaagaactgaagaaaaacacgttgaaatatctagagggtaatgtgctaacaatgagttaacaattaggactcacaacagaggaaaagaaactataaaaaagaaactgtggggattctagattttaaaggtacaatagcttgctcaaaccaatgtgatgaagtgt

SEQ ID NO: 6435 - DNA, 1134 bp, artificial
  synthetic oligonucleotide
agcagcagtgtgctaagctaaggcaaatgactggaaaattggaaacaggtgcctatgtcaagtcatttcattgaaacaatcaactgggacaaaggttttcactacacacaaagcttctcagctcttagcatgccactggctgtcctgtttctgtggcacactttatttcagttttctttcagtttcaatcttctacttcaccactgagcctgacgttctaatgctggaactgttcctgctacttaatgtgtaaaataccaatacaacatttctgctctcccttgggcccttccatagcatgtagaagaaggaacactggttcgggagtcaccacagatttgttcttagtccaacttgtccctcttattctgtgattgtaattcttatatatctctgtttctataaaatagggagaataatggctgccacgtattccctcattttccctaaattttccttccacagccccttttataagtagagttgtagttgaacccaacatacaggtttaaaaaccacatcaattcttgacctaatgtaggtcaagcccatgtgcgtggatagcctcagacctgtctactggtggagcttggaaagtaacccctgtattcattcaaggttcagtgaaccagagataaattttaagcactggatgattcaatttttatgagcaggcttctatctcattttgcctgtcaagcaacctactgtgatgttggcactgtgagtctgcctggtatgccatggccctgtccatatcccctcccaaactaaccctctttgccatatttatctaagcatccttgctgataactcaggaccatattgactctggattcttcctatcacctagaacctctaccgctatggcctattaactagatagggttcccatgacaagcatcagtactaggtttagacactgacaatatcccaaggtagccatgactgggggcaacactatatgaattagttacatccactaccttgctagactatattccaattcatactgacttcctctccttccttgccactcagtgttgctgagattctaacataccttatcccccaaagcaaataatgacagcatttgctcttcctacgccacaagacttttatgaagcatcaaat

SEQ ID NO: 6436 - DNA, 2132 bp, artificial
  synthetic oligonucleotide
ataaaattgggacatactgcctatatgttttttatcttttaaacttgagatcatggccattttatataaagtaatacatgttctttggaaactttaaagaagaaagcaaggacttctcatacattctgtttacgtagtttcaatgctaatttagcctgcttttttgtcagcatagactcataaacatcttccttgtcattaacaaacactagaaatgataaatgtatctcccaaagaaaattagcttgaagataaagtgcaaatagtaggaaaataatgcagaagtgttagctcaactgtgtactacagacaactggagaaatgtgtttgtaatgttactaaggtaacttgcataccaattgtatgtgtacagaatgtatgcatagcgcaagataaagtgctaatctcaagacagttgggtgatgaataatatttattttcttctttacagcttgtcaagcaattgcataccttttgtagttagaaaggttattgtaaatttaggaattcttatggaaaaagagctggtagttgttttgttttttttttttaatagcaaatgagtagagaattatgtgtcagattcattaaagttggttttgaagatggcatgatggtagtggggaaagtgcttgggcattggagttggatctggatttcagtcctactttattctttggtggcaatgtgagcgtgggtcactgtcttagcccccctgagaattatttttcttacctatcaaatgtgataataggatccacctcatagagttgatgtgataattaaattggaagatatagtaggggacaattctggacacagtaggggactctgttcttcaccttattcaaaacaactccatttcagtagaacagaatcacagtaaattgctctttgggatttggaaataagtgtaatgtagaattggattatttgctattaaatattaaaagtagattctacctgtggttacctggaaagaagaggatctcagaaataaccagaaagactgctaaaagtaaatcagccttgtttttgttttgttgtttctagttagtaaaatgagataattctgttttagagatggtccactgcaacactgggaacgttggaacttttcagaaagcatttttgtgtaagattctgcaaggcagatctttagagaggtgtcataatcagttttgcatgtgttttgtttgagtcaaccaacgttatttgtgatctctatttttcacaaactctctttggtatgtgcactaatttatcttttcattaaaattggattcttcactcactaagaatgaattggtatgactattcagtcagctatagttaacacacagtacttaggataattaagatattatcttaataaaaacatccccaaatctcatttttcattttgttaactcacttagatctttattaaagtcaacattaattcatgaaaatgtaagtgttgcagtttaaaatcaaactgtgtgaagactccaagtagcttctctcacctcacctttccccttttcgttatagaagaacagaaataattgacagaaggacctagaccaagaatcctgatttaatggtgtcagatctgttctatgaccagtcaaagagtttctaggggtgaatgaggcagccacacacagcaagaatgtcaaagctatgctctgattacaagagccacaagaattttttgtgagaaggcttttcactgagttcttatctagcattggctcaaagcaaatttttgcttccatcttttcccccaactttgccttgagctttgcctttaaaggcgaaaaggaaaaaatggaagatgagatggtgagggcaagcacatggtggatgtggccaatgtaagggtacttaggtaccttgggtgagccctcagaatcagatgtagttcacatgtacatttccagaattagtaattcttaagtttgtaatgtcttgctttaccactcgtgtcatgatgcaaatgaaagcagtcattttccagtaatgtatatgattgtaaaataaataaggaaatgatcaagtacctattttttactggtacttgaaatcccaagttttaatagatgttactgaaaaatacttaaattggtttaaagctttttcattgtggt

SEQ ID NO: 6437 - DNA, 1540 bp, artificial
  synthetic oligonucleotide
attctttcacttaaaaacaagactcggggcagtggagaaaacatcccatgttaagctatgagaaactaaaaacccatccactcttccatacttatttgtcaaacagtggcaaagttagttaggatcttgagctcctggcacatcttctttctttcacctgctttcctcagaaatgcagctcacagcaaaaactatggttccctttcctccacatcttcgccaacatttgttatttcttgccgttttgatattagctatcctaatgtatgtgaggtggtgtcttattgtggttttgattttcatttttctgatgattagttatgttgagcatcttttcatgcaccgtacaatgtagccatttgtatatcttctttggaaaaatatctattcatgttctttgcccattttaatctcactactgaatctatttcccaaagaaatgaaatcaatatgttgaagaaatatctgtactccgtatgtttattgcggcactattcaaaatagcaaagacttggaactaacccaaatgtccaccaatgatagactggattaagaaaatgtggcacatatacaccgtggaatactatgcatccataaaaatggatgagttcatgtactttgtagggacatggataagctggaaaccatcattctcagcaaactatcgcaagaacaaaaaaccaaacaccgcatgttctcactcataggagggaattgaacaatgagaacacttggacacaggaaggggaacatcacacaccggggcctgttgtggggtgggggaaggggggagggaaagcgttaggagatatacctaatgtaaatgacgagttaatgggtgcagcacaccaacatggcacatgtatacatatgtaacaaacctgcaggttgtgcacatgtaccctagaacttaaagtataataacaaaaaaagaaatatttgtacttccacgttcattgcagcactattcacaatagccaagaaatggaaacaaggtgtccactgacagatgaacggataaagaaaatgtgacgcacacacacgcacacacacacacgcacaaacccaaaacggaatattattcaacctttaaaaagaaggaaatcctgccatttgtaagaatgtggaagaatctggaggacattatgttaagtgaaataagcctgacagaaagacaaatacaacatgatctcacttatatgtggaatcaaaaaagttgaaatcatggaaacagagtagaatggtggttaccaggcccaggggttggagaaatggggagatgttggtcaaagggtataaacatcagttctaagatgaataatttctacagacctgatgtacagcctagcaagtatagttaataatactgcattgtatactttaatttgctaagagaataaatcttaatagttctcaccacgaaaaatagtaactatgtgaggtgatgaatatgttaatcagcttgattgtgttaatcatttcacaacatgtatttatattaacagcacattttacatgttaagtatatacaatcttattt

SEQ ID NO: 6438 - DNA, 1282 bp, artificial
  synthetic oligonucleotide
ctaaatgttcctgttccaaagctgagggccttttctcctgggtgctcctgatgcaatgatttatagcagaagtgcggggtcatgcctttctggctccttacaggagggaggttttccgtgcaccttggcttctgatcgcactgtgtagtgaatttggaggtgtcaaggtggactcacacggtaatgtgagcctaagatgagaagttaattaggtcttttgatatctaatgaggtttcaaatcatttatcaccagtagagagcactataagattagaattaatagcaggacttgcatgaagaaaataatgtttgtatcatgaatgtattacaaaggcggagttaaaatgattgattttaagcaagcatgatctgcccttgtaatagtagatcatttccatcagttgaatctttacaaagcagtcactcaaaacttgcatttaaatgtaatagcaatattaaaagaagtaggcgttgcttgcttgttgaagttacattgaagaggttcaattctgaatcataacccaggcatatgtgccttctacttgaatatcttgcttccaaaccactgttgcagtgtttataacacagagttccttctttcttcctgactcctgtgttgcatatgggactccacacatacagaataggttcaaagatatcaagataccatggggcttcatgctgaccccctttatttttcttacttgggatttgtggctgttgggctttcttaaaccttttttttctggttgtagatataaaatcaagcttcatttcataagtagccttcagtgtattcatattatttagagacatgcagtaaatacaaatctgcccacagtctacagactgaaatattggcatttagttccatcctaattacagtattttactagtctaacactgacatgcatcacacaatgactttcatgctgtggaaagctttgaaatggatctgccttaaagatagctgcacttacacttcatatgtttttcatcatttttcttaccattttgccagttccccaaactagctgtatttaaacaaattcttcccccacagccattttgttctctgatttcaccctgccgtgaagtctcaatgcaaaatcggcaatagcatgattgatcatttagctgacagcatagtcatgaacacgaggtagaaacttcacatccagtaagaggagaagctggaatgcagaggtattaaaatacaaatatctcccatgaaaacagaggaaacatgagaggtttaatgtttgaataaatctcctctat

SEQ ID NO: 6439 - DNA, 1543 bp, artificial
  synthetic oligonucleotide
caactcctcactctcccattttggagctgagtttctttacactgcagtattcgttttgataaccgtgcagagacagatggcattttgtctgccttccagaacagaggaatagtttgcctagctatagctagtataatgagaagccgtgtaagttgaagatgaggtaaaaccagagcatctgtcagtcctcacgtgccagattggagatgctgcagacgaactaatatttcaacaaaaagttgaagcgagtatagatttgtgaccaaaatgattgcatttgataacaatgccatagcagatgtcctagagttcatgcttggtttttattactgctctgtgagtgtttttggaagcgagacctaccagcacagcttgtatggtgcatgttcattataaaattttattttacagaagacaatgagatggaaaatttgtagctaatttggtactttcctactttatcatgtttctttacttattatttgggaaaaggttctattcttgtttgatttacattggcgtgttctagcacaataaaagaatatcgtgttaatttgaggtagagaatgaaaacccaaatgaatgtccattatctaatattatgttttcagtatggaccataggaagatacgttttaacctatctggggtcctccttttcatctattttctcttattttttttttttgttatttgagggtaatttttaaaaagtcctttaggaatcctgattaggagagaaacaggaaatataagtatttcaaaacatgtaatacatgataaatatatacaaagtttatttgtcaatttaaaaattaattaatttttaaaaaagaaagaaaagaaacaggagaacaatggtttgcttgctaacatctttcttcaatagttagattagtagttagtatttcctcaagaaagtaattgctttagacttcgatggtttaagttctttatatattgtgaagaatgtgcttctaagtgtgcatgatgcttgtttggcctcagtgctatataaagcagcgttaatgtgactcaattaaagaaagtcatgggctcagaacccaaatcccaccacatgtgccttatatgaaggacaacttctctgggttttagtggaatgggaaatagctatataacctgattgccttaaaacatacccttattgggagaaggcaattattttcaaaggttgatgtatgttaataaaagattacatataatagtcaaaatgttatagcatcgagtttacacgcagaaagacagtccaattacatacgaaaatacatcctattacagaagctgttaggacgatttctctgccatgtcttgtaagcaaatcgtagttgaggacaagtgttcctgtctccctgcaactcaatggctcttgggaaacatatggttttacttctggaactcctctttttgcttcccttcaaggtcttaactcagattattccatttcctagcagtttgtggtgttggaggctttgggttacatggaaaccagtagcatggttttgggtttgcctgcatgggttgat

SEQ ID NO: 6440 - DNA, 2217 bp, artificial
  synthetic oligonucleotide
gacctagtcctgcagggtctatgactaacttccagaatccctttggttaaattaataaccaagacactcaatggtcttttggagcgcaataatatggaagactccatactgagacatcatttctgtggcagctctagtccatggcaacacagaaggctgaacacattcaaggtttgggggaaagcctttctaactcatgaataggagggggcctcacagcagatgcctctcttggcactaagaaaaaaagctgcttctcacactgtcacttgctgtcataaagcctagaaaattctgtgattggccttgaaaaagaaatgaaaccactatacaatggtgtgattgaaatttcaaaaagggtgccacactaattagtgcttatgattcggagacaaattgcttgaaatgatgctgatgtttttgaatgcaatagaaaaatgtatattctcaatcaagagtaggctctcgaaaaggttttttttttttaattgaattgaaaaaaataggagggttcataaaaagaggtagcagagcaagattctcccatgcacacttttagaattatggcagatcctgctactgcctatcttctgtgcattcagggagcttcaatgtcttcaaagtggtctctccataccaagaggaatgagatttgatgaagagggaagaatgatgcaaccaaatcattcactttcctgcaaaaatatttctactttggatagagacagagaacaccatccattttttaaaactagaatgctgggagcttcgtgagactcttttgttcaagcctccaggcctcttagcgcaactaggtggggcacacctggaatagaaagccctatggagggacttctgcctatctggctggctgcagcagatactcccacttactcctctcctcccctcttttttctcccctcatatcctcttccctttctgtctgtcaccctttgtctaccctgcctcaggctttgttctaggttctgcggaaccagagataagttagccttgttcttgtcctaagggagctcacagccagtgaggggacacagacagcagacatatgaataccaggccaaaaaaattcccgtttcagaggtgtgcataggagggagcaagtactggtagcttcgctcggtagtggtatggcagagtagatgggcaggggccagcaagtcttccctggggagaggagaacgatgagtcagatgctatgatttcctgcagaagagaggtacattttcaatgcaaagggctttgaccagtccacatgtttgtgggaaagtaggaggaagccacatgaagcctggacctttaggtgtttggatgtgccttttcaggatgatggggtacaaaggctgctgacttcctgatttccactggggatgcctggtttttcttttccatgtctggccctgtaattttgccatttagtcgcagcaaacatgctagggggtattgcttgtgggaaatttattaaatatttcaagctaaatgtggttagtggaggattatagaacacttactttgttactttggttaagggcaggggagaatctttttttttttttttaaggaaaaggctaccctgattatcagaaccctatgaaataaaataagggcacctgttttcttcctcggaggaaatactttttaaaaagcaagaccccttccagatttctaagggctcccgggttcttgaatgcttatgaaataaatgttattttcaggatagaatgtgcctgctaaaaatcacagaccaagaaggcatctctctggctactaaatacttgggctgtggtgtggtggacgtgacaggctagaatttcaggatgagagactctttccttctttcttttgtgctttgggatataacagtgctggggagcttggttattcatgcacccatcttatgacaagaagaccatgcatggtagtaacctacatttgagagcttaccccaagggtggcttagagtttagattgattaatatttgttcagatattatctaatggaatccttgattttgtagaatggggaaaattagagaaggacaagccctgtaatgtttctttatggaattgaggctgtccaataggtcttttatgtctagtttaagttcaccacacgtcgtcacttatatatacattattattttcctgtttagcgtataaaatctaaagaaatggtaatacagccatgagatattgcaa

SEQ ID NO: 6441 - DNA, 558 bp, artificial
  synthetic oligonucleotide
aacaaaaaacttgacgtagacatgttaatacaaagaacatgattataagcaggattttccaaatttctagtgaaaatctattttgcttgcttctgatgcatctataatatagcataatcagtacttttagtatgaattacaacttaaatacatgtcattttcaagtagatgcagaccatgtttgttaggggaggaataaatgatgacaaatggaattggaccatagcatttcctgaatccagactattgaaatctgctctaaagtgttaagaattaggtggtacaaatgtattccctcttgaaaagcttttgttgtataatttctatgtggggaaaaaaagaaggatagatgacagctaatatatttttgcaaatgaaaacagcatctagagtctgcctgaggagaaattgtctatgaagatcatatttctgaataaaaacaggatttcctttgtggtttaattcaatgagcaattatggtaaaacatcattaactcagatatactcattttcaatatgtgatcttttggacacggtggacagaaggttattttgtct

SEQ ID NO: 6442 - DNA, 1058 bp, artificial
  synthetic oligonucleotide
ttgggaactaacttatctgtgcttgaaaagtgcagcagaataccaattatgaagaattagctgctatccccccccaacaaaagggacacatattgtactgcattctcattctgttcttttcattgacacggggaaaggatactacaacagaaatgaaaagggaatgagagccaaattcatggcttgtgaatttcacatgctgagatctagaatgtctaggcatgcgaccagcctgaatcagcctcctcacccactcccttggtatatactctctgaggggcaatatagtatcatcatcaaagtgtgaccatcacagacaggctgtatgagtgaaaatcccaactccaccacatgctagctatgtgaccttgggaaaggcccttaacttctcggtgcctccgttattccacctgcaaaaatagtgccaaaagtagtacctacctcactggcactatgcttcctgtacagcctgtataactatgagccaaataaacctcttttcttcataaattaggcagcctcaggtattcctttatagcaacacaaatggactaacatgggaagggttggattacaggaactgtaggcaggttctagggtttcaataacagatgtgacttgtgccacactttgcaggtagtggactaggcagcagtgagcctcaaagacatctctcttgaacccaacatggctgagcagctatagatttgaaatggatgaggatgtccctaggttgaagatacagaggtagcctctcagcttctgtcagtcccagagcagcaagaaagaggagctggatggtttcccatacaccagagatggagtccaggactgagaaagccagaatggggagagggcccacagaggacagtgagagtcagaacagtgacaacttgtgtgggtgtgctatggtttgtatgtttttcacctccgaaactcatgttgaaatttaattgtcattgaaacagtattatgaggtaggaccattaagaggttattagtctttgatggctgcaccctcatgtatgggattaatgctgttatacaagggcaagttc

SEQ ID NO: 6443 - DNA, 3497 bp, artificial
  synthetic oligonucleotide
acagaacttaaacacttcatagaagcacacatgaggtgcttttatttgtaaaaatctcccctacttatgcaaagaatattgaatcttatttcctttctatgtttggaattctggctaagcttatttaaatctttactgacttacctttaagcagtatctgatttgaatgcttccattgcctaatgctaatattacatttttcttgatgcttttggtttcgccttacttcttagtcgggtatgtcatttttagaaatagatgatcatagtcaaaataatgcaacaaggggtaaatatacacagagaaatgttattttgcattttctatagatgataagactatcccaggtatgcatgcacaggactaagcaggcataattttcaccttttgaatatagtataataaagtcaatgcctgattatctgtatgtactgtattttttttgtgaattgtttgcattaattttaatgcctctatcagcttcccacaactccatgcaacattcctccaaatcaacttcccccattgactggaattatttacattttcatttgctgaaaatactgacttataaaacacaattaggaaagtaggcttaattaaaagacaaagtattctaagctaagatagagaacacatccaaagccaaacaaatgacttagggtttttggacttcttgagttatctgtactacaatgcccctctcttttatgggtcattgagagttggctgtaatttccatttggtgttaaatcatgaacatatgagtagatataagccaagaagcatgtacatcatccatatggagctgttacagaaaataccctgctgatgctgaaacagtgaaaataagaagccaatcttgctggaacagtaaaaataaatgtgaagatcgtgaagataaaagaccagagtatagaaaagttgaccttaattttcttatttttttctatgctactcattgttctatttttcaaataaaaattgctgttgaatacagagatttgcataaaattcatgaaaagttgcatgctagagggcaggacaagagagcttttcagcataagtgcacatatttgtatctctcagaataattagtcatagcgaaccaagcaaactacgtttttaccgtggtgaacattgcaaaccattattcagttatctgtgaaaacttcaaatgcccttttcaaacactttttaaaaatagaatagtgaatctgtgtatttgagaaaaatacagataagaatatgctatatactatccaagtaacttattaagtcttaaaagaatttttcttggagactaagcatcatattttgtaaaattatacagatttaaaatgcaataaggtcatgtttatcctgcagaaatttgaaaactgacattggttttaaactttggtcaaatttattcttgctttttgactgggtcattttagtagttcatttaaaaatcattctaagtaaagtacagtatttgttgtattattaaggagaataaagaggaaaatcgaacagtgaaatcttttttattttttctatcatggttttatttgactttacatggctacatggctgaaatatcaaggttgggttattttttgcattatctgtttatcttccttttatagataaatagcattaggattttgctgttggcaaatcacctcttgcttttgatcatgatacaagttaactctctagcttatgtccagctagaaaaaaaaaaggaaactagcataagaatggcaaatgccatggctcactcctgtaatcccagcactttgggaggccgatgcgggtgcatcacgaggtcaggagatcgagaccatcctggctaacacagtgaaaccctgtctctactaaaaatacaaaaaaattagcctggcgtggtggtgggcgcctatagtcccagctactcgggaggctgaggcaggagaatggtgtgaacccaggaggcagagcttgcagtgagccgagatcgcgccactgcactccagcctgggcgacagagcaagactccatctcaactacaacaacaacaacaacaaaaacaacaaaaaatggcaaatgccttatttattgacagaaacagtggaccaagacatttgaaatcagttaattcatctgaaatagtggtcccaggtggacccagatttgagacttcagttctatttagcacaacaggggtataaactagtcagaaatatattatttcagaaacctgaaccacaaagtggtccaggaaacagcctgcaaaggtggaaagagcaatggatgaagactcaggaaacctaaggtcaagtcctactactttcactaagaaacagggagactttggccaagtcatttcccctctctgagcctatgattctcatctgcaaagtaagaacaataatacgtcttctgttttcttgggaggataaaatcaaatcaaagttttgcaaacaataaaatgccagagctttgtacttcattctcagtattgagaaaaagttttgctattctcctataagaattaactattggttgtttatctttatgtcatgtgtaatatataatttgttgttgtttaataactgtataatgttcctattccactaggatgccagctggtatagtttacactgaagtcaaaacagataaatacagagatgaatcatatcagaaagaatagtggaagcattcgtaagtgttatatgttaatggttatgcccaaatcagtttccatacccagtatttccattaggaatttatgaaaagtggtttgatttctttgagcttctaaattctatttcgatgccttgttgttccctaatcctaattccctaattttgaaagcctataaaccatcaacagtctttacaattgattgactagaatatgcagagggcactgtgggtattctcaagtggtggcactcaaaaaggaaccaggtcattatctgtactcattttttttttcagtgacacaatgttgcagtgacattatcagtctcttaatcactcagtcagacaatgtcaccatctctaagcactaagcaagcaacagagcactatagttacgtaggctgtgccttgcttgcatactccctacacttccgctgagtaccccacaccatctttccaaatacacaagtagggctttgtaccccttccttaagccagagggtgtaagtacaacagaatggtcagaatgagaaaaactttgaactccatattttggttatagtaagtagtcttaaagtgtcaatgacaattattgtcatttagaaagcatttggactacaagtattcttggatgtctttcctagaactgctagtggcaccacttaactattttggaaccattggcatacacattgttggctggaaaattcaacagccatttccaactctcttctccctgcttcctacagatgttggaaggctaggtacttatagctaggtttggccagaatttgtttgagacttggggaaactattgtggtttcctga

SEQ ID NO: 6444 - DNA, 3253 bp, artificial
  synthetic oligonucleotide
ggtctctgtttcttcaggaaaaaaatgaagttaaaaggtatttggatgattttggtaatatgagataatactgtagaagcatattcaaatagaagggagaatgtcagagaagtatgagccagagggctgctgggtgttttatggagaaactgaggcccagataagtgacttgcttggagtcacacacagagctaccggcaccctgctctgtcagggctcagtctgctgtccttcccaagagagttctagccttaggatttgaaaaatgtgccaatactattccctctgtataacgacacgaagaaggcaaattacatgcctaggactccagaatgctcatgtcctgaaatgccagaaagcggtcccgccccttcccacagacctttctctgcacggaggccagggaacctttccctccagggaattggctaaagggatccactccttcctggatcagaggtggaggttgaagggagtaggaggctcggttaaaccctccacgtgcagaaagagaatttcaggccagaagggagacgggcagccggtgcgtgggatactgggcacacacccagtggttttcccatttctcagaggaggagctagcagaagtcttttgctcaaggcacctggtgaccgtgcgaggaaagtgacagtggaacccagtttaacagtatcctaaccccgaactcaaggaccacgcaagggcagtcatttgttcctatccttgctgcccactgaatccagggcctatagctcgctgacctactaggtgcgcgcctaaaggcatgcctggagggcctgggtgcgggcacgtggagccacggggctggtgaaggtgaccgccttctccttcctggacccgcgtgctacgcactacagacctgagggatgctcaggcccgcaaagtttgctccactactcgggggctcaaggagctgtgcttgaggtggcagggggcgaccttcaaccccacggctgtttgtgctgtcttttctagttcaaaactaattcccagtggtgggggtgggctgggcttcagagaggggtcccattcccgaagcccgcgtcctggtcccgccagcccacctcctgtatccctgccacggcccctgcgtcccgggtccgggtccgggtcctcagctctgtggccgctcccactagctgattttgacagtggggggtgggagagggttcccgaaaggcaggggcgggcgcggcgagcccctgccagatccggggatgataacgtgcctgctccatgtcgcggcttctagctgtccaggctccgccccctgtgagtgtgtaagtgtgtgatgctgccgcggccgccgccgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggatacca

SEQ ID NO: 6445 - DNA, 717 bp, artificial
  synthetic oligonucleotide
taattcaattaaaaattggcaaagcatctgaatagatatttattcaaagtagatacacaaatgctaataaatacatgaaaagacactgaatatcttagtcatcagggaaatgcaaatattaataaaaaccatgagacaccacttcacacccactagaatcactatgcccaagaagatacacagcaacaagtgttggcgaggatgtcgcgaaattaacaccctttgcttgtggaaatgtattaaataaaattatgcagacactgtggaaaacaatttgggaattccgcaaaaagctaaatatcgaattttcatgtgacccaacaattacgcttctaagtatacatggaataatatttaagacatatgtccacataaaaacttgtactggagtgttcatggcaacattacttgtcacagccaaaagtgggaatgactcaaatatccatcgactgatgaatggacaaactaaatgtggtctatctatacaaagaatattactcaaccacaaaaggaaggaagtactgatgtgtgtcacaatttgcactgcaatttggatgaacattgaaaacattatgctaagtgaaagaaaaaacagacataaaaggttacatattatatgattcaacttatataaaatacacataataggcaaattcatagagtggttgtcaggggctgctgggaggggagaatgtagagtgactgctaataggtaca

SEQ ID NO: 6446 - DNA, 967 bp, artificial
  synthetic oligonucleotide
attccagaagctttttcaatagtgttcttgattttttttcttacatagcacatgaaaagcatgaaattatatggcagcaagacatatttaaagaatcccgtatgatagtctacttagggcatctgtttgaaacattaacattaggaaacacaaacctattcattctctctcctcccacccccatctttttgttattttagacaaacaaaggtgatgcacttgccaaccgagtccagaacacgcttggaaactatgatgaaatgaagaatttgctaactaaccattctaatcagaatcacctagtgggaattccaaagaattctgtgccccagaatcccaacaacaaaaatgaaccaagcttttttccagaacaaaagaacagaataattccacctcaccaggataatacccatccttcagcaccaatgcctccaccttctgttgtgatactgaattcaactctaatacacagcaacagaaaatcaaaacctgagtggtcacgtgatagtcataaccctagcactgtactggcaagccaggccagtggtcagccaaacaagatgcagactttgacacaggaccagtctcaagccaaactggaagacttctttgtctacccagctgaacagccccagattggagaagttgaagagtcaaacccatctgcaaaggaagacagtaaccctaattctagtggagaagatgctttcaaagaaatctttcaatccaattcaccggaagaatctgaattcgccgtgcaagcgcctgggtctcccctagtggcttcctctttattagctcctagcagtggcctttcagttcaaaacttcccaccagggctttactgcaaaacaagcatggggcagcaaaagccaactgcatacgtcagacccatggatggccaggaccaggcaccggacatctcaccaacactgaaaccttcaattgaatttgagaacagctttgg

SEQ ID NO: 6447 - DNA, 1257 bp, artificial
  synthetic oligonucleotide
ttttcatttcctgccagcaagaagagaggggataaaactggtgcaatccataggccataggccccaagtggacagttttctgtagagctgaagcagacgatgggtgggtttatgtaacattaaacccaggtgggtacttacccactttgccttggtgcaacatgttttggacttggcacaaattagtgtgtttgtctttcattctacttggctactagccagcaaggatactctattttcattttgaaatttcacctggcagatccttaaaagtcaccagaggacttttcctgagtaataaaaagcaacttttattgaaaactaattattttttccgatgaatatgccagctgtttaaaaatgctgcagtcatgttaaagcacattttaatagtgtacttgcaaatgcagatccaggcgtgaaatgctttttgacagtaacttgtaagcaccttattccaatatacctctatgcctagttacatgcaggtctggaaatctgataaatgccaaaaaatatccactaggtgagtaaatcagttatttgaaaatgggcacatattataaagttcactatataactaacaggttccccctgcttaggaatgaagactgacagaagaaatgcataccattattcatcgagcaattttaagcttttagaagggagtaggattgaattacttgggaaggttgcggttattctgggtatacttgggtttgtgtgtcactctgcatctttgcctgtgtctacacacgtagttgtgtattccctgtgttctgggctccacactaaccactgagatatgtatgaaacactaaaatgaattaaacattgtctttgcctgccaggaatttacagcttcatggggtgaatcagaagagagacaagaacagaaatgtaaacaagacagaattatgcacgtgtgaaatagaggcttaagggatatcttggacttacacaaagcctggtgtacattctgacttaagggaccaaagaagagcgtgataatagaggtcccatttgagctaggtcttcaaggatgaaaatggcaatgattagtggaatgtagagaaaggacatttttcattcattgaaggaataataacaaagacaccaaagaataaaggggcatggtcgggaagggagaagagcaaaggagatgaggctggatggagcagatgacagaaagtctcaatgtgacactacagacgttattttcttttctgtttagatttgtgagagggagaatggatt

SEQ ID NO: 6448 - DNA, 2851 bp, artificial
  synthetic oligonucleotide
ttctgatgaagtggttgaccacaaatgtaatctgcttaaccccagaaggtattttaattcctgttttaaatccattttattctaaattcttccttctttgaaattgctaaatttcctaaatccctcttaataacaaaaccaaacatcctgaccttattaccacctgcctgtttgtcatcatcacaggtcctgccagttcttggtgaaatgcctaagtttgtttccatttctttctatgtcagcatttaatagactctgtgttcatttgtaactcaggattgtcattcctcttgctattgatctagttgtaagccctgccattccacatacaggagtcagtgttgagtaaggctgcctgtcctcagctatcttatcactagtggccatgtacagacttcctcttgacgtcaaaggcaagttgggtacaatatcaaatgagttcccctaacatgaggaaattgtgttcctcttttcttctcccatttgcacttggcctccttcaatttaacattgatgagaagggagactattagctagaaggtaagattttcaggcagactaaagatctagtatttcctatgctgtcattcaaaataacaggcataagaacttctgtttaaaatagctgggctttttgactagagggcttttgtgtagaagatttaagatgtcagctttaaatatgacattgatagtctttggcaaagaatgggagtgaatttttgtagaaactgcctttttttctgattgtttattaatggtctttgtgatttatagtaaatgctggggaggatttccaggcccatttatcatgagaagggaacaccttcttgttcttaatgtgagtgtgtcataattagcaatgcatgtgggccaggagatttaactctgccttttctgaaagtccttcaacctcatatttaatcccaaactgactgaatattttttcttctttaaggaaattaattatgccactggaaaaatcatcaactagagagggagttgataacaggcacaatgtaggctgggttggctaatgtatcaaaatgacatgattagagtaactcacatcttagacaaattggaataatggagtcatcattctaattaaaaacaggaaggtctgtttgtatgtagcattcattttcagtaagaaccacaccatttgtttttcatgttcatgcatgtttgtacactctgcgacccatcaatggttgttgctctaaataccaattacattaaaaatatccatccagatactttgcattttgtcaatgaaactgaagctgaagaaggagttgggcactgtgtcatatggccagcatccatagaggcagttgaagggttacaacaaatccatcatcatgcaacctatttgcctgattattttcatcaaattaacttatgcttcatgatgtttttgtgttccataggctggcctaagtactggcttctgttgatacacatttcacagttaagtattgttctttaccaggtgactctgtttgtgcttcatttctatatattataaagccatctgaagtattttcttataacaagaaaattatatacaatttatcatgccggtcaccctgggatatgcaaaatgactttacattctggtccctgccatcaaggaatgtacaatttagtggtgcaggttagcacaacgaaataaaatcatctgagattaatgaagtgataaactgtgatgcaaaacagggagatatctgtaagaattaaaaagtcattagcgatgacttcatattatttgaatttgagcttgaaagataaagatttaaccaagcagaagagaggggaaacgtgccactgtagatagagcaaacaggataagcaaaggcatggaggcaatgtgggagcagagaggagacaaaagtcgcatttctgttgggaataacaatcagaaataaaactgacactaaggtagggtgttgatagagatctaactctgaaaaccttatagcaaagagtgtatatatctgccagaaagtcattgtgaattctgaaatagagagatctcatgatacaacatattgtcacagagggtgagtataaaagagcaaagcttttagttcaccagggaatgaggtcaaggcaagtaagaaaagaacattggatttgcggccaggcacggtagctcacgcctgtagttccagtactttgggaggccaaggtgggtgaatcacgaggtcaggagttcgagaccagccttgccaacatggtgaaaccccatctctactaaaaatacaaaaaattagccgggcatggtggcacacacttgtggtcccagctactcaggaggctgaggcaggagaattgcttgaacccaggaggcggacgttgcagtgagtcgtgatcgcgccactgcactccagcccaggcgatagtgtgagactccatctcagaaaaaaaaaaaaaaaatagaaaagaaaagaacattggattggcaatgatgagtcaggaagagaagggttgttgcgggcagttaagaagcagttttagtagccaaaagagtttcaaagcctaattactaggcctgaagaagtttccagtggtgaggaagtggaaccaataagtgttgactttgaccacatctttaagacattttcatggtggaagacagtcagtgactttttcctgattaggaatgtatgggctagtctgggtgaccacccagcagggctgtctgtacatcatccacttctcttggcaatatgttgtgttgctgccttgtgagggttagatacagcaattttgcaagttacagtttttgccattcacttagatttctgatgatcgtgtttacaatacaattatgaagtaagattca

SEQ ID NO: 6449 - DNA, 1733 bp, artificial
  synthetic oligonucleotide
tcctcatcaatcttcctgctaccatttacttttcaaagctctcacttagctgctgcaggtaatctgtttaaattttataactgtattcactaagaaagacaaggtagagtatggttactccatcttaactcttgaagccaggactttctcagcctcaattttgtcacctgagaactgaaaccatcagtggttacacagcataattgcattaagaacgtgatcttactattccaggaaattcttatctgagaagatgaaattgtatataatttttggttgtttcagggacttcctaaaaattcaaatatttgaacaaaagaacactcatctaattctcatcagggcaatgggccccttctcaaattgccaagtcattccgtgcactttttttgttattgctacacttcaaggcttgcttcaaaactcttacctcactgtgttcatcagttccaaatgattgaaatatcacaaattattccaatcctaatcatgctccagcattaaattatctattctaaatcagacccccagagtcttatgcatatcttactattgactaccccttctagacattactaagacaggcaaatactgatatctcttattgcagtatgagataaatggacttagcctgatcaatcaaaacattattatggtgtgtgtatcataatacatataatatataatatatatgtgtatatatatatatatatatatatattctctttttctggagaaccctaactgggacgcataccattatatatacatatgtgtatgtgtgtgtgtgtgtgtgtgtgtgtgtgtgtgtgtgtatatatgtatgtgtatgtatatatatatatttgtgtgtgtaccagttatatgtatgtgtgtttgtgtatgtgtgtgtgtgtgtgtgtgtgtgtgtgtgtataaaacaaggaattgacctgcctgattatggaggctaagtgccataatctgctgtctaaaatttggagaccaagggaagttgatggtgtaatgtcagtccaaacttgaaggcttaagaactggaagactaacggtgtaagtcctggcctgagtccaaaggcctaagaaccggctctgatgtctgaggataggagaagacagatgtctccactcaagcagataggaaattctcccttcatctacctttttcctctattcgatggattggatgatgcccacccacattggtgagggtggatcttctttaccaattgatcgaccagttcagtctaccaattcaaatgctaatctcttcctgaaacaccctcacagacacacccagaaataatgttttgccagctatctgggcattccttagcctacccaatttgacacatacaattaaccatcacagatgtttgtgtgtgtgtgtttgtgtgtgtgtttgtagaagtcagcaattgacagacctatccaaaaatattcttgtgggaccaatttagcaattgaaaacacttaccagttcctctactttcacaaaaatagtttagacaaatcactaaagatcttaacaagagtttatatatcacaaatgagagacatgaaaattacccagtttatttacacctgccaacctttatggactagaaagttccctggatctcaccatcccagcattgtcaataagaagttttccatttgttttgccttgttacacatgatacccagaagacaattttatttttctacgtccacttctatgttcaacaactttccta

SEQ ID NO: 6450 - DNA, 156 bp, artificial
  synthetic oligonucleotide
aatttctgttgggtacctactttgtatgtgtgtgtgtttaaaaaaaatttaatctcacttaatctttataatgaccctgtgaggtaaagaccattattatccccattttattctcagtacttcataaaggtggcagaatgtcaaggaattattaaa

SEQ ID NO: 6451 - DNA, 461 bp, artificial
  synthetic oligonucleotide
atcctctgtagttgtagttctctagttttcagggtgtcgagatacaggtagaagtggggaaaaaactcttaaaggctggccaatccacatgcagttgatatctagtacccatcatctcagccagccctgagttcacacctagtgggtactagtctactgtttaaatgtctcccggtggcaaagcagggaaaagaatggtgttctcagggtagtaagtagagaaaatgggcacattaaaaaattgttttcctaccttaactcctgtccattgttcttggccctcttcttttctaggctgccttttccctaatttaccctactcagattcctgacctatccacaggctcttctgtttttccagtggtttcctcatcattttttagctatttggtagaaatatccatctctggattatgtgacatggccagggtttggttctagagagaggactagttgtaatt

SEQ ID NO: 6452 - DNA, 1798 bp, artificial
  synthetic oligonucleotide
cctgggagagcagaacttcctgtgtgatgaacccttttccctctccagggacagccaggccccaaagcctgagagtgcacagggcatgcacgagaagcacctggggctttggattgagggcaaagattccatgggaggctcctctctctccctgtctctggtcccagcttccttgtgcttcctcactgttcagtgcaaaccttaattgaaatcaagttctcttctttttatcaagtgatggagcaacctggcttttcagccactcatttgatttgtactgtaaatgtttgttttaatgagacctgatgtgaagttggaattgataaggatgtaagctgacatttgatttataagggcagggagcaggacacacttgaaaaataactaattgaggctaccagggactgctggcttggtgtcttggcctagctgctgcgaggcagaggtcagactagctcacgtgtagtccaaagccactgaacaaggggctatttcttgacaagtgcctgacacattgcacttccacgaggcttccccccttccagctgtggaacaaggagtctatttgcacaggaattcagcaagctgtgggccatttccactgtctcgtgtctcctcacagaaggtctgtagcatgggcaaatggggatttctctcaacaggacaaagcatttctttgccatccttgactgtaatcaatcaaagggaaacaggaaactattgtaaagtgacaaatatcaatttatggatgtggtattggttttggagatcagactctcccacttcctgacttggggttgttctgcacgtgggttggtttgcacttcagtggcacctgttgatagctcaaagtgtgtcttgcccatctctgattttgcaaacatcacctctgatgtgtggacactgagctggccgggccagaaacccgatatgatgccaaatccttttcactttttgagagtcagtgaaatcactttcccaaaatgtaactgttacctctcttgtccccatgtcgcttcacataacaacttagtatctttcattgacctagacaaatggcctcaggcatcttaggagctctctcttgccctgggctgggtggggaagtgaattcaggtggtggcttatgaactttcctgacttttaaccccaagtcggaccccaaccctccccttgggttgtctatgagtggccaggagaggtaacaaggctcaggtgtgctctttgctgtgtgattctcaggaaggtagaggcagagaatcagggtgaaaccaaaaccagccccacctggggcaggaagcaggggcccaccacatatgcgtgggcaccagggccaaccaggagaaccaaatatgcgcctttaacacagaggggaaaaccaagagggcaactcagtgtcattcagtgccagtgggaattggaaggaggagaaggtgacataaacagagtgccccagctgatttaggtgttaaatgtggcaaacagagacatggtcactgagattttcttttgcttttttcttctacttaaaatgccaaagagattataaaaatgtgaaaaacaggcaaacatagtcaagaactagtgtgctttattttgtctaagaaatgtatgttctcttttaggtattcatccccagggtccaccaaggtttgttacattacattggtggagattgtggaactgatttgcacgggaccttcatggctgggagacagagtgatgccacctctggagccacccatatttctgggtgtcccagtggcatgttcttttgggaggacaggtttaggggatg

SEQ ID NO: 6453 - DNA, 935 bp, artificial
  synthetic oligonucleotide
cttcagcttctggtatgtacttccatatttctacatagcatgtctatactgaagtttttcattttaccattttagaaaattatttgcctccctaccctggaagataaagatttaactgtcttggaccacctctatatagtctactctttccctaccccaaactcccagtataaccatatcaccatttttacttaaatcacgatacagtgtttctgttattataattatgtaaatatagttcacagcagagccaggtagtacactataattatgtttaatttatcctttatcatacaaactttttctcactagagttaatcattgcctcatattttttttccctttttttggtaacgcatatcactattcatccccaaacaatatcttcttgatatggttaaacacatcacataattacagcagtcatcctgggaactctttttccatttctcctgtttctcatactgtgtatttctctttcttggttttcttcctcaaattgatggagatcatattaatttatcttcctgagaagaagcacatctgaggcaaaatttcagaggccttatttattaaacccacatacctgaatgaaaaattggctgagtatagaatcctaaagtggaaataatttttcccgaagatggcaaaggagttgcgccactgttgcctagcttctagtgtggctgttgagaagcctgaagatattctgattcaagatcattgaaattttacctctgtttctccctttggaagcttttaggatcttctctttattgccaatgttttgaaatctcatgatgatgttcctttgtgtcaaattttgttattgtttggattcacagtgcttggcactcagtggaccctgtcaagttggaggctcctctactttaatttcaggaagtgttcttgtgtgatttcagcaataattttca

SEQ ID NO: 6454 - DNA, 530 bp, artificial
  synthetic oligonucleotide
acagggcccttgctcagatgggccccatgcttggtttgatgctttgctgtcaccatcttgaaatgcttaataatttttgaacaacagactgcattttcattttgctgtgagccccacaagttatggtagtcagtcttggctgggccctatacccagaatctctgcttcaataatctggaggcagggcctgagaatttgaatttctaagatgctctaggtgatactaatactactggtttgtgaaccgtactttgagaaccatggtataagaataataaaaaagattgcactgactaaacagctcccaggtgcatttaagaatgtatttatagaccattaagtactttggagtagagaaaatgtattgaagatcaatcagaaatgaaaatatggtggctcccaaatgagaatgcaagtcaatgagaaatcccaaagtgtggttcagtgataataggtccctcagaggatggcaacctggcactggtcttgacacacccactttgggcttccatctctggtcagctcctttc

SEQ ID NO: 6455 - DNA, 4209 bp, artificial
  synthetic oligonucleotide
agggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctggaggttattgataagtgctgctcaaacatttgttttctgcgtctttggagtagaagatgaagcgttaacacccccaacgcgcatacacacatcccaaatgcgcgcatacacacatcccaactgcat

SEQ ID NO: 6456 - DNA, 8250 bp, artificial
  synthetic oligonucleotide
gtgattatctgcattttatagtgaggtggctgagacacagagacgctaagtaacttgcccaaggtcacatatctgactagtagtaaagctgggttctgggcttgtttttactttcaagaattgagtcaaatgtagtcccacttcattaagctgctgggatgggaggagcaggaggggcagggcctggatgggtgaagcagccaagaggctcctatgtaacttcctatgaagaggtagttgtctccaaacatgtggaaacaaattgagaatgttctgcttgtattcaagctgaaagacattttcattcttattgggtttgcatcaaattctcattttgctagtcttatacattagagtatcaaccaatggtcccatgtagctttaacaaatgatctaataaattgagagaagcattggccagagaaagttggagtgcttggaacaggccttggctggctgtccagctccacctgggggagacgggaggtgtgagctggcactaagaggccctctgcctgtctaacttggaccagggttgcttggggctaaaagagagcccaaaatgttcatagcagcattattcacaatagtcaaaagtggaaagaactcaagcatccaccaatgaatgagtaaatgaaatgtggtgtatctatacaatggaatattattcagccataaaaaggaatgaagtgttgacctatgctactacattgatgaacctgaaaacattatgctaagggaaaaaagccagatgcaaaggccacatattgtgagattctgttttggtgaaatgtccagaataggcaagtccatagaaagtgaaagcagatttatggtttctaggagctggaaggtggcggggagtctggagtgactactaattggtatgagggttctttttggggtgttgaaaatgttctgaaattagatagtgatgatgattgcacaactttgtgtatatacaaaaaactactgaattctacactttaaagggtgaatattatggtatatgaggtatatgaattacatctcaataaaaacaggcaaacaaacaaaaaccagaacaacagcaacaaaaaagagaacacaaagtccacactattaagacccagagcaaaacaccgtcttggccggacgcggtggctcacacctgtaatcccagcactttgaggggcggagacgggcggatcacaagatcaggagatcgagaccatcctggctaacattgtgaaaccccgcctctactaaaaatacaaaaaattagctgggcgtgttggcaggtgcctgtagtcccagagctactcgggaggctgaggcaggagaatggcgtgaacccaggaggcagagcttgcagtgagccgagatcgcgccactgcactccagcctgggcgacagagcaagactccatctcaaaaaaacaaaaacaaaaacaacaacaaaaaaacaaaaacaagcgaacaaacaaaacaaacaaacaaacaaaaaccactgtctgatgaagctgggttgtgggagaaagaccttgagctgagagggaatccagcctggatttaagccttggcatgaccttggacaagttctttcacctctctggggcctcagttttcttatctatttaatgacattgtgagaaaacattttcccaatgaacttttgaaaactataatatgcttatttaaaactgtactcactagttacaagcaaggcattattatagtgctggagggttaaacagagagcttagaacgtttgataaaaggtaaccttccatcattgccgatgtaaatcagggaactgaagatgcaggcagtaccctcatgtgctcagaaggattacccattcctgagcagaaactgctcacttgccctctcattcctctgggaatattccaggtttcctctatttggattggatatcttaatagctttaaaatctcaaataaagggtttatgtccactccagttatttagggcttcctaacaagccttttagaaagagacttaattaaaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgc

SEQ ID NO: 6457 - DNA, 2700 bp, artificial
  synthetic oligonucleotide
aagacaaaatatgaaaagtgccataataggaagtttgcaaaactctaggagcacagaaaatggaggctgattccaacaaggaggatctgtgaaggcatcgtgaaggaggcagcattggacctcaagagatgaaaggaattttgacaacaaagggaaagcactagaggaatagggagtactatgagcaaagacttagaggtagacaatggaggcacagtaatgccaagttggaaccaggctgcctggatttgaattccagcttggccacctggtagctatgtttttaagcaagttgcttagcctctatgtgccactgtacctaatctttaaaattaggatactaatagtagctcccttatggggttgttacgaagatcacataagttaatctaggtaaagcatccagaacagtgcctgagactcaggaagcattatccattatttctttgtcatgaatgcagtagtcaaaacccatttatagttttgctcttatcacattctgaggtaataagtgccttgcttttaattgtctgcagcttaatgaggcagacaatgaaaatcggaccactgtttctcctaattaaagtgttggaagaacataagtcatccccagtttactgatgaacaggctgtgcaccaaaagcttatttgtacatcctacttttggaactctgaggacatttttccatagaaacattgcactcagttatgtatgactgcactagtcctccaaaggtaggtaaggcacaatggaggaaaataccaggtctgagggcaccaaagggagttctagagtcttcaagcagaaatttccttttatggagtggtaggcaaaggagagatttacccaaagttggtaatggaaaaagtcacttcaattcaactaccatttcctaaacaaaccactgtgcctggcactgtgcttggtgctacagggggattttggagatgaattttgtgttttttctttcagtgttacaattgactgggtcttttccctcctccctatttcctgatcttcagtctcctcaggctatactaatgctttcactccagcatttttttaggtgtgttccctaacccacttcagtaacaaagaaaacaaaatggttgttgggggtgaagggtcagtttataaggcaactaagtgttagaaggaaagcaattgaattgaaaacattcaccttgaagttggagctacaaagtaggcaggtcaatccagtcctccatccacccactggatactcctcttacttttttattctgccaaacctgtgtgctccgagaaagcatcaagttatttgcacaagaatttccccccagttaaatgacacttcagctagggaacaggggcaaagatggagtgggaagatgctgagatgataatcacttttaagttaaggactggatttggcctgactcatctatcatcttcatttgttttcttgcaacttgtgtgtgtgtgtgtgtgtatacttgttagactgagggagggagatggtctgaagttcacatatagagagccttcttggcaacaagaaccatcccctaccttgatcacattgaccaaacatctggctgataggcctagcagctgacatcatttaagatctggaaaggtggaattggtgacaagcgcatagccctaggtctgtgatgtattggccccactccccacaagcctcaggtttgtgatgtattgccccctgctccccacaatgtgctcagtgagggaaaaaagtcttctcccagaggtgatgaaaagtttgacatggccaaggaagtttccttttaaatgaattttccataacaaaggtgttgaaattaaaagccagcctctagggtttctgatttcaaaataagcaagtctctggttattgtcatatatcaactccatgtcatagagaaatacacaaatatttttctgcaaaagctaatgcagacaggcagcaagttcccttttagctaaacttatttaaaaactctcaagagaacaaatctgaattgatcatggaacttgatcaatgatgactaagtgtggctccacattgatttgtcttgcataggaacagacctagttaaatgacaaataaaccccaaagccactcccttcagcaatatgtgagtgcaactcccacctcgattcttttgacttgtttaacctctatattgtattaattttttttctgaagagatttttcttcttagaacagagggaaagtgacacatagtgaacagtcaatgtgcttccaaatttaactggtaattttttaaagagaaacttatattgacttttaaaatgtagaaaattgatgaaggcaaatgaatcctcagatccattagatgaaatcactttttgttttccagtttgctaagatagaatctcaaaataatacagatataatattggtgacagccaacaaaaatatttgaggtaacagaaggaatgaaactttttaatcaaatgcttaatcaaagttttaatcaaacattctctgatggctcaccaatggaaacattaaatgaatgtaaaatatgctttgttacgatatctctaccgtttgggagcaggtatgtgggatgggggcctttactggtcccacagttcctgggcctatcttatgtactgttcctggtctgtggttttctgtcacactcagtgcttccctactgctgacctcaaaatgcacacactgtgct

SEQ ID NO: 6458 - DNA, 330 bp, artificial
  synthetic oligonucleotide
agaaacagctaaggggagcagagtatcagattatgaatcttgcctgcatatggtactttaatatccataaatttttcctttttcctttgttacagtcaagtcccagaagaagttaaaatgtggaccttcgaaccaataaatacaaagatcaaagtctaatttaattatgatcaaagtctaatttaattatgacatacacattaaacctaacttgagagatggacaaatgggacaatttgggtggaacatgtgtatatacagatatgtccccacctaagctttttggcataaactagcttacactcaggtgaaatcccatctctatgtaaa

SEQ ID NO: 6459 - DNA, 1249 bp, artificial
  synthetic oligonucleotide
tttgcttggagctgccttacccccaggcggtcctggctgtgaaagaccttatctaacacaaattgtgaagacagaggcactgccttgagcacctgaaagagcatctgctgagtgtccttaccaatcccagccctttccggcgccccgcccttcgcctgtctggcctagttctcaaggtcagctggcaggcgaactagccagcgaactgtccttcctgctgctgttggggtgatttataaagagcctcggctgtgactccttcatgatggccttgtccgtggagcctcagccacacctgcccttttaaagaaggcggcgtgtagttccgtgccaaggactgcggcgaaaccaagctggtgtcctcaccaccagcaacctctccctgcatcccattgcccaggttcctggagccccacgacgaccagggtgcccaaagagccccggagcgtatcccagcctgtgccctccaggcggcacagaacggctccgcagtgccacctagaggcttccagcgccagccagaggagagagtttttgtctctgcgggctttgggggctagctgggcaatggctagcactttggaggtttggtaccagggtgagctacatttggagaagttcatttctggatgtatggctgtacattcaaccccctcggagcctgtctcctgtagctacctctccacccctagtgcacacacttagggccagtgtgactcacagctctggagaaacccaagagctgcctccaaacctctagtcttaaccaaatggcagaaacaggagagcaagtcctgcaacataccccagtgcaagagttgttcagtagatgagataaagatagcattcccaacagaaccgaagtgaagggaccatcagtgagattgttgggacagctagctagccatttctaaaaaggacattgaaacttccaccttgcaccatgccctcaaattacatcctggtggattgaagagtgcaatgtcatactagaagaaaatattggtacctatttgtataggcttggagtggggaggatattccaaatataataccaagcacagaaactataaaggaaaaagactgataaatttgactcaaaatttaaaatcttttgtgcattaaaaaaaaaaactattgataaacttaaaagccaaaataatgtacttggaaaatgaccacacatctgaaagacagtgactaatatccttaatatatagggagcttttacaaatcaataggaaaaaga

SEQ ID NO: 6460 - DNA, 1854 bp, artificial
  synthetic oligonucleotide
aagatgttggatttttttctaaatcagatcttttttttcattctacagatggacaaactgaggcccagatagaggaaggactgtgccccaagtcacacaactaatttgaggctaagcctggaccagggagaggtcttctggttcagtgtggcccagtacaccccattgtcacctcctcagctctttcctgacaccacaggttgctatgcttgaagggcagtttccatttccccagtcccttttccctgctgttttcctctctgaccaccccttcttatttcccccaccccagagccatcttttgccctagccagtcaccacgtcagctttctcaactagtccacatcccattttgagggatgtggatgactggaaattgctagcacgcatagaaagacatttatcaagctcctgctgaggctagccccactccagggcaccagtgagccagcaagcagctacacatccccttctctgatgagctaacgcaatctggggtagggagagaagccaccctccctccccagaacagacaaacaagacacaagcccagtgccatggaatcttcgagaaagctccacagatcaggaagcttgcaaatttgtgacacttcacacacagcaggaaccatctcaaaacaacaacaacaaaacgaagcagtcatcttccaccccaaaaagccacaaatccagggcacgaccctcctagccaagtctcagggcgaggagaaggtgtgagggaagatggttgttcaagggaaacctgaaaggggagaaggggattgaaatctacggcccaaaccacagacttcagaggagaataatattcctggcctctggctccagtctgcccaaggcccagcagggtgtctagggatgagttaaggaagtgggaggctgtcagcggtggagagggggcatagctggtgcgggaacccttagactaaaccaaagctcgtgcctgagactggcaccaacaggagcagcggcatgggaagcaagtaatgtcagagttgcctggcgcagtgcctggaactcagtaggcactcttaaaaaaaatgtgagcagcagagaacacacgaggcaacactcacacatttttggcgcagctaagctccctcagcccgcgcacccccttctcaaaatgcacctccggcccccccagtagctgaagcctgccctggccggtcaccccggggccgctcccctgttcctgcgcaagactccgaggagtgcttgtcaccaggccaccgcagtgcttctgagagcgggaatccgcgaactggagtcccgtcttccttctggcgtcctgtcttccttttggagctccccctcaaggaccccgggagcccatcctacagtgaggcgggccgaggccggcgcgcatcgaggggacgcgggactcggccagcccgcggtagggccggggcaaagcgggcgcggggctcgaggaacgcggggccgctggggtcccgggagccgtcccggctcccggggagagggagctgggcgcgaagggctcccgggtcccgggatggagactcacctcgactggaggatcaataagatgcctaggaggactggaagaactttggacaacatttccgcggagaccggcgcgaccacctgcgcggaggtcgcggctcacgctctggccgcactgagcgcggggcggaggcttttgctgggctccaactttcactcctcccactcgccccgccccgtcccgcgctccccgccccaggcccgccccgatggaaatctccgacgacgtgacggctgctgcggtggggagccggggaggctcgcgcgggcgcgggaaggaggcgggagcccggttgctgaggccccccgt

SEQ ID NO: 6461 - DNA, 1266 bp, artificial
  synthetic oligonucleotide
aacatcccccatatccatcaagaacagattggataagttaagctggggcgtattagtaagatggaatacggtgcaacaattaaatgaatgatctacagctatatgtaacaacatagatggatctcaaaacataaactttagtaagaaaagccaaatataaataagacatcctgtatagtttgacatatatattatattatatgtgtgtatatataatatatattatatatataatatatataatatatatataatacatagtatatattatatataatatatattatatatataatatatatatataatcacaaaacaggaaaaaagcaatcagtagtattatatgacataatagcattttctttgcggatggaagaaggaagtactaattgtaaaggagcgtgagggaattctgggtttgtggaaatattgtttcttaatctaaggggttgttacattggtgtattaactctgtaataatttattgagcaacaggtatgcaagttttcaggtaggttatatgtcaataaaggaaagtggaaaaaaagacaatggaaatttagatttgacaggttaaatgaagttgagacagaaagaggggaagttgtgaattcactccatgaataccagccaccaggctaagaagactgctttgagggatgaggttgaatgagagccatcccatcagatacaaagttctcacatatattaaggtttcccaacagactggcaaaaaagggaaaattgcgggcaataaagaaacattaataaaatgataaatttaaaaatgcacaggtaaatagaacatatttaaaaattcattggggtggtggggtttatttgtttctgttaaagaagagagagaaaaagagaaggcggaaaattgtccactgtggaaaatatacctcccctatgatacccaagacacacaataaaatttaacatatgtgacatgagtagctatcttctgaagcaagaggaatcgcaggaattatattatcagaacattacgaggctaaagtcaaaggaattaagaacctaaaactcccagaatttagggggcctgagtaggaattggggcatttactgagcttgcaggactgctaggtttttggtaaatatcaccagtcacatgcgtgactcatagcgtcaagctatgagataagttatgtgaaaaagcttcactattctttcacctgttcagcaaatattttgtgtgtgtgcttactacatgctagggactattgtaggccctgtgaaggaaga

SEQ ID NO: 6462 - DNA, 573 bp, artificial
  synthetic oligonucleotide
taataacttccattatgagttcagaaaaatgttcccccaaatggctcctccagacattgagggtcctgcatccatttcaaggccattttggctttctacatgcccgtaaagtctgtccccactgggacacatgatcatgcccattcgttaaaagtggcaaggagtgtaaaattcgaggtgtggggttggattggagcaatcacagcaggtggaatcccagtgctgcctgccacctcctcactgaagtgttctgtgaatctagcctttcatgagcaaagttagactcttgtcttgtcgtgggttttgccatctccagatgttaggggagccatgactaagtaaattggcaactaccaagaaaacatggatgcaagaccaaatacatcatagtcaagtggcatctttgtgtttgcagttcagtatcatgggtgactgaggagaggagcaccctaagggctgtcactaaagccatactcctctgtttggcaacgttgtcggattttattgctaccgtctccctgctgtgaactgctgggtgcccactgtactctgatcacttctcaagggtttctg

SEQ ID NO: 6463 - DNA, 2045 bp, artificial
  synthetic oligonucleotide
aaaggtctcacaattgtcatcagagcaatatcccaaccaaccttggatttcactccctgctctaccacgtggagcatgaccctttggaaaatgacaaactccaggtgcgatcccctccggtaacctgagggaaagccagatgcacccagagggtcttggcttcttgcacttccctgacctcctttttcccctcctcgtgtctccacaccatgctccctgagtcacctttcacctcttccccgctctctgatccttgccatcctgggtcactcctttactgagtgaccatggccggggtacttggtgctagctgccctgcagaggtcccggggaccccagcgagatgaataactgaatgaatggacgtaataacgcccaggggtctagcccatgggaggtgttctgccaacgcgggtccctcccgtccccttcaggagccgcggtgcgctgaccacttcgaccccagccttcagagcagcccagacagaaagcggaagtgcctcggggcgcgtggggagccaggccagacgcccctgtggggcgggcgcggggcgggccgccatccctctgcgccgcgcatgctccatgccccccccacaacgcgccccgttcccacgctgccgccgccccggccccgcccgctcccggcccgctcgtcggcgcaccagactgagactccccttcaggacgctcttcgcgagcggtacccagaggcgaagtcgagacaagcccaggagcccccaccccccgcccgcgtttcctggggacgcggcctcggagggcttctaggaggaggcggcggccttggcctcgggcctgccgggagcaggaagggaggccgactccctcggctgcccgccgagcccaggtaagagggccgagctgggccgcaggggtgcgggtaagcgggtaaggggcccgtctcggcagggtgcaggtgtcgagggggacgagggagctgcggcggcggcgacaagcagggactccctgggaggcgggctagcactgagtggccggaccagccctcggggccgccccgtaccaggggcgccaggggaagagccatccagggctgggcgctgggagctgcggcccgtgtctgtcaatttctctcctgattggtttccagccaccggtcccgaggctggctaaagagcatcctgtcgctgatctgcctggtgagtttggattttgcacctctgggtgtgagagtgctgggcagactggcattgtgaggttgtggcaccgctgcccaggcaccggccctgagggtctccagatcggggcaggatgcccaaaattgtgctccagagggtatcaggtgggggctggtgcctcgcggtggtgcgggatgttgaccaggtgactggcatgccacggaaaagcatcagcttagccaagccaaggaggaagcgaagggccgatggaagtggtgggcaagggtgagagaaggagccagctgagctgggcagaaagcggcacccagcgcttccctacagggctagttgtgactgattcactcccacagatacctcctgagcaagcatttgagatctgccagggacacggcggtagtaagccctgccctgttgttctcgttctagtggctgagcgcagacaataagcagaaaatgttttccattagtaattacagagtctgttaaaaggcagtaagagccggggaagggaggtctggttgccagtttaggtggttagaataacttattctagaataagtctcatttctaccaaaacttgaaggtggtaaaagagcgaggcatgtggttatggttttggaagagcattctaggcacaaggaatcccctgtacaaaggccctgaggcaggggtggcctggctcaagggagcaagagtgtggcaggagcagagggaggtgcagaggtgggaggagggttgggcaaggtcaggaagggttgtgtgagtttactctgagtgacacgggcatcccagggataactgtgagcagagaaggacaggacccgacccgcctgttagaaggatccctcagcgagcagcctgggtggc

SEQ ID NO: 6464 - DNA, 4167 bp, artificial
  synthetic oligonucleotide
ccatttggtgtcactgggtaagtgatccctccacgacatacacacacccagtcccacctactctgtctctgggctcagtttatttccgagattcctgtttgtcggttgctatgagcccaagaataaatgcatttctccatcagaccagtaatgccagtaatccattgcaggccagccgccatctcagtaggatggtttttagctaagtggtctggacctgtaaatgttttaggtaaatgcgttggcctgtaagtttcagtaccagtcttatcttgtgtataaaatcgtggatcgactaaaggtctttctactcaaaagagagatgcaaattctactggaatatttatgtgcactcttttagacttaattcgtttctatgacggctgcattttgcatccgttccactttgtaaaatttagcaacatcttttccttccattgaccagggaggtcccacataaggacaaagtgtagacttggatttcaagccttgagaagtcccgggaggagctggggcagcttggagcacactgctctcccccttccatgccagtgcacacccactgccggaaggggcagcaattttgccaattaaagggcaaaagcaggagtcacaggctagacggatgggggccggagcactcaggaaggttttcaggtggggtaaagaacgtctgagggtgccagtgacttgcccccacctcacgcagctgatgagagatgcatgcgtgaaacagagtgggactgggcctctggcttttcccccagtgtgcccagcaaggctggctgctgcagctaagctcagacactccacttcccagtggaaatggaaacactccacttccccttgccgctggaggggaaatccagagggtcttcaacattgcactctactgcctttggggttgtgggagtctgactccacagattttgcctctgtaatctagccccatagagggaaagcagcttcatcccctggattccttctgacactcaccaggcagacctggggttccagggaggggtctgggatcctcagtggagttggatgatgaaacagggcaattcagctttcggggcctatggctgtcggcctcccaatagtccctggggcttgcaagcccttcttctgtccctcagggtgcccacacacatccccgatttctcatgagcttctcagcctccctgcaggccaggtgacaaacacagttgtcctcatggcccaaatcgccagctactgaagatctccgtgcccacctggccctggacgcgcaggagcccttgccctcgtagagggacttggccctttctctgagccttcccagtagtgctttttagagagttctttattctctgttacctgaagatattgagaattgcctgagttcaggagcgaccctgccctcagccatagtggtcttgacctgcttcatattccacgcccaggattttccttctccaagcctcacctgatctcccaattggaacgaggggaaggaccctgggtagcagacatccccagaacctgggccaccgcaggattgcacataggtgagtgagaggtgctcaaccagctccccatcggggtaaaaagaaatagcagtggcaaagggggcgggggagggtaccctgccgctttgggtgggaaatcctctttggaggcagatgtcaatctccaggtgtcacagcagccccgctatctccagcccatcctcccgccccttcatctctcctgtctgcctgtgtgatggctttctgttctgtggtcaccttgccccatccccctatgttctcacctcctgctcgttcatctctctgacttggcatgagggtgacactgcctggtgctctgtctttccaggtgacagaacacagagcaagacgtcgacttcaacgcagaagcattctggacgacaactccccggggccgatccacaaggtggcaaggaggggcaggcggcgaggtcgtctgtgctccagagaggtgcccagggcttggggcagagttcggctgcggggccgcagggccccaaaggcgcggagaagcggtacctgtgccagcagtgtgggaaggccttcagccgcagctccaacctcatcaagcaccgcatcatccacagtggcgagaagccttacgcgtgccccgagtgcggcaagctgtttcgccgcagcttcgcgctcctggagcaccagcgcatccacagcggcgagaagccctacgcctgccccgagtgcagcaagaccttcacgcgcagctccaacctcatcaagcaccaggtcatccacagcggcgagcggcccttcgcctgcggcgactgcggcaaactgttccgccgcagcttcgcgctcctggagcacgcgcgcgtgcacagcggcgagcggccctacgcgtgcccagagtgcggcaaggccttcagccgcagctccaacctcatcgagcaccagcgcacgcaccgcggcgagaagccctacgcctgcggccagtgcgccaaggccttcaagggcgtctcgcagctcatccaccaccagcgcagccacagcggcgagcggcccttcgcgtgccgcgagtgcggcaaggccttccgtggccgttcgggcctcagccagcaccggcgcgtgcacagcggtgagaagccctacgagtgcagcgactgcggcaaggccttcggccggcgcgccaacctattcaagcaccaggcagtgcacggcgccaggcgccctgcgaaggcggagacggcgcggaggctagcgggccctgggagcaccggccctgggagcgcggtggcggccaccagccccccgcggccgagcacagccgccaggccttccaggcccagccgccgctgactccccgccagcgcacccagggcgcggccggtctgcgtggggggccttcctggggacgtcgaggctcagcccccttcaggtgggaagaccgccctcccagggcctcgattgcggccacagccctgacctctttggccatcagaagaccccaggcagagcctcaccctgaggctgagaaacgcaggaaggactcagaaccgaggactgccgcctgccctggctcctccatcaacggcagtgcgggctgggaatggaggccctctactccctcctgagtcctgggccttgcaactgaggcacatagatggcacctgggccactcgtccctgagccacaggtactatcgagtgtgcacaggcgtgcgtggaggggatgcgtgaaccatccctcggatttgcatcagaatcgcctgctgcgggtagggaggaggccacgtgaggccagtgaggccagccagcgcggggcacgctggctttgagttacagaagagtggtgcatttcctccctgggggtcgttcccctcgccctaagagttgttagtgttcccaagtagaagatactgaaagcactttaatcctttaagcgcttatattgcaggtgggggaggcgctaaagttagcacagaggcaagaggctccctgaatgttggcataggatggggggctgtgccagaaaactcccgccttgtctgggtggccccagctgcttctgggaggaggagcagcgcccaggccccatcatccctgagcaccagtggttctgggaatggctagcccaggccctgcagagaggataagacccttcaagtcactcacaattggacatttgtagctagccaccctccaggctttgctttcccccctgcccgcccactgccttctgctccccagaccccaccagcaaaggccaccctggcctctctgtcccctgtccccctgccccgccccaccaccagtgcctaaagcttcgcacttacctgctcctccccatcaggcagcctctcttgcggctggtgacgattaggaggaaagccagacgggttaggaatttgcacttaggcaacagagcaagcccaggaacgaatctttcatcgaatgtcttttgcgtgacattttgtagaatactggacgttccgttgctttgattgtttttgtattcaggggtaatgtatattgaaaatagagattttgccatatcagagtatcagggattcactccctaaataagagtccccccagccctctgagaagacctcaggcaggagaaagggggccaccccaggcctgcccccagatgagtgtggtggcaagcctggcccctc

SEQ ID NO: 6465 - DNA, 1669 bp, artificial
  synthetic oligonucleotide
gcctcagccccctcactcactctcctgtgggccccggtctcctccgcaatcaaacagaggccaggccaagggctgccaggaggaccacgtgcggcaaggcacatggcaatgtgctcaggcgtgggcaccacccaatacctgaggctgatcccttcccccagccacgggacccacctctcacctccccgcggactgagcaccacagtattctagaacatgtcaggcccggtgcacaggcaacctcgcctaagcctcacgtgctgagggaggtgacaaagcagggccttgcctccaagcaaccccctcccaggagctagcaccctcacctccgttctaagcgcgtgcaacttggcagcactctcctgcagctgcctggcaagctccgccagcttctcctcctcctcggacttggcagaggcactggccctgcagggagagaaagggaacacttgcaactcaccgctgccaggggtgtctgcagtaacagaaccaagcagcctggggctgggacaggaggccagggtgctgccactgaggcctccaggagcacgtaccactgccagtcatcactctgcttgttgaggaggggctgcatgtccaggggccacgggtcgcactctggattcaggagcatctgcaggtgggggctagagaagagctcccccagcaaggcctcgttcttctccctggtgtcctcgaagtgctccatcaggctgcaaaggcagcccccagggccacaccgtcacaggccagagcactcgcccagcaggccctcagccccacagggaaggccccagaagcacatcggggccaggcacagaggccaggacaagccccaccgcgcagaatcctgccccacctgtctgccctggctcctccatttttgcccgcctacctacccacccatggagcaccctaggtgctcaccctcctctgtgcctggcccgtctgctctgaggcccacatcccaccttcatactcacccccggggccttgggcaacagccagcacccttgggacacagctgccccttgcccgtatgctgcccggcccctgattggccagccagatccccaagtggggtgtcacaccccagccagcatcagagggggagtgacaccccagcccctaccagctccagaactaggaccaagagaagcccgtcaatactgcccacctgggccatccacacctttacctcgagcaactggagcacccaatggtcaggctccggatggtatcgagcaactggtccatgaagtgtagctgcttctgggcgcaggcacagccctgggcaaggaagaccacagacattcactggctccatctaagccaggccaaggccagctgtccccagtgcccctgcccccacatgccacccatgccaggagccaggggaaaggaggggcctggcccatcaacgaccctgtgcctgcccagcaatgtcttggactagcaagtgctccctgcctggtccctgccttgggctgtaatgatgctgggaccacacgccagaacgggctgagcactgcagaaacatacaggagcatatgtgtctgtcgtgcagccgacagcatggcttgctgggtgggcaggcagcacacagcagggcctgctatgacagaacacagcccacagggacacctccaggacaaggcctgttctcctc

SEQ ID NO: 6466 - DNA, 1620 bp, artificial
  synthetic oligonucleotide
actgctgtcgttttcactcagacaacatgtggaaagctcaagaatgggcctgttccttttctctgggggtcaccccaaggctgtgtctctggctgccctgggccctgggaaaaggacaggcacgtagtaggtgctcctgcagagagcaggagagcaggagagcaggaacagcccccagaccttgaccctgaggcccaaatgctcctgaccccacccgctcctcctcgcaaccccgcctccacccttggccagccactatcacctggcccctggcgggctcagctgccacacggtggctcccacctcctacccttatgcccccagtacatctgctcgtgctccaccccacagcctgaggggggccggatcctgtgactcctctgcttagcagtccaaggtggctccctgattctttcaaggacaaaggcaagccagcccaccgccacagacaccttcccacggctcactcagcctgctccaccacattgctgtcattgccaatgctcaaattgggcccaaccctttctcacctggggcctctgcactggccatccctctttttcggagggctctttctgtggctttttgcatggccatggcctcttcactcatgcctctgcccaaatgtcactttctcacggtcctcacctgatcccctgtcagtgagcaaagaatccactgtccagtcctcgttgatgacagccttgagggacaaacagcattgctttggcatcctccaggctaccaatctgagtcccagcttgtagagggtatgtgtgtgcatgagtgtgtgaagcgtgggctacatggaagggaagggggaggaggacaagggacaggagtcccttccttgaccttagaatcctgggattgtacaactagaagcgaccttgatcatgtaatccagcttctctaggcgccttctggctctcagattctagaactttctaaggagcctgtttccaccatactgaaatgagaagactggggcactgaggagggagggaagcttgttcctgatgtcacatggccagtccgtccatggcagaactgggagcccaaagctctttccagcaaccctcgggctgcatccctggttcctggaaaatcccaacagccctcccaccctctgctccagacaccgggctcgggattactgttggcttggggcctgcctgtctcagcacaagtccgtcagtgagctcttgggcgggggggagggcaaggcagaaacttgccgggagcctctggctctgctgagcccctgaaggctggctctgctccatgggggttccttcaaggtccccacaatggccgggtgccctgggactggacagagtgggcagcaggagtaccactccccaggggcccacccaggtcagccaccaggctcccgaccaggggaagggcagcgaggccaggcctccatgggagctgggaactgagagcaccccaggcctcaccccttcctgcctaggtgggtaggagcggagtccctccctcctccaggctggctgtgccagagaaacctgggagcaggcttcccccacccccagcccagctaatgggaaccagatggcaggatgtttagtcagcgcctggggagcggcgcaaacaggg

SEQ ID NO: 6467 - DNA, 1900 bp, artificial
  synthetic oligonucleotide
ccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctgcatggcatattcatgaccttgacctcactgaatctgcagactcactgaacaggagaggcaaggcctggatttttgtccccatttttcagatgggatcattgaggcccccaagaggagaagggattcagccctgaattgaggccccttccttcatgagcagatggctagggacattcctatgaacctggtggggcagggaggcggggagaggttatcgtaataatcaaagaccagccccacttcctgagctccatctgagtctcacctcaaccacacgagtgaatggctgttttcatccccaacccccaccccccgccgccacttttcacagatgaggaaaccgaagccatgtggctcattaaaggggcactgggatgccgaggagagggctggggatgcctgggcccctgtgggacacagctgagacccagcagagggtcccagggtgaggtcagcccctcaagtctgcgccatcggaacgggctgggaacttgtggtccccggccattgattgtcactgctgcaggccccgaggcgggggacagccaaggacacagccagtctccatcagctccacctgggccgtgccctgcacggccaggtggtttgagtgcaggagtaggcatgctctcacacagcagggggtaacgggcagatggaagtggggcgggcgtgggagggggccttgcacagggccagaaggagagccggtccctgaggaaggaagcccctaaggcaaagagcatgccaggggacagccacaatgccaggtgatggagatgccccaatcggcccccgaggggcaaggaaggggccagaggaggctcgtgagggtgcctggggcttcagtgacagcagccccttacctgatggtctttgtgaccttggccaagtcccttctccattccagatccagggagggtgggggtgggcctgggggagctggagcttcagaggttgaatcattcactagcaggagaagccaagcctgtgagtcagtgagtgctctccatcccagaacgtctgctcccagcccagggatgcagccacggagtgccggggtcagccgtggaggaccctctgagaatgtcttgtggaaaggggcgccttgcctgcccggtagacaggatgagggcgccccagagccccaggggcttctgagagctgagtaccctctgggcctcttgcagccagcagagccaggcagagcttcttctggccttttcacctcctcccccacctcacagagcaagtcatcagcacatatgaactcccctctgattttaaactgatggcttgtgtatttcaccaatggccactgtctccatcagtggtcagtagcacatcaagtaatgtcaacaatgataatagttataatggcagtcactttatgtcagacactgagtgctgcacagacatttccttgcccacttaattgaaacaacaacaaatgattgcaagtgctgttatccccattttgcattgcggctgaggcccagagaggctaggtaacttgcccaaggtcacacagccagtaggtagcaaatccagggctggaatgtagtccatcaggctccggagtctggtctgtgcttgtagccattagttcctgtatctccagaagtgtgtgcggaagtcagcagagtagagtgtggttcgtgtgaactcactgtctcgggtactcccagccttgtgggctgaagccggggattcttgggaagaccttgcagctcagaagc

SEQ ID NO: 6468 - DNA, 1415 bp, artificial
  synthetic oligonucleotide
gagagagatgggggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttcaggggtgtcatcagagcgtcccagcaagggcggccatgacccacctcaagtcacatggaaggcagggctgggagaaccagggcaaaagcaggaggcttcctgagcctcagtttccccctctgtaaggcagggagagttctcctggccctcgtagggtgtttccaagggtgcagtgaaagaaacatgtctgtcaagagctggcatgcagatgtgggctcaaaactcagtgtgtgccatggggtcctgagaggggccccatgggagcgggggtgccccctacttagaaagtgccgagccttctggagcatgctgggctgcccagggcctggaggaagtccatgggggactaagctggaggtgccagcagagcccccaaagccagggagggacaacataggggaaagaggacccctgggtctctggtcaggtgggtttgagtcactgggtggggagtaggcactctgagcctagttgggaggtgagggtctctgggccctgctgaagagaagagtccagaaggcggttgagtaatgggcctggacttgggccatcccctccagcagcccctggaggcagcagccagggacccccctggctgtctcccaccacgaggccggccagtctgtgcggggatggtgcaaatgccggaaggtgcgaggccccctctgtggaggttctcatttcaatgaagccaattaaggtcagaaagatgaaagagcacagaaatggtatgttccctgcccttttggtgcctacagaccattctcggcagccagcccaggccggaaactctgtcaggcctgcagaactgataggcctagtcacttc

SEQ ID NO: 6469 - DNA, 1758 bp, artificial
  synthetic oligonucleotide
gtacacgaaaaggggctcagcatcaccagctgttagggagacacaaatcaaaaccgcagtgcggtgcatcacacacctatcccatggctgaactaaaccacagcagatgccggagtgggtgtgtggagaaaccagcgctcacccatcgctagtggatatgtcaaaccgggcagccactcgggaaagcagttggcagtttcttacaaaaacacacatctataaaggggtagcacggggtagcagagtggtgaggaaaccgctctgtaatttgattgcactggcagttccatgaatgtacacagtgatgaagttgcatagagacgcacatacacgagtgtgcgcacacaggagacacccgagcatcgatgtcgcgtccaggttccggttgtgcctcgggcgttcaagtagccaatgtcagagggacctgtggggaggggccacagcctcccaggcacttcttaccaacgtcctcgtgaatctaacagtttaaaaagaacaagttaaaaaatattccggcagaaaaaagaaaagtataaatgaaaaatgtgggcgaactgttgatgccagctgatggatccacagggtttcatgaactctgtctttgtttatgtttgaacttttccatgataaaccatttcttaagagtcaccacgaaatgagtgtctggtgaataagtgaagcattcatgaatgactgcagtccaactctgtccttccagagataatgcgagcgagatcccgcaaggggagatgattgctcaaggtcacgcggaacagtcaaggctactgagattccgtctagctctttctcaatgtgtgtttttaactttacacaagcaggacattacttttaaaggaaaagtgaccataaactgagggctgcaacataggaggggggaagggcagagggagacccaggatgccagcttcgcctaggggcaggggcgaggcagacagcctggggaggttagaggctctgctgtgagagggtttctgcaagatgaaatcactcaaatgccggctgtgtttggacatcttgagagaacatttccacacacggatggggtctagggttgagttcgtgatacgagcaaacagctacccaaaggacaatgattaactcctgggaaaacaaaatgcagctcgcatggccccaccgtgagcagcatttatgtggccgcataatttccaagcatggggataggaaggggtagaacagcaaaggtttgggggatgggactgatggaagccttcgaggaggcccccaagacgtgggcggacccttgtcttggcacactcctgcccctacatccttcgggccccagagctccctgacaccactggacccaccgccccccaccactctgcttcctgccagccctccagatggcctgtccttgccccctgtgtttgctccctcctgaggtcagcccctctgcaaggacaccggcccttcccctctggctaggttaggtcaaggacttggcctctccaacgcccactcctctcagtcacaaacagggacacctcaggcaccaacctgtacccgagctcagccacggacacatctgggcccccagaagggccctcagctctccagagccagagcaggcaagggcgacagagcgtgtggctttggcggctgggccaggaggagggaggggtccctactgcagggtttagccctttcacacttcagcagagagcagccgccccgtcagcacccacctgctgctgtcctcagaaatggggtgcctgt

SEQ ID NO: 6470 - DNA, 4320 bp, artificial
  synthetic oligonucleotide
accccttccaggcactgaggctcaaatgctattactattagccagaatctgacacatgagaatgagaggagacactgcagggggacctggggtgggggatggaattggcagcgctgtcagccagactttataccctcttcactgtgggagcaggaggtggctctggggcaccaagttgcgcccagtcctcaatgggccccttcgctggggtgccagtgcagattctgcgcgtaaccgtccacctagcccaggcccagcctagttcagggcccccaaccccactcccgcgccccaagcgccggagcccccactcattggcgccactggggaccggggagcgcagggcgcgtcgggcaggactggcctagagaacagaggcttgcaggtgggaggaaggcggcggggggtggggggggcgtgggaggtggagggagacgccgggcaggccgcggcccctccccgctccctccccgcgagccgccagctacagtgcccctcctgggcagggggcggagaagacggcgactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggaca

SEQ ID NO: 6471 - DNA, 455 bp, artificial
  synthetic oligonucleotide
tgttaaggctcactggctgcagcccacagaaagcagtgggactggaaatgccccaggaaaagactcatcccacccacatgtcacctgtttcacagaggaggagactgaggccagcagcaggcaagcgcctgcgctgcatctccgtgccacacctcttcttctcccctcttctctagaacatacccctggtcaggcagggatgggggctttggctcatggtggttaggggcacggcttccctgaagtgatgaacttacccgaactaaggtgtccatcacctgctccctggccaccttggccagtgtcagccgctgggcattgaaggcgcagatgcgaaaggcctgggccccattggccaggatgaggaagaggagtgcagttgggtagtgcatggctgtgtgtggctgccggggacaccccaggaatccaggctgctccagggtgcgctctcactg

SEQ ID NO: 6472 - DNA, 2123 bp, artificial
  synthetic oligonucleotide
atggaaacagccccatttggcactcttagcatttgaagagccctgcccagcctcatggaaccttccatcgacaagggcacaggggcagatttggactataacgcaggtccttgatggccagcctgccatttccacagtgaggggtggttctcatggtggctgtcactccccgcaggagaacatcatgaaatccaacattgacaagaagttctctgcgcactacgacgcggtggaggcagagctcaagtccagcaccgtgggtgagcagggtgcgggtgcccctcacccgggccccgggccactcttccgctggccctgcgactaccttgccccttgtgcctccttgcttcaaaggtctcgtgaccctgaatgacatgaaggccaagcaggaggctctggtgaaggagcgggagaagcagctggccaagaaggagcagtccaaggagctgcagatgtgggtcctctcgccgcagccctcaacatggagctagtgcttacggggtcccgtggctggtcgggctctttttgcaccctgggggggaccctgtctccagctttgggacaggggtagcatctagcttgcgatttgcatttctctctcccgcctcctcgggtccacgctcacgtcttttcaccatggcggcttgtcttctttctgaccctctaaatgcagtgggccctttcccagcatccggtgcctgagcagcctgcgttctccccattgccagcctgtgcttggctctcccctgtggccctctgtgcttgctgtttgtaacagagccctcgcccatgagctcaaagtgatccaggacagcaggacccgtctggggcaatggggacccagcctgggctgggcaggccccacatagggcacacaggtggctctgggtcaaggaaggggctgggtcagggtcgggaaggacatgatgtgtgatggggccacctgcacctcactaggaagctggagaagcttcgagagaaggagcgtaagaaggaagccaagcggaagatctccagcctgtccttcaccctggaggaggaagaagagggaggcgaggaggaagaggaggcggccatgtatgaggaggagatggaaagggaaggtgagggctggcttgagtcggagccccgcccgcagcccctggggaggggtccccaatgtgagaggctgtcagcaaagctgatgccctgtcaagatggctccaaaagctgccctcttgaggcaccgcgcacagtagaccggggagggaagaggctggtctagaccaggctggctgggcacattttctgtgatgatggaaatgttagagtctgtgccacccaatatggtagccacttgccccaggtgcctcgtatgactggggcactaaatggtgaattctgtttgatttgtttcagcgtaaatgtatacagccacagaaattccgaggctactagtcagacactgcaggtctcagctgtgagaacaaggggctgtcagggaaagctcaggatggctggggagtgagggtaaagccagcctggcctccacgtgtgccacacacctgtgctgtgcctggccagggcacatagggtgctgtccctctcctggtggaagtcacgggtcaccatgcactgaagacactactcagggttactgctctgctcggggcccaccgggctaacccaggggtcaaggaaggaggggagggttgagttaggccctaaggatgaggggagttgcattcgccagagaggcaggaggggcgacgagaaagtacatgccagaagcccagcaggaaagagcttttcaaaacgtttgaagattgggagcaagttgtgtcacgggcccctggagggtgtggtggcagttctggaaattgtgtcacccagggaatggcagagggagagaagcgaggcaggggatggtgctgtgtggctgtggtaacaggctgggtgccatggctttgaggggagtgcaggattgtagggaggaagaacctgccagccacctgccatttgggttccatgttccagcagccacagtaaaacatagaaaaagaaacaagcaggattttagtatgacattgtatttaacccagcgtatccaaaatatcaccattgcggcaggcgcactagctgca

SEQ ID NO: 6473 - DNA, 1455 bp, artificial
  synthetic oligonucleotide
ccaatccatacaggcccaaaagagttcagagtaagtatgagagagacttatgtgtgtattggagggctaatctccaattcagagaatttattgttttgtttcattttattcctttcactggtaagacactaagacactgcatttttatttatactcatttacagctctacgatgagttagaatctctttagcagcttggatactggggacctaggaagctagggtcatatgagcagtctcttcactgtaattacatcaccacagtcctgcctgacatttccttttgtacacttatcctaactgagctgctatttttcctttctctggtaaatcataaatcaaagactgaacatgcagagtactagatttgtatagattcttgtctttgctgtgtcataaacttgatttaaatgtttgcatagatccatttccttattgaaatccaattcaatctaaattagcaaatctttttttttttttgagacagagtctcactgtgtcacccaggctggagtgcagtggtgtaatcttggctcagtgtaacctccacctcccgggttcatgcatttctcctgcctcagcctcctgaatagctgggactacaggcatgtaccaccacgcgcagctaatttttgtatttttaatagagatggggtttcaccatgttggccaggatggtctcaaactcctgacctcaggtgatccgcctgcctcggcctcctaaaatactgggattacaggtgtcagccactgcacccggccactagcaaatcttaattgagtacctactatatgccatgttcattcattgtctaattgggagatagaagcaaatactgtattgccttttttcttgtcatatttatcaatttattattatagcattgtttgaaatgtcaaagaattgggaaacagatgctcatcagtacagaactgattaaataaattataatacattcatataatggaataaaatgcagccgttaaaaaaaaaaaaagcaaggaagcttggtagtaatacacaaatatctccaagatattttgttaaatggaaatgcagggtagaagaacagtaagctatgatttgtgtaaagatgtagaagagaaatagataaatacctagtcaagaaaaattaatttttaaaattttcaccacactaatgcatgcatatgcatgaaaatattgagtggtacagaagggcttataataaatagtttcactcctcaaatggaaccacttctttctccttattttccttttagttcttctgttactttgatatctctaaataatatacttatgatgttctttcttgatttaccagttttggatattttctattcttatttattattgtgttatattgctctcacaaatgaggatttagctcacttatactaccccatctccattctcctcaatgtagttatgttactattttttgttctgttggt

SEQ ID NO: 6474 - DNA, 877 bp, artificial
  synthetic oligonucleotide
acgaacaaaaaaaacccctgcaattacttgcaataaaaatatgataatctacctaaaaaccatcagcaacagattcagcagacaaactgcagaattataattaatatgagagttcaaagtggttgccagataaaatatcaatctccaaaaataacttccatttcttcacaccagtaataacatgctagaagagacatgcaaatgtgaaactgtcacaatagcaaaaagaaattacaaataatataaagacaaaagtaacaaatgcctttatggagaaaaaattccaataaaagaataaaatattatttaaataaatggagaaatggtccatactcttggataggacaacttattgtaaatattctcaccaatttaacctatttaatgcaataccaatctaaattccagttgaattgtttgaggaacttgataaattttatttaaaatatatatatatatacacatattatatatatgtataatatgtatatatatatatttttttgagatggagtttcaatcttgttgcccaggctggagtgcagtggcacgacctcggctcactgcaacctccacctcccaggtttaagctattctcctgccttagcctcccaagtagctgggattacaggcatgtgccaccacgcccagctaactttttgtatttagcagagatggggtttcaccatgttggtcaggctggtctcggattcctgaccccaggtgatccacctgtctcagcctcccaaagtgctagggttacaggtatgagccaccgtggccggcctaaaatttatatcgatgaataaaggtctatgaatagctaagttaaccctataaaggcaatgatggagttacctcaagaataatagactag

SEQ ID NO: 6475 - DNA, 1188 bp, artificial
  synthetic oligonucleotide
ttttacgtttttattttaaaataagttttctgtgcataatacattttgtgctggtacctcccctgctgtttagcagttgcttccagcttctggtagtgttaaactagaaagtcataatgccaaattgaggggatgttgtgtttgtcaggcagcatatactagtagaaagcttgatttctcagcatggtctatatgactttatccacttacatttatgtagcatcatagagatttgtcaaaggtttcgttatttccatttggctgattcactccactgtctttttggcttaaaaattgaaaaggtagaaaggctgtgttgttgccaggctaatttacttgaatagtattaagccaaccttctgctttttttacaacttcctttccccttccttacttcgtctttctctctagaattaagtatcactttataatgaaaagatagtttctttttaatcattgagtaggcaaagagtaaacaatatgattttgaacactttccttttgatcctaaggacttacactacaaaatattctatcaaagtcacagaatctgttgtttctttagtaaaacatagatcaagaaattggtaggtagaacatgaccttagagtacagtcaaactcataaaacaactaattttccatatttttattttattaaagttttagttgcatagcatttttgtgccagtgacacgatacaatggagctattctgtaagttagttctaaaaactggttgataaataaaagtaagcacagtggaattctaaaagaaatagttgcccataaaaatggtcttgagaatatatcattatgacttaaatcatgaagtatatgtttcatttgttttgaataattgggatccttttcaggagaagtgcagtgacaattatgaggcccaagcagagaagaatcaaggccagtcagaggggaaccagcatcaatcagaaggaaatccggacaaatcagaagaatcccagggccaaccagaagaaaatcatcattctgagcgatcccgaaaccacttagagagatctctttctcagtcagacagatctcaagggcagctaaagagacatcatccccaatatgagagatctcatggccaatacaagagatctcatggtcaatctgagagatctcatggccactcagagagatctcatggtcactcagagagatctcat

SEQ ID NO: 6476 - DNA, 1667 bp, artificial
  synthetic oligonucleotide
cttgtcttctgaaatagccagtgccatttgaaatactcagttgaaatggtgttcgattgtaatgtgcttaaatgattgaaaaagtgaatttaagcaggtttaagtagatggaggctttcaataagtgttgtagtcatttattcaaagtatttcacttaaggaggtaatagctgactcattcatataactaatatacctcgtgtaaaataatgtatgctatttgcgaatttgagttataaaaaatgctttcatgtttctagtgcatagcccgtaaagccaggtatgtggaaatttacagtccagttttcctcataggaatcagctcctgccgctatcaaacagatatttcttcttccattttctttggttcttatggagtcatagtaaatagcctttaaactaaatatgctaccccatggagccccatccaccacaccaatattgaagaaaaaatgatacagctcattaaaacagtggtattttctgtaaaatgggaataacggtagtatttccaaaagattattagattctagaacttcattacactccactgacccaacaaggagctacatttttatgccaattatttaatgaaagggtcataaaagaatgttcaattgtctggaaatatgtcccaatctccctccagaaaattagtattttgttgttgttcaatgaagtgaaagttagggaataacttgctgaggggcttcactagaaagccagtaaggcattttcactacagactagagccaattccatcaactgttaacaggcgcccataaaatgccagatgtagagcagtccaaatttgtttatttgtagcattagcatgcattctttcaatatgcagaaatcctctttatggccatatgcacaggtgtgtctaccgtgtgtttaaaagagtgacagtatttctccctatcacaaggtcaaaaacctctttccaaagccaacccgcacaaacactggctgtttcactgttgtgtatagtggctttcaccgcctgctgttctggctccacactggggctttggaggcctttagttcatacaagacgcattgtggtttgtggtcagcagaataatagctccaaatatgtccaggtcctaattcctggaacctaggaatacactaggttacatgaccaaagggactttgcagacgtggttaaattaaggatcttgagatggggggattatcctggattattggatgggcccaaattaatcacgtgagcccttaaaaagcagagaacctttcctagctggggtcacaaagatgcagcagaagagagtcagagagatgaaagatgaaaaggacacaccttaccgttgctggctttgaagatggaagggaccatgagccagggaatgagtgtggcctctagaagctgagaatgaccgggtctgatagtcaataaggagacggaggcctcagacctcatcaaagaactgaattctgctacccacttgcacaagcctgaaaatgaattcttctctagagtctttagaaaagagcttagctcagccaatacattgattttactgagatccacatcaaactcctctcttacagaactgtgagacaatatatgtgagataatacatgtgttatgtacaagtgctacatttgtagtaattatttataacagcaataggccactg

SEQ ID NO: 6477 - DNA, 1008 bp, artificial
  synthetic oligonucleotide
gtagaacggaattagagtcaaattctcagttcctgactgaccaatactcattccttatgccattgttgataattcagtaaaacaatagatgtgtctttattcttgtgaaattgaagtttctgagacatcttgttcaaccttccttcttctggcgaagtagtcagttttatactactattttgggggatataattgtgtgaaaaacttcttctcttgagcatgaaagccctgccacacccacacaggaagatgagatgggagacagacaaaacctgtagcatttctccattcttttagcccacacctgcactaaaataacctccgtcagatcctcacccggagcagctctctttctttttccccatgaagcctaacaaagcatcctggataactgtgtacttcctgcctcacaaataagaagggaattatttatcatctggctagacaggtgcagaatcttagaagccctgattcctattgaaatccggggccagagcacgacgtcaaccatgcctccctgtctgggacccacaccaatggtgaggtgagcggtgctgggagtacacagcctgtctagttctttctcaagattgacatgtcaactccatgaaactcggcattgctctcataaacatcatctcctaagctcatcttggcatcagatctgtacgatggcaggagtgctggggaggctggcacacccatgcgaatttgtttggagccgggagagacctgtcgggggcactgggttatgccttagatagtagggctttgctaacacctgggatattgagtctggaactcccatgggacacagctgccctggtcccaacttggaatcagatgcttccaaagagaataaagaaatgtcagctcctttcattaaaatagtcaaatccactgcatacaaactgaatgcggttataatgctggacaaaaactttttcttccttttttccccctaatttcagggggaaaaatgcttagagttttagaaagatttttttt

SEQ ID NO: 6478 - DNA, 719 bp, artificial
  synthetic oligonucleotide
tattttccatccatctccgagagaagctcagcatactggaggcatgtgcagcagatgtcttcctggttaacactttcccagtagaaggcctgttaaccttgagtacccaaacttcagagaatgttcacatttctccaatgcaacatttgtgatgtattttaggctccttgttggcattttcctgcagatctttgattttccaagaacagactgctgacgttcgcagggtagaaggtggctgtgtctgtgccaggtctcagtcccacttctctcactgccggtgcctcctctacctacttgtgattccccatgaaaaacgcccccttttaattcacctgaataaactgcctcttcaccactcccggattctaatacattgtgtgggtgtggcaggggatgacaccacttcccttcagagcaagcctctgtttcttcggtaagcgtgggaggccactaaaaaattaattgcagcaaattgaaaaaagtctcgggcaacatcacaaatgctaatacagcaaggaaagagcagcatgattgccttttaaaaaggccttttcattgatagtattatctcaaatgtcttcataaaaagaaagggtgccatccctggttgcagagatctccttaatgagctccaattttaaaggaacatgaggaaggaggagtctgcaaatggagatgagcagggccacagtgagctgggacttgtgaagtgtgcc

SEQ ID NO: 6479 - DNA, 1008 bp, artificial
  synthetic oligonucleotide
tcgaagttggattatctgttatcttcatatgtcatttttatgaaataaactaaagaatgggtttaagtatattatatgcaatggatatgaaagaaaattaaatctgtatgtcttcaaaagagatatatatgatccaggtggatatcctacgtatcatatatatatatgatatatattatatatataatgtgaatgcttctaaattttgttttcaacattccaaaacctgacttatcattttgcttaatttaaaatggtttacacatgcatcactatttgtttggatacggtgtgaatctaggtactaggcaccaaaaaaatactaaaagaaccaaaatgttccttcagtacaaacacaagccgggtctcaaaaataattttcaatgcaagggacaaagagctttcccacatctggccttatgagcagaattctcatacctgagccctttcctatcggaaattcaaggttctcctaccttctcacgcacttctatgcacatgggtaaggcggcttcagtgataaaaatcaagagactcatctccactatggacagaggtggcttgggaaaagaaaacccatcatgctggtgaaggcgtagtcagaggcttgacaagcgataagcacctgtaggtagactacatagtggaatactaaactgaatggccatataaagtcaacagatttggtgaatatttcctgctgatacccacgggttgacagtgggcccttgtttctccctagctatccttccaagagcattgctttcttttattctgtgttacccaaccaggctgaattttttccccttcctgtctccttcttacatgccaaaggtttgggtcttcagatgctatttccttgccaacatcctgtttgggttattgataaagaagctggatattggaaagctctcacctttgaaatagttctcaggctatagttttgcaaactgcggagcgcacacctttcaatatttatgctccttctatcgacactgagtaaattag

SEQ ID NO: 6480 - DNA, 1003 bp, artificial
  synthetic oligonucleotide
cattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggca

SEQ ID NO: 6481 - DNA, 29732 bp, artificial
  synthetic oligonucleotide
gaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctc

SEQ ID NO: 6482 - DNA, 898 bp, artificial
  synthetic oligonucleotide
tgtatgtcaaaccttagttcagcatttactgaacacctttggtatgtaaggggtgtgtgtgctagctttaccttttgtaaattagcgacataattacttctcaagatgtcattgggcataatgaaatgagaatcaaagtgccacagggctggggtaatcatagctcttaaaaatgctcaaggccgggtgcggtggctcacgcctgtaatcccagcactttgggaggccaaggccggcagatcacgaggtcaggagatcaagaccatcctggctaacatggtgaaactgcatctctactaaaaatacagaaaattagccgggcatggtggtggtagcctgtagtcccagctactcaggaggctgaggcaagagaatggcgtgaacccgggaggcagagcttgcagtgagccgagatggtgccactgcactccagcctgggcgacagagcgagactcagtcaaaaaaaaaaaaaaagctgaataattgctattctttctccattattgtggggtaataattggtatagttattttcaacctcattcaaataccgatgatgagtttttgatagcacttgttatcttcttgaaaggcttgcaaattaaatgcactagaattaaaataacaatttcacaatttgaacttttaggtacattttttcagtgcctcagaattcgtaacctattatttctttgggagaacatgttatattttaatctttgagttggagtaagttgtctgtggtctatttcttcccttctttcaaaactgtgtctgagatgtgtgttgttttctggagtcctagttaacaaaacacctcctttttcagtgacaaagccttgttactgaaagcactttatgttctgtgaatctcctccaatctgtccccagtgtgcttg

SEQ ID NO: 6483 - DNA, 1007 bp, artificial
  synthetic oligonucleotide
aagaagcagctcttccttacccctcttgaaagggtgttcttggaaaattaattggtctgaatcctaactccaattcactgatatgtaaataaaatgtttgcaggagccagagggctacatgtgtctcagaatttgggacctagagatgtctgcaagttctccagcctcaatactcctggaaatgtaaatacccaaaggcatagctattgcagtctttcctgcaccttgggaacttaacaaggggacctagtcaggtatgcaaacatttagcactctaagggagttgagagatttttattaccttttcagaccagatcaattaactaggcaaatgactacagatctagatctcatggtatgtaaagagtaaagtatttctggggaaaataaaagcaaacattctctatctttacatcatatacatttctgtgtctcagaaggcaggggattcttgaagaagcacgaagaaattcagggaagttttcttttttagcagagacattctgctacattcatattttgggagcacatatattaaatgtttgttttattacaaagcatgtgctgttaaaaataatcttgtgaacaactgatctagtccagtgcttctcatactttatgcttaatgcacagacagaaccatcttgagaatcttgtgaaaacatatataagcagattctgattacataggtgtggagtgagttcttagatttgttatttctaataagctcccagcagatgctgatgctgctgttcacacttagcatagcaagaccccagccacctccctgtctccagagttggagcagaactgtgaactctctgagctggaaaaattgaaaattgtacagcagccagaatgcatctctgtgttgcctaagcaaggagcaagaatctgggtcaagtgttggacagaatattagcacttgttaaaattgaaatggagtggtggagaagagacaggaggattcaaagaatcctggttgaaaaaattgagatacagtagg

SEQ ID NO: 6484 - DNA, 201 bp, artificial
  synthetic oligonucleotide
ccttagcacttatgttgaagctttcaaaagatctgaagattagtgaatcctgacatcactgcattctggtttagttttctataaaattttctttttctactaattgttcagcataagaaaagtctccagcctaaattataacagggcccatattattaaacaaaaatatatttattttaactagatagcatttaaaactaa

SEQ ID NO: 6485 - DNA, 489 bp, artificial
  synthetic oligonucleotide
tatgtagttcatctacttctatattgcagcatttaaataatataggtatatctcaaaaggatccaggagaaagttcatttcgatgtgtgtctgatccttttcagtaatgtattaatcaaagtaaaggggagtatgttgcttggtacttatcattaaagggaagccagtatggaccagctttaagatattttgacacaaactggctctgccacaaaacattcatgtattcttaagcaagttgcttacccttttttaccctattttcttgtttccaaaatgaagggactatactaggacagaggttggcatactatggtccatgggatgaatgtagactgccatctatttttatatagcacattagctaggaacaatttttacattgttaaatggttgaaaaaataaatagaagaatattgtgtgacacaagaacattatataacattcaaatttcactgcctataaataaagttttactggagtacagca

SEQ ID NO: 6486 - DNA, 1730 bp, artificial
  synthetic oligonucleotide
ttcatataattagaatatatttatattgaattgtagccaataatgtccaaacatttaatcatggtcatctagaaaaaaaatgcttacttaataattcctgctattattgtaaatattttttaaaatttcatttttatacaaattggttgatcaaaatatattttgaaaacttaaaaagtaaatgaagtcatttgccatctttaaacttaacaaaatacttttcattttttttcagggccttctgtccttaactttggtaatatttgtgtgaactctccaaatactcatctacttcatgttattaatatgctacctatgcatgttttgctccagttagatactgatttagaagaacttcagaagaccaaccaattttcatacgtgattctacctacatccagtacttatatttcaatggtatttgactctcccaccattggaaaattttggaagtagggattatttttgaatttctgcttgttagaatcaaagtgtacttctgtagaatatgtatttattttcctgaataattgtattgtatattatatttgttctccaaacatagaagctatatgtgcatcaatttttagatatatagattgatagtttagtagcaatctaattatctttcataattaaagtattacgtgctaagaattgtggatgttaatcaatgctatgtgcattttacgtgtagctgaattctataatcacaaataactattatcagttaaatttggatgcttttgctgcattacaggtctttcacctttacagtgaacaatgtacccagtggacacatcctagtggtggcagttgtccagccagtaacacttgagctatcttctaatgagctagtattgagaccacgaggcttcttcatgaaaacatgttttcgggggacagttagattgtataatcgtcagaattgttgtgctcagtttcaatggcaacccgtaaacacaggaagagggatagcattttctatttgtccagctaaaggtaacagtttattgtttgtttgatttagacatttattttttcatgtattcatgtattctggtattaattatttattgagtgtgtactgtgtactggtgccaagagtatagaagtaaatcagatactgtcatcaggggtatttatttttacagatataatatgatttggaaatatggaacccttgttagggttctccagagaaacagaccaacagggagagagagagacagagagagagagataaagagagagacattttaaggaactggttctggctcacaggttgtgtggttgtgtggcctggcaagtttgaaatttgcagggcagggtggtagactggagatacagggaagagttgatggtggagtcttgagtccaaaggcattctggaggcagaatttattattcctcctgggacatcagtcttttctgttaaggctttcaaataattggatgagacccacccgcattatgaaaggtaatctgcatgttaattaactgattgtgataattattatactatatatgcatatcaaatcattatgttgtacaccttgaatgtatacagtctttgtcaattaactgtttcaaaaagcctactgatttaagtgttaattacgtctaaaaaaacactttcacaacaacatctggactggagtttaaccaaataactgagccctacagcctggagcagttgacagataaaattgatcatcacagatacttat

SEQ ID NO: 6487 - DNA, 1498 bp, artificial
  synthetic oligonucleotide
atttcattgtaatgttaaatattaatggaaagtatattaaccacactttaatcagattcactttaatactataatagtaaaacttgccagaaggcacaagtcagatttttcttgtcatggttctagatgtttctaacatggttagtaatatttctaataattctaaatatggttctaaatacttcatgtaaagttaaaaatatccctagaccttgtggaaatggggtggtggaagtgcaagttttgagttgttttggagtgtggccccaaattgtttgtgcagtcaagaccttgttgtccccacgaatagtcaggtgcatgcagcatgtcgtaggtccctccaaagaggatgcaatacttctggcagggcagaattattgctgactatcctaagtattaaacctatagcaccttccagggatcagtcaaacttgtttgctgaaattcatacagacttttagcacttaagccagtgtacatttttcataattccatgaactttgttttgttattaaatttgaagagcatgctgttttaaatatataatagcaatttcagtgacaccttgataagttgtaatatgtgtgaactgattcaattgcaagaatattttcccttgtttgtgagagggtaatgtttaatgtacttcttgtttgtggaacagggttgcctgttgaagattgagcttgctttaatttaaagaggttaataaatcaagtaattgttctatatgtaaatccacaattgccttattaatgataccttcatacaagtagtttctttggtgaatctgtaagattctgtttaatacacaatctttgaaatttgaaatattctattcttttttcatggcagcatgttaacttgagagtctagcatagaatcataggtatatgtatgatttgaagtcttagttaaatgtgttctgaccacactatttgtattcatatttaatattacatgtcagtattttgtaaatgtagttgagtttgcactactagagagctgacctctaggtaaggcaggtaaaaatagccaatgagcagacctatgacataaaccatctctgcctttactcctatttcccttcttcctagccttcctttccttttctcctcaaacaaaatttaactgttagcaattcgtgttctccaaattacttgtccacaacaagagcatggctggcaatatgcacttagtacattggggaagacaaatttgtaacaaatgttttttattatgcccaagagtaagatggactattgtaaagaattaatcagagtccttagttagagatgaattttgtctggaagaaaattctttgcagagaaagtggcatttgagctagaccttgatgacttggtatatttaaattactcttgtcttgacgatgttggcacgaactcatttttctcagctttatactctgtagccttcttttggcaaatctctctggctgtgcagtaaatttggataatggattacagttgtattttca

SEQ ID NO: 6488 - DNA, 931 bp, artificial
  synthetic oligonucleotide
gggacaggtcagtgtttttcatcatggtcttcagctgaagaagggtgattatcgtaaaaatgatttttgctctccttttttgtcccccttctggtccttaggctcgagagggagctttttttttttctatacttgctgccttttctagattgtgagtttttccagcatcttgtctgggatacataggaagtaagaaaaaaaccaaaacccagaaaacttactgccttgccgttcatcaaatgccaagatctttagccaaattcctcatcctttccaactttttggagggtatttctatggttgctttatgtgtcatgtataggagttttagctctgtttaatgtgaggaacaaagagaaatctgtatttatttatttattttttgagatggagttttactcttgttgcccaggctagagtgcagtggcacgatctcagctcactgcaacctccgcctcccgggttcaagcgattctcctgcctcagcctcctgagtagctgggattacaggtgcatgccaccaagcccggctaatttttgtatttttagtagagacggggtttcaccatgttggccaggctggtcttgaactcctgacctccagtaatccacccgcctcagccttccaaagtgctgggattacagtcatgagccaccgcgcccagccatatctatctttttaagaactaaagtccaaacattttttttacaaacaaatttatatttgctttatgataacagctcacacacgtgaatatagggaaagctgttaacagttgtgttagaatggcaagattattcctctttttttttaaccaatattctaccatgatacttatattacttctatgaaggaaacattaagtttctaattaaatttctaaatgtgcttattgtgctttatgtttctcagttatttaaatactcttta

SEQ ID NO: 6489 - DNA, 10240 bp, artificial
  synthetic oligonucleotide
attataaacaattatctccatttccaggaacactgggggaaaatgacaagcagaaagaccctgaaacctacaggaaagagatagttcaagaaaaaggtaagattgctctaagtgctcttaagaggatattggattccaagtacatctatctagggatttccaatagtaaaagcttaagagaaaagaaaatgaaagtcttggagagagaatgagaatggtggaaaggctatttcactctttaagaatggtaaggaaaatagtttcttctgacaggataaagtccagctatagataattatatttatttctgaggtcagtctttttgacacattatttttcttcattctcattccatgtgagagagagaaaactagaattctcttttttccaacttttaagttcaaggatacatgtataggatgcgcaggtttgttatataggtaaacgtgtgccatggtgctttgctgcatagatcgtctcatcacctaggtattaagcccagcatccattaggtattattcctgatgatctccctcctcccatcccctaccctacaacaggccccagtgtgtgtgtctgtgtgttctcatcattcagctcccgctaataggtgagaacatgtggtatatggttttctgtttcagcgttagtttgctgaggctactgacttccagctccatccatatccctgaaaaaacaagatctcatttctttttatggttgcatagtattacatggagcatacatactacattttctttatctggtctaccattggtgagcatttaggttgattccatgtctttgctattgtgaatagtgctgcaatgaacatacatgtgcatgtatctttattatacaatgatttatattcctttgggtatatacccagtaatgggattgttgggacaaatgttatttcttcttctaggtcttcgaggaactgccacactgtcttccacaatggttgaactaatttacactaccaccaatggtgtaaaagcattcatttttcttcacaacctcgccagtgtctgttgatttttgacttttcaataattgttattctgactggtgtgagatggtatctcattgtggttttgatttgcatttctctaatggtcagtgatgttgagctttttttcatatgtttgttggccagatataggtcttctcttgagaagtgtctgttcatgtcttttccccactttttgatggggttgtttgttgttttcttgtaaatttgtttaagttcctcgtagactctggatgttagacctttgttagatggatagattgcaaaaattttctctcgttctgtaggttgtctgtttactgatgatagtttcttttgctgtgcagaggctctttagtttaagtagatttcatttgtcagcttttgcttttgttgcaattgctattgcttttggtgactttgtcatgaaatctttgcctgtgcctatgtactaaatggtattgcctagatttccttctagggtttttatagttttgggttttacatttaagttttcaatctatcttgagttgacctttatataggtgtagggaaggggtccagtttcaattttctgcatatggctagccagttctcccagcaacatttattaaacaaggaatcctttctccattgcgtgcttttgtcaggtttgtcaaagatcagatagttgtggatgtgcagcctcatttctgagttctctattctgttctaatggtctatgtgtctgattttgtgccagtactgtgctgttttgactcaaatagccttgtagtatagtttgcagttaggtagtgtgatgtctccagcttttttctttttgcttaggattgtcttgactatttgggtacatttttggttccatatgaattttaacatagtttttcctaattcagtaaagaatgtcaatggtaatttaatgggaatagcattgaatctataaattgcttttggtagtatagtcattttgacgatattgattcttcctatacatgtgcatggaatgtttctccatttgtttgtgtcatctctgatttctttgagcacagtggtttgtagttcttcccttgttagctgtgttgctaggtattctattctttttgcagcaattgtgaatgggagctcattcatgattggttctctacttgccttttgttggtgtataggaaaactagtgattttcacacatcaaatttgtatcccgagatgttgctgaagttgcttattagcttaagaagcttttgggctgagtcaatggggttttctagctatagcctcatgttatctgccaacaaagatagtttgacttcctcttttcctattgaataccctatatttctttctcttgccttattgccctggacagaacctccaatactatgttgaatagaagtggtgagagagggcatccttgttttgagccgattttcaaggggaatgcttccagcttttgcccattcagtataatattggctctgggtttttcatatatggttcttattattttgaggtatgttccttcaatacctagattattgatagttttaaacatgaagggatgttgaattttattgatggccttttctgcatctattgagaaaatcatatgggttttgtctttagcactgtttatgtgataaatcacatttattgatttgcatatgttgaaccaactttgcattctggggatgaagtgtgcttgatcattgtagataagcttttagagtcctgctggattcagtttgccagtattttgttcggaatttttgccctgatgctcatcatggatattggcctgaagtgttttgttttgtttttttgtttgtttgttttttgctgtatctctgccaggttttggtatcaggatgatgctagccttacagaatgagttagggaagaggctctccatttcatttgttttgaatagtgtcagtagaaatggtaccagttcttctttgtacccctggtagaattcaggtgtgaatctgtctggttctgggcttttttttttttttggttggtaggctatttattactgcctcaattttagaactcattattggtctattcggggattcaattttttctttgttcagtcttgggaaggtgtatgtgtccaggaatttatccatttcttctagattttctagtttatgtgcatagagatgtttatagtattctctgatagttatttctatttctgtggggtcattggtgatatccccctcatcatttctgattgtgtttatttgaatcttctctcttttcttttttattagtctatctagcagtctatctattttattaattttttcaaaacaatagctcctggatttgttgattttttgaagggtttttaatgtctctatctccttcagatcagttttgatcttagttatttctcgtcctctgctagtttttgggtttgtttgcacttggttctcttgttcttttagttgtcacgttaggttgttaacttgagatttttctaactttttgatgtgggcatttagtgctataaattccctttttaagactgctttagctgcatcccaaagattctcatatgttatatttttgttctcattagtttcaaagaacttcttgatttctgccttaatctcattatttacccaagagtcattcaggagcatgttgttcaatttccatgtagttgtgtggttttcagtgaatttcttaatcttgagttctaatttgattgtgctgtcatctgagagactgttattatttcagttcctttgcatttgctgaggagtgttttacttccgattatgtaattaattttagagtaagtgccatgtggtaatgagaagattgtatattatgttgtttttgggtggagagttctgttgatatctatcagttccacctgatccagagttgagttcaggtcctgatgtcttttttaatattctatcttgatgacctgtcccatagtgtcagtagattgttaaaatttcccactattgttgtatgggagtataagtccttttgaaggtctctaagaacttgctttatgaatctgggtgctcctgtattgggtgcatatgtatttaggatgattagctcttcttgttgaatagaaccatttaccattatgtaatgcccttcattgtcttttttgatttttattggtttaaactctattttatcagaaactaggattgtaaccctacttctttcttttttccatttgcttggtaaattttcctccatccctttattttgagcctgtgtatgcctttgcctgtatgatgagtctcttaatgacagcatacccatgggtcttgattcttaaaccagcttgccattctgtgacttttaattggggcatttggcccatttacacttaaagttagtatggttatgtgtgaatttgattctgttatcatgttgctagctggttattttgcagagttgtttatgtggttgcttcatagtgtcactggtctgtgtaattcagtgtgtatttttagtggctgataatggttattcctttccatagttagtgctttctttgggagcccttgcaaggcgagaccaatggtgacaaattccctcaacatttgcttgtctgaaaaggatctcgtttctccttcgcttttgaagttcagtttgaccagatataaaattctggattggaaatacttttttttctttaagaatgttgaatattggcccccaatctcttctggcttatagggtttctgctgagaagttcactcttagtctgatgggcttccctttgtaggttacctggcctttctctttggctgccctcaacattttttctttcattttgaccttggagaatctgatgattatgtatcttggagttgttcttctcatggagtatcttaccaggcttctccgcatttcctgaattttacttcatggttggattctcagggaatcattttattaccataattttaacattactgggctaagaaaagtttcatgtttgccttctatactatatacactggcctggtgatgtgagacctgattaaaatcaggtgatatggcctgtcttgctaggttggggaagttctcctagatgatatcctgaagtatgttttccaacttggttccattctccccatctctttcaggtaccccaatcactcagaggcttgttctttttacataattccatattttttggaggtttcattcattctttttaattttttctctattcttgtctgcctgtcttatttcataaagatagtcttcaagctctgagattctttcctctgcttggtctattctgctattaatacttgtgattgcattgtgaagctcttgtgtgtatttcagctctaacaagttggttatgttcttctctaaactggtgattttggctgtcatctcctgtactagaaaactagaattcttaaggcagagtggactttaagacccacgttttgtatgagggaaggtagtgtggagaaatattgcataagaacagaacttgaacccaattatatgggggaaaataaaaatgaaaagaaaatgtctgtgataacccagggacttagactggtgactggattgcatggtctttcaccataatggagtttagaggagaatggacatgatcatggggaaaaatggcctttcatttgagacactcaggtttttagatgcctgactttaaaagtgtagaaatttagagtctgacacaaagtgttctgcaataacatagttcctcatcgagtttgtgacagaacttggaaaaccagcataatattttagtcaggtctcatatcaccaggtgagtgtatacagtatagaaggcaaacacgtcttgggagggtgtatgtgtccaggaatttatccatttcttctagattttctagtttatttccgtagaggtgtttatagtattctctgatggtagtttgtatttttgtgggatcagtggtgatataaccactttatcattttttattgtgtctatttgattcttctctcttttcttctttattagtcttgctagtggtctatcaattttgttgatcttttcaaaaaaccagcttctggattcattgattttttgaagggtttttcgtgtctctatctccttcagttctgctctgatcttaattatttcttgccttctgctagcttttgaatgtgtttactcttgcttctctagttcttttaattgtgatgttagggtgactactttagatctaccagaggtacaaggaggagctggtaccattccttatgaaactattccaatcaatagaaaaagagggaatcctccctaactcattttatgaggccagcatcatcctgataccaaagcctggcagagacacaacaaaaaaagagaattttagaccaatatccctgatgaacatcgatgcaaaaatcctcaataaaacactggcaaaccgaatccagcagcacatcaaaaagcttatccaccatgatcaagtgggcttcatccctgggatgcaaggctggttcaacatacacaaatcaataaacataatccagcacataaacagaaccaaagacaaaaaccacatgattatctcaatagatgcagaaaaggcctttgacaaaattccacagctcttcatgctaaaaactctcaataaattaggtactgatgggacatatctcaaaataataagagctatttatgacaaacccacagccaatatcatactgaatgggcaaaaactggaagcattccctttgaaaactggcacaagacagggatgcatgccctctctcaccactcctattcaacatagtgttggaagttctggccagggcaatcaggcagaagaaagaaataaagtgtattcaattaggaaaagaggaagtcaaattgtccctgtttgcagatgacatgattgtatatttagaaaaccccatcatctcagcccaaaatctccttaagctgataagcaacttcaacaaagtctcaggatacaaaaacaatgtgcaaaaatcacaagcattcctatacaccaataacagacaaacagagagccaaatcatgagtgaactcccattcacaattgcttcaaagagaataaaatacctatgaatccaacttacaagggacgtgaaggatctcttcaaggagaactacaaaccactgctcaacaaaataaaagaggacacaaacaaatggaagaacattccatgttcatggataggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctgcctgacttcaaactacactacaaggctacagtaaccaaaacagcatggtactggtaccaaaacagagatatagatcaatggaacagaacagagccctcagaaataataccagacatctacaaccatctgatctttgacaaacctgataaaaacaagaaatggggaaaggattccctgtttaataaacggtgctgggaaaactggctagccatatgtagaaagctgaaactggatcctttccttacaccttacacaaaaattaattcaagatggattaaagacttaaatattagacctaaaaccataaaaaccctagaagaaaacctaggcaataccattcaggacataggcatgggcaaggacttcatgtctaaaacatcaaaagcaatggcaacaaaagccaaaattgacaaatgggatctaattaaactacagagcttctacacagcaaaagaaaccaccatcaaagtgaacaggcaacctacagaatgggaaaaaatttttgcaatctactcatctgacaaagggctaatatccagaatctacaaagaactcaaacaaatttacaagaaaaaaacaaacaaccccatcaaaaagtgggcaaaggatatgaacagacacttctcgaaggaagacatttaggcagccaacagacacatgaaaaaatgttcatcatcactggccatcagagaaatgcaaatcaaaaccacaatgagataccatctcacaccagtttgaatggcgatcattaaaaattcagaaaacaacaggtgctggagaggatgtggagaaataggaacacttttacactgttggtgggagtgtaaactagttcaaccattgtggaagacagtgtggcgattccacaaggatctagaactagaaataccatttgacccagccatcccattactcggtatatacccaggattataaatcatgctgctatagacacatgcatacgtatgtttattgcggcactattcacaatagcaaagacttggaaccaacccaaatgtccatcaatgatagactggattaagaaaatgtggcacatatacaccatggaatactatgcagccataaaaacggatgagttcatgtcgtttgtagggacatggatgaagctggaaaccatcattctcagcaaactattgcaaggacaaaaaaccaaacaccgcatgttctcactcatagatgggaattgaacaatcagaacacatggacacaggaaggggaacatcacacaccggggcctgttgtggggtggggggggaggggggaggggggagggatagcattaggagatatacctaatgttaaatgacgagttaatgggtgcagcacaccaacatggcacatgtatacacatgtaacaaacctacacgttgtgcacacgtaccctagaacttaaagtataaaaataaaaaaaaactaaaaaaaaaaagaagaattaatttgttctttagttcaaagactttcttacagacaagagcgcagtcatacatttgatatcagttcctactgttttctgaaaattatatagcatattatgatttaagatataaaaggggagactgctccttaggacttgcctggacatgagatctttggcatagacttggtacctaggcttatggtgaacctagaaatgtggaggtgccccgaacaaaaggtagcatggaatgaataagcaaagtctttgggaggtgaggatttttcttggccctctagttgccaggttcccaggtttaaccccccgtgttcttagtttcagagcctcagttgaatggggtagagatgctttcccagaggcccagaataccgactgtctttgagaggagaagttgtactgtgtcagtccctacgtcattaggatgtgtgtgtcatctgggtggtgttttaatttaacactccattgtacacaatagcaataaataataaataaaatctgttctgcttaagcaaaaaaagaaggcaaacatgaaacttttcttaatttagtaatgttagaactatggtaataaaatgattctctgagaatccaaccatgaagttaatgaacacaaatgaattaaattataaaaagtaagagaaatttattgttggagagaaaaatgtcttcaatttggtcttggagagatgaacgtctccagtttgttaagacttcactcaacatgagtgaaaaatggagtcaattgcaaagaggtatacttagtggagaaaatatagaaatggaagattgcacatgcaaaaatgcattggtgtcacccacgcaagcattttgcagatgaaaaatgttccagttcctggatccaattccaatcatattcatatggcaagaaaggaaattttaagcaaagaagatatgttctcataattaaggcctcatagcccccaagtaaactgatataatgtttttcctatgtactgagagagggtgtcctagtcatttcaattttaaatagtctagcctttgggagaattattttggattgtgaaataagaagtttgtattctggtctttgtagcaatttctgcaggcacgatgtgctaaatattccctagtttttcagagagactgacttttatggtctgtgttacctgaattctttgccctttggattttggttaaatttggtcaatatgtggtatcagcaggagatcagagagcaagaagagaaagtgggtgcaaatttacttctgcagcacctttctgctaggttccaggttggcatgtgttgcattttctttctaaagccaaggctcgaagtagaagaatcctgttcatccacaggtctgttgaggttctgaaaaccact

SEQ ID NO: 6490 - DNA, 3790 bp, artificial
  synthetic oligonucleotide
aactagtcttcaatactaagatgttagggtctattggatatccagcaaagcatctaaataacttactctcaattaccttcatttctgttttatttggtgaaggctggataagctaggattaaaaagactgattgtatgaaactgcttctcaactgaggtgtttttgagaactgcctctgttcactgtcatggtcttaaaggtgattatgtgtcatcagaagtttctgttagctgaagtctgtatcaaagagactgttcttcgaagtactagtactgagggtactgcctttttcctcaaagctgtgaaattgtcttttgtcatcaaagacaagaactctggtttttatctggtggcagagcctttgggaagcatcagagtaaactgaaaaaattatctggagatgacaggttttaatttaacagctcatcaataataacaataaacaaacctaattattttaacacaatgctatccataaagtgaaagaacaaatatttgtgacattccaggaattccatggaaaaccacaaagagtgttatagatgccaaagatgctgtgaaagttttattctttatatcatttttcatagagaatttaatttgggaatgtaaaattttaaagttgactagagttttatgcacttgagatgggcagaactcaacagtaggtgtgtgggtagaggaaacatccagactaggtgtaaactcgttgggaagtccataggtaggtggcacaggtagcctaaaggaggtattggtaattatgcatggttagagctagtctaagagagacatagcaggaagtgcatggtttgaggaattctccagccttgggaaagatactgcaagaaatgtatgagtagaaatattatatagcttaggggaaaattcagcaggagatgcacatttggaggaaggagtcagtctatgggaggccttgatgagaaatccatgggtcaagtgagcacccagcccaaagaagaacattagaagagatgcatgggtggagaaaacatccagcttagtaaaaataaaaaaaaacccaaaaaacaaaacaaacaacacctcagcacgaagtgtataaacttagatgagagttgtgcatttgatgctataggttgaggttgcagcatgcctaggagagaaattatcagatggtatgtcggtggagggagaatctatggtggaaaaggtcttggcagagagtgcattattggagggcacagcaaatctagaggaatttctggaagaaggtttattgttgaaaggggcatccagcctagaaaaggactctgaagcagttgcattagtggaaagtgcatacagtctaggaaaaaggtttataggtggaggcaaaaggtttatagatggagaatgtagccagtttaagtaagacataactggtggcacatggagagagggggtatcaaagatgtggggaagaatgtgcaagagtatcatcggtatatggaacattcagcctagataagcacccagaagacgttttatgagaaaggatggagtcattctagggagtcttcttaggaggttattgggtagaggtagcaatcaacctaaaagaggactcaaaagggtgtacatggatggataatgcagctagcataggggagggattcagcaagtcgtgaatgggtcaagatggcatccagcccatgagaagagtaagcaggaggtatgtggtgatgggagtatacagcctagaagaaaaacacacaggaggtgcatggatggaggatgcaaccagcctatagggggacccaatatcaggttcagtagtggtgagtacagctggctttagggaaagcccagcagtagctgcaggaatggaggaagcattcacaggaaaggaagaactttcagcaggtaaatattggatgaaaaattataaatctatcctaagagaacacatagtagaaggatcatccagtgaagggaggaacctacagcaggtgcacggttgaagcaagtggaaagcctggggaatgacatgagaagtagtggagggatgagtggagggatgcagccaaaacaggaaaggaattagctgaaggggcaaagattaatgatacaagcctgctggatgatctgagagaaagtgaatggctagagggagaagtcagcctgtggcattgcatggcaagatgtgtacagatggaagaggaggaagtcagcctgtggcattacatggcaagaggtgtatagatggaaagtgcagaaaggctatgagaggccacccagactgcttatggctggaggattcatcaagtctaggggtggacttggcaagagataatggatgaagtgtacatcaagtctagaaaagaacatagtagaaagtggataaatgaagtttgcagtgggcctagggtgggatctggcaggaagttcaggggtggagttaacacccagtattaggtaagacttgggaaatgggggagtaatgggtaatacagacagcttgaagaggaaatggcatagagtgcatagattgagagtatagccagtttaggtgaataatttgcaaaagttgcattcatttagagagcatccagactaaagggaagcttagcagaaggtgcatgggagggtaggggaggatgtcacagaaagtgtatggccagcaacaacatcctttttctctctctgcttctccttgtgagtgaccctctgtggccctatgtgacacaccacgcctcttgtcctctggggaactgtgagtaataaacacttctttcaaaggcagttatcttcttgtctatcatcttgccatacctaattataataaaacatatctcgagtacatttttaaacaattggtgcattgagcagggtagtttggtgattggtgaggatgacatgcctctagactgctcttggcttactaactgaatccaacagagagtaaatactgcctggaatggcactgctggcttgtattttagcagctgccattgtgttgtgactgtcaggtactgctctgattctccagtctaaattatggtagagttcaaaaagctgagtcgtccctgagcaactgtccttagagtgctgtagtctgggtaaagaagtctccagttgacttcttatgtatttacaatgtgtccagaagtgactatggtaactggctattgtactatgtgaaggttgtccagaagggacaatagtgtgaaatagtgtatcacaagaccaagagctttgattttagaaacaagcataagaacaaaccaggcagtgccacagttgccctcatggaactagactccaaacctggggagactgactgggacaccgtagaacaggagatgccacctataggcaggaccacaacaccaaaacactgccacaagtagtaaacaaccaaagaataaaaaccactggaaagaggagcgaataggaaaacaaggcagagactgagttgggaccttttcctaatatgcagttaccaccttttgagacactataggactctaaaacatcatccccagacaaacatatgtattagagacatgggcatctctcatgaaaaaaaaaattaaaatgggccagcctgcttattataaactccaacaaccaaaaaacctgctagatacctttgaaactcatgcagcaggggaagttcccctctctttacttcaatttggtccaaaatagtggataggagatgccccactgagacgaagaaaggcacttccagttcctagttaatgggttcctaatatcatgtcctgaccttcaacaatggcagccacctaactccctcctgaagga

SEQ ID NO: 6491 - DNA, 3127 bp, artificial
  synthetic oligonucleotide
tcataatgttttaaatcatccagaaatgctcgaagggcagacaacttattctgtgtgtgacacttataataacacaaaactttgatttcttaaatatgatttctaactcaaactcctttatttactctggcaaaacatataaaaataaaacaaagttaaattaagtgaccaaaaaagatgtaaattgcctgtgttagataatatttaaaatataacttcctgatgttagaatgccctaacttgagaaaggtgtctgaatctgctataaagaaatacctgaggcttggtaatttataaagaaaagggatttattttgctcactgttcttcaggctataaagcatggcttcagcatctgcttctgctgagagcctcagaaagcttccggctatggcagaaagtgaaggtcagcaagcatcacatggtaagggggaaggaaaaagagaggggcgggaggtgccagacttttctaagcaaccagatctcacatgaactaatagagcaacaagcaataactcactaattaccaaggaaagggcaccaagccattcatgagggatcctcccccattaccaaacatctccctttaggccccacctccaaaattagggatcaaatttcatcacgagatttggacgggacaaaaatccaaactatatcaacaggcaaattagtagatgaattatttaaaagcttgctatctctacagtttgatgcttttagataggatttaatcaatcaacaaatagttatatccaaagttacttagactagtggtctttaaattgtggttcttggaattttgagatttttcacaaggagatttagaaatttaccaaagaggtagggatacaaataaccaaagcagcatttatttaaaagtttgcaaattcattggattacatataaaatttcgatttaaaggtggaatatgttgctgtaaacatttggataccactgatttatgcgtaaacaatattttcaattatatagattaataaggtaattgattaaaaataatatctattgtatattgggcatttattaaatcccaggcactgtttgagtgcttaaggtgcactaacttacttcatcctaacaccaatccagtggtcattatctatattttacagatgtagaaatgaagacactggacaattaaataactgttccaattagtaaataaagaaaccatgaccaaactcagactatttagctccagagtgttcacttttacctatgacagtaatttactttcttaggacctccttaggataatggacatttttgaaagctagacaaaagtgagaaagtagaataaattgggtttctgttcagaaaaacagcactacaaaagtggcattaaaatattcatctagtaatgaatgtaggataaatatatgatagcagagcctaggtttgggtatttgggcttattcattcattcactcattggacaaatactcaatgagccagtcactctcatttgcacttaggttacgttgatgaacaaagcatacagaaaattctgtcctcttggaccttgccttctaatggaaacagagactagagtagtttcctgggcttaagggcctggcctaggaagttagcaataagcctgtgaagtaaagaataggttaaaactatttaaacaatttttttgtacctaaaagttatgacaatggtagaaggatgggaaaatcagaaaggaggactagttttggaaaaatgaattgttttgaatagctgattttgaagaaatagcaagacatccatttgtaaatatttagaaggcagttagcaatagaaagctgagctttagtgagattaaactacatagataccagagtcattaacattattattaggtaatattcatcccaatggcaagttttagttggaatcacaaaatcgaataatattcttatggagaaggaaagtcagcaagccaaacactgaagatttgtgaattctcaaaataataggaaaggagaagtaaaaaagatgcattcaaagtaacaaactgatttgctgaatatgtaagaggagtaacaaggtagaatatagtcacaattcaatgtaaatgtaacagtcaactacagtcaataaaatatcaaaagcaatggggattttaaaataaatgagtcagaaggaaaaccttttatttgggaatcctaaagacattattgatgttcaaaataaaatcttgctagaatgttgaatgaaatcagggtaaaatgagaaaaaaaaatgcataaatgccacttgttttacacatatcctagtacaagctaggggagaagtagattattaggaagaaagatctcttttattttggtagtaagggcatcaagaacagaaaagtatttggaaaccacaaataagctgatgattacagaaaacattacttagcttttaaaaagctgtgaaacaaatagcttactaagatgcagactaattccttagtctttccactactatatgctactaccaagagagtaacagaaatctgtcacatatttataacaatgcttgctcattttcccagcaattttttcttaatctactgccttttgcttccttgacttggcaatacaataggattttagtgcagggacaatagagcaataatgctagactcatttataatccaaacttttcaaacattttcccacatgaaaagcagttaggattaattaaaaagaaagcaaagtgataaataagaaatcttcctcttataaagacttttaaaaacctttgttctgaaaagcagatatgaatcactgacagcatacattcagatattagctaggtgcactcaagctttcttccagggtaattctgccccctacagtcttatcaaatgaatgaaggtgactttagcttgaaagaaatctgctaagtctctgatttaggcaggaagacaatatttggttcataaaatatccctgacctattaaatttgaggaccctctaacataaaaggtaacttcacagaatttaacaagtgggcatatgagtggctgtgtgataaccactggaaaacaaaattaagttttatgaaaatctaattttgttctctagtactgaaaacattattggtgacaatgttgaattttaccaaagcc

SEQ ID NO: 6492 - DNA, 448 bp, artificial
  synthetic oligonucleotide
tatcactccccagatcccatcacatcataagtcacagctcctctatctctgcatttacctaactcctatttctaatgaataagctcttagcctttaatatgcctcccgctgtttttgctgctgctctaaaaatatgcctttcttctgtctctgtcgctttgtattcaacacatttgtaaatttacattatactgctgagtgggagacgtttttgtctactttcaatactacaggtcttttatcttttgatctttgcccatagagctgtgacactgggctaaatcctgttattccagtatacactgaaattcagtgcttgtatgtgtcaactacattaggctagattatgctacagtaagaaaaactccttcctcgttgcagaaaacaacaaatatttatttctcacttttgctacattgcctgctacattattttgttacatacttgc

SEQ ID NO: 6493 - DNA, 402 bp, artificial
  synthetic oligonucleotide
aacaaagcaaatctgttttctacctacataccaaaaaggagaatggaaatcttaagaaatctgggctttccttactcccagtcttcccaacaaccagtgaatagatgttatattttagaaacatgaagagataataaattctttcagcttttaggtggaagagaagactaaaatcttgagtttatggacttgaagggctcaaaggtagatgtggcttctgtgatacacattgggaagtggtctctagtggaaaggtatttttgcccaggttacacacaacaacccagtatgtggccaggtcactaatgtgatagtgggtgaatgcttgaggtatgaataccaaccatcaatggacccaaagaaggttctcatggtcaaatgtggcacagacagagtggagct

SEQ ID NO: 6494 - DNA, 1777 bp, artificial
  synthetic oligonucleotide
gataaaataaaatctatctacctacctttggatatagcaatcttttatagttgggatttgtaataaaatatgaattatatcaatgtgaaattggtcaccagaaagatctttttatagtagacctcaagatcagatcaaagataatctttattccttttttttaaagataaaaactacttagctgattttcttctgaaaaaaaaatctgagtttatttcaaaaaacctttcatgacacaaacccataggtacattttattcaattattcatgtattatcctatgccagtaaaagatctaaagatgtagcaagatgctaaatgattacaaaccacaaaaatgtcataagagaaatcagggctaattaaatttacaactgattttaaaagattaacagcatggagctgtatatgttacactgggatatttctaattacaggaaagcatccaaatcaatagatcaaatacccatatttgctgtttccaagcaagaaaagacaattgcaaattcattgtcttgaaatgcttttaaacactgagattttacccttaggttaactgtagtttatgtctgaaagtgtaaaagttctgtttctgtttcaggttattcattttgtaataaacaattttctcccaaagcacagggcttcccatgggtagtactcacattatgattgttgaagtcacgtacatcaaccataatcagtcaaaagcattgttccttgaggaaatgaattaagagtatgcagttgtgacgggagaaaaaataattgtcaaagtttcacattgctatgactcctcatcaaatgatgagctgagactaatgtataaaatcaatctaatgaagcacaaacttgtattatcaatgtacattataatcatctctgtcttcaattttaaaaaattctgattacaacgtaaaaaaatcttcaatagcgctacaaaaatatgtttaaacaccttacataaaatttatttttatatccctcgaggcattgttacaacacgctcttgttgtctaaatttcccctgacatttaactaggtctagacacaatctaaacaaatttttaagtgtgctttttctggtattactgtttgccccaccacattatatttttgctgtgcacaacaagtggctacaaaagaaaaaaaatctttagtaatagtagccaccctttaactttagaattaacaaaacaatatcaaaactgtaacatatttatatatatacacatatgtgcgtgtgtgtatatatatatacatgtataacaaaaatgctggttttataaatgtacagaaactaaaatattcaaagcaaatattagtttatcctttacttgagggactctaaacccttaaaggaaatgacctatcaaaaatacaaagatatatattgaaaattagataacctgttggaccatctatatattactctttgtaatgagtgacaacacaccccacctgatttagattcctaacaaaagctgaatttcacagataaaaatataacaattcaattattgcatttttaaagtgactctcaatagtagaatctagtatggaatgttacatatacgtagattaatttttctttagatatgaatttaaactacccatttccaagacacacaaatttgcatgaatgtcgttttcagaatatctttgtggatccttttcttatttcccccatgttctggcaagtttagatgtagcataatgataaatagaattaatttgtagaattaattcctaaattaacacattttttccaaaacaa

SEQ ID NO: 6495 - DNA, 1097 bp, artificial
  synthetic oligonucleotide
atttttaaaattttacttataccttttacaggctcattagtgatattacccatgtattcccatccccagtaaaacaaaattaattgtaatgagtaagacttgtatacattatacaagtaaaaaattaataggaaatagagttttgtaagcaatatggtggaataggaaggcccagaccctcatttctcccatggagacactaattcaacaacagtacatgaaaccaattttctgtgtaagaaatccagaaactagttaagagatttctgcaacccagaagaacatgaaacaaaacatgtggcaccctgtcatcatagcccctcccttcattatagtaccacatggtcaaaaagaaactcctagctccagattctccttgaggaaggaaagagaaaacttgacactatcttcttatgttatgacttttcaggggtctgtcaaagggactggtggctgtttcatcggtcttagagcaatgaagcgacccagcatattctagatgcttggaggttgttgagaaccgaaaagaaactggtgatatgttgcttctccagaggaacactggtacagctgacagggtgatacagctcagaagcattttccttagaaagaaggagaagactggagcatgtgcacaacactgtagcttttcaggaggctgccggaaaggctgatttctgtcttgcctgtcttagaacgcacacaggacctggactactctaaatgcctaggggctgctgagacttgaaaagagctgggtggtgtgccgctgccttagtggacctgcagtacagcaaatagacaccagagggagcacgagattacaagctcttgaaatacgaattctgcaaattgctctaaaggaatctacatgcgcagagaagatacatccacaggagaggtctgacaagcccccagaatttctagttgggtgattggtgaaggttttccctgtacaaagccagtttgtaaataatgttagaggtgtttgcttttttcaaatgcaaggataacaacacaaagttgtgaagaatataaagagggaaaacggctcaaccaagaaacaaaatgaatctacagaaattgatcctaaagag

SEQ ID NO: 6496 - DNA, 1032 bp, artificial
  synthetic oligonucleotide
actgatttgcttatccattccacaaattaagtacctactatggagcagatgctgtcttggttctgggacaacatctatgaatgacactgaaattgtccctgctctcctatcaggtattggtattattaaaaactgacgtatttctgagaagtcctgagaattctttctgtagtaggaaacaacgcttgaataatttctgctgaagaacatttaaaaacacagttatgaaagctggagagtaatccatattattgtccttgcttcagtttatttttctattattattttatgcattttaatgtaggtaaactaacttcgatttaggtctttctccttgcacaacttcagggaggactgttcatagaaaatataacttgaaaattgtgtccttgaatttatgcactaaatggtactgcttcaattcatattcttcaattcgactagtaattatttgaaagatttttaactttataatttgaaagaaattagacttatatgaaagttgtaaaaattgaatcacatattctaatgtatccttcacccagaatttttttttactttatcttaaatataatttctttttgtctgtattttagagtcaatttctactcagaagaacaagtatataatgaaaaactgttaaaatgtgtgtggcacagaaaaatgattttgagagtaaaatttgagcatggaaaagaagatgacttaattattatacttatattcaagcacaggggaccaaaacttttctcagcaatatcatgtctagtaagagcagaggaaaatatttaaaagcttggacttgggaacaaaatggcccagagtcacttcccatttaccacttatgaatggtgtggccttcagcatgctcattaaccattcagtgtcttaaattccttttgtgtaaagagagaatattatcatatatcatttaaaggctttataaagattaaatgagttaatatttataaagtgcttagaaaaaatgtctggcacacagtaagcaccattaatggcttgataaaagtaatt

SEQ ID NO: 6497 - DNA, 2655 bp, artificial
  synthetic oligonucleotide
tagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatata

SEQ ID NO: 6498 - DNA, 3148 bp, artificial
  synthetic oligonucleotide
accctagtagacttctgacatatccattgttgctttatacttcggtctggaaactcagcattggactgctgattatttcatcccatcccacatatttcatctttgattaggtgaggaggagggacctgagctcgtgtctcatggtccaaactgtatgtgcgaataaataagttagttatctgccccaaatcatagtaccttgctacttctccccaaccctcaacttcccaagtaatacaaatatttagtaaaagataagtatactaccaattatgaagtacttacctcctaaggttaattgtgggagctcaataaatgagtatatataaatttctttttttacatcttttattttattaatgtttttaaaaaattcaaattcaatagtctttggaatacaagtgatttttggttacatgaatgaattgtatagaagtaaaatcagatattttagtgcacgtgtcacccaagtagtgtacattacaccccaaaggtaattttttatccctcactaccttcccactctgccccttctgagtcttcaaagtccattctaccactctgtctgcctttgtgtacctacagcgtagctcccacttataagtgagaacatacagtatttggttttccattcctgaattacttcacttagaataatggcatccagctccatcaaagttgctgcaaaagacattatttcattattttctacggctgagtagtattgcatggtatgtggctgaatagtatttcacggtatatgaaaatatatgccacattttctttatccactcattggtcggctggcacttaggatggttccatatctttgcaactgtgaattgtgctgctataaacatatgcgtgcaagtgtctttttgatataatgaattctcttcctctaggtacataatcggtagtgagatttccagatcaaatgttagatctacttttagttctttaagaaatcttcatactgttttccatgtaggttgtactaatttacaatcaccagcagtgtacaaatgttccgttttcatcacattcacaacaaaatctattcaaaacctctgggatacagcaaaagcaaggctaagaggaaattttctagcaccaaatgcctacatcaaagagcctgaaagttcacagtctgactacctaacatcacacctgaaggaactagagaatcaacaacaaagccaacacaaagctccagaagaaaagaaataacaaagatcagagcagaactaaatgaaattgaaacaaaaatataaaagatcaatgaaacaaaatgttgattctttgaaaagataagtaaaattgatagaccagtagttagattaaccaagaaaaaaagagagaagattcaagtaagctcagttacaaatgaaaatgcaaatttcttaaaacagcatctggcagtgttccacaagtatgagtagtagtagttgttgtcattattagtgtacctctatttggcttaagactttaaatgcaaataaaatgaccaacatagaatctgagccatgctagtgtctctctggtggggaatagacccacccataaattagaaattccttcttgagaaattaccttctttaatttcaggacttaaagtatttaaataggcagtgtcattagcctgctgatgaaatctgaatcattatttcagcatagaatccatggttggccatgcctatccctgagtacattacatatatttactttttaaatgctttttgttgtgaaacataatatagggaaccattcatataaacccatggtgaccatcacccagaccaagaaataaaacttccagcagccaaatggaacactctatatcatagtttcaagattaatctacctctttgcttattagttgttgattaatttctcactgtatgattgtcttagtctgtttgtgctgttataacaaaatgcctgagactgggtaatttacaaataataccaatgtattcactcacagttctggaggctgggaagtccaagataaaggctctggcatttggtgtctggtgagggccttcctgctgtatcttcacaaggcagaaggtagaagggcaagagagcaagctgactgaatgctgcgtgaagccttgtttataagggtcttatttttattaacaaagaaggagccctcatggcctaatcaccacttaaacaccctacctcttagtactagcacattatcgacacctgaatttggaaagagacacattcaaactatagcaaattttactattaataaatactgaagtagttttggtttggggctattactatgctgctatgacattcccaaacatgtctcctggaatatgaacatatgcatttctgtagagtgtatatatagaagtgaaattggtgggctataggttatgcagatctttgaatttactaaatagtgccaaatggatttcactccaagaagcagtagtgtaattttacacttctatttacaattcacagaccaagtaacattgtgtgaaatttctaattgctgtatattctcaccaccacatggaattgtcagacttataaatttcaatgattctggttggtaagcagtgatatttcattttagttttaatttgcatggcctggaccattaatgggacttagaaattctttatatatttattggccgtttggatttcttattttgtaaagatgacaaaaatcttaacgttactatgatgcataaaacacattagttatttactataaagtgatcaccttaaaaatgccatccaggtcaagatacagaatattgccagcaggccacaagccctttttgtgccatggttcacttttcaagaacttttcccatttttctattggattatctgttcttttctgaaagatttgtaggaattctttataattatgaatacacacatttcatccattatgtgtgtattccaaataatttatcctactctgtgggtttcatttttactctctcagtgctgtcttttgatgtatagatgttattaatatacaaggtagtccactttattatttttattcatgattagtgcttcatcatttgtgtaagcaattttttcttaccctatattaattaacatattctcctctattttactgtaaaagctttatcaatttg

SEQ ID NO: 6499 - DNA, 246 bp, artificial
  synthetic oligonucleotide
ttctatatttttcaatttgtctacaatgtgcttttcatattgagagtcagaaaaatgaaataatttaaaatttttttttaaatggcagtctcatatgcaaatgactgctaactccaaccctcctcctgctaccacagtctgagaaacagtcagcagctaaccagagcacagagaagtaccagttggtcacgacttaccactccacctttgtagcaaccatcagtctccactcttggtttgctgttt

SEQ ID NO: 6500 - DNA, 1018 bp, artificial
  synthetic oligonucleotide
tctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagccca

SEQ ID NO: 6501 - DNA, 961 bp, artificial
  synthetic oligonucleotide
ctgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataaccta

SEQ ID NO: 6502 - DNA, 1868 bp, artificial
  synthetic oligonucleotide
atataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaactta

SEQ ID NO: 6503 - DNA, 972 bp, artificial
  synthetic oligonucleotide
ttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccct

SEQ ID NO: 6504 - DNA, 1651 bp, artificial
  synthetic oligonucleotide
taaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcc

SEQ ID NO: 6505 - DNA, 1423 bp, artificial
  synthetic oligonucleotide
aattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatcttt

SEQ ID NO: 6506 - DNA, 1717 bp, artificial
  synthetic oligonucleotide
ctgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttcta

SEQ ID NO: 6507 - DNA, 2855 bp, artificial
  synthetic oligonucleotide
aatctagacaccactactcatgagacataatgcatatctaaaatgtttcaatgttttgttttactaacactcatagtggagagatcaatcttacataagtgtgctgacagaaatgaaagaagagattttaaggcaatttcagcaaggtcaggatatttgtttttaacttttattcaacaaagactaagcaatactgtattttcaaaacttatattcaacctttcatcagtagccagttctaacggttaatcttgtaaagttataattgaacttacattatcttttgatgaaaaagatggattaaaaagttctatgaatttcctgtgtatgaattttcttttgaaggaaaataaaatccaaaatgttctgtcaaatttgtaaggtattcagagaaaactttttgctgatatgatattaagataattacctacgtcaatgataattgttaaattgtggaacatgtcataatagtctataaaactctgttctttcaagattctaactttgttgttgttcttagatattatctgccattgaaaaatatgttgtattacttccttacatgggctaagtacaaagcttagatcataaatacgctgaaaatataggacaaaaaaatccagctggcagtctaactcatatctttaaaagttaggttaaactagttacttatcttgcagaaacactgagaatatattctgtagttcaaacattctcaacagaactttcctcttgataatcatcatacccagcatgcaatatcattgtttatattcagtttctatattatcacaaaatatagagaacaatctgaaatataatgcattcgcttctatgtaattctcagattttaccacgtcagtgtgcacattggctagttcagctaatatgatttttgtggctagattttcttgatgaaggaaagagcattgattgacgttctggggacaccttaatctgagtaactactcagaatgttttcctgtaattgcagctgagccatcagaacattacttccacatgaaatttaaacatcaaaccatattcgttgacagataattgtcttcatagttttatacagttaaatgctagttgtgtttgtcagcaatagggttggaaaaaggaattctatcttaatattaccattatattggaattgtccacatactaaaaaattactgtattaattctctgttaatactatcgagttgcagtggaaaatgctttgcaagctttatgtgcttttttgtttttgtttgtttgagacggagtctcgctctgtcgcccaggctggagtgcagtggtgctatctgagctcactgcaacctccgcctcctgggttcaagaaattctcctgcctcagcctccccagcagctgggactaaaggcacgtaccaccacacccaattaatttttgtatttttggtagagacggggtttcaccatattggccaggctggtctggaactcctgacctcgtgatccacctgcgtcagcctctcaaagtgccgggattacaggcatgagccaccgcgcctggctgcaagctttatgttttctctgagttgatcatccataaactagcccgtttctgtcattggaaagtggtatttgagctaccttctttgcaaccaaatttacccagcattttcaagcgaacctctttcttgcttctttcattaatgtcttggcaattgtatacggatttttagtcttagcaaactgaagggctgttttataagaagcctgcacagcactaatgcttctatgaaacaaattgaacattgaacatctacttctgtcggcttttatgtcaatactctttctttcaaggattatttttgtttgtttggtgaacttttcttttagtatgtaattgctgcctacattttgatatatcttactggttcttttagctagaaaatctccacaagcactacaccccgttttaagtactttaccatcagttatggctacaaagttgatctcactatttgaagaaaaatacttctgaataaaactagtataaattattttggccttcattgttcaggatgcacgttggtcacggtcatttagtttactactgctgctgtgggcatacttgacgaaaaaagtccagtgaagtttattttgccgagtgtcattcattcagggttaaaacaaatattctataaaatttgtttctttaatttagttgataatgttaatctctaaaaattaaaacaattataaaaacaaaaattattaaaagaaataaatgcctacattttctttgatttttatacactttgagttacagttgacaaagtaaccctaaaacatgatgtattgtaatgtggtccttctgcagtgcatgacttgtgggcaacttacaccacatgtaactcaccaggcaagtttgacaacatccaaactggtccatgccctattcaatgagacaggtacactgacttaatcttccttggatattgcagcaatatcaaattgttaaaaaagtttccaaacactttctctcgatttcacttatctgaaccagctggtaacaaacaattcacgaaacagcaatgggctggggaccactctttaaaggacaagatttggagtctagaggtatttgatttgaaaactaaattttattacttaccagctatgtgaccatggacaaaacttacaatctccttttctcaaaaatgaagataatattttccatcacaaagagttgttgtaaagatgaaataatgcattcacacatttgttcattgagcaaatatttatcaaacctctacgatgtgccagaaaactgttctaggatcttgagttatatcaatgaacaaaacagacaatggcaagag

SEQ ID NO: 6508 - DNA, 1144 bp, artificial
  synthetic oligonucleotide
agttgcaggcaggataaccaatatcctaccaattttttagttagatcagggctaatggaaaccaacaaagatggtccatgatatggttcggctctgtgtccccacccaacccaaatctcatcaccgattgtaatccctacttcttgagggtgggacctgatgagaggtgattaaatcatgggggtggttcccccatgctgttctcgtgatagtgagggggttctcaggagatctgatggtttaaaagtggcattttccctgtgcactctttcctgccaccaagtgatgaaggtgcctgcctcccctttgcctcccaccatgattctaagttttctgaggcctccctagccatgcagaactgtgagtcaattaaacctctttcctttataaattaccccagtctcaggtagtatctttttagcagtgtgaaaacagactcatgcagtgcagaaccctagggttagcaacagttgaaagttattctttaacaagaaggtagatggagaaagaggctgacaaatatacacaggacacattatcttgtgtaccaaattactgggcccacttctgaagtggatgacctctggtgtgcatttatggggaagtaaatatctccaaactttccattctgagaaccccattcatatccttctcccttgttctctttgacataaatttttcagttttattctgagtctctgaacagtcagccaacttcttagtcaatcagaattactgtagattctgacttatcttaggctgtctctcctgctaaagtagtggacaaccagatttataacctgaagttgtgccctctgggagaattacccttcaccaacacctttcaaggtcacctatgtgtagggctatatattaataactattgacttctagctagtgctagcatgctatgcagatccatccataaaccacgtctgaacttttacctcctccattatctggtcaaaggaaacgccctataaggccataaatgtagataaaaggcaatatggcaaagcaataggaccaggtaccatgggagtataaaccagcaacttgagcattttatttatgccttttctggatttgcttgggtccagtcttgtatacaccatttctattttacatagaatgctgctgtgca

SEQ ID NO: 6509 - DNA, 1363 bp, artificial
  synthetic oligonucleotide
tttcctgttttgttttagctgttgtttactggctgtaggaagagagaactgcccctaatctccgtgtggttgttaaattaatggccctccacacattgcaactctctctccaagccctggtgtatttcccccacccccaccccacagacactcagcttggacatgtgacttcctttggccaatgggacattagcaaatgtgacacaagcagacgctagtcaagtgcctgtgcattggggcttgccttcttttatgctgctttttgaatccaattttgatatgaacaaatctaggctgatcagctagagacatgtggcccagcccataccatctgacagacatatgaatgagaccgtcttagaccattcagtcccagctgaggtactaggtgactgagactgcagaaggcaagaccagcagaagacacacagagctgcaccccttgtacctctcccttaatcatgctccccagcaagtttctaatcctggccacagccaactatcttattctgcatcggtactggagaagctgagctttgctgtagaaaatgaccacaacccatccgagcactctcaatttaaacgtgttaccacaaatctctaataggccttcagcactcctggctattcctattatgtctctcttggaaattcactttccatatctgagacaatcacttcacactttcttctttctccaacaccccctcctgtagtgacactaattttaagtataaagttcaatgagttttgacagatgtatacacatgtgtaaacaccactgtgatggagatatagtacatttccagcatcccagaaagttctttcatgcctttttgtagacatatgttttcatttctcttgagtaaatacctggaatggaattactggaccaaagggtagtatatttctcagatttaaccaccaaatctaagaactagtgagttctgccagcatcacagaggcagcttcccagcgagtttcaccagtaccttagcaggcagctttctagtcagtttctctggcccccagacactggtttcacccctccgtgagcttctctgccctccacggggctacagccacaccatctccaacaagatctaaacctccgccctggtggtaagaatgtgccctctttcaagtttgttccttcttagactgctctccctcagccctagagatagtggctgcttccttcatctgctattcctgtagagttagtttccatctcctagtagttaatcctgttactagttaataggtatttatattaaatcttccctgttcaaattactggtgtgttttcaatcttctgactgaatcctgacaaatatagtccaatcatcaattcttttccact

SEQ ID NO: 6510 - DNA, 548 bp, artificial
  synthetic oligonucleotide
aaaagaaaactatgtattcttttgtaaataacattctaaagtgggatgaaaagaagttcctaacatattccaacaacttttatgtaaaacctgcttatgtataattttactaaattttccaattggagtaatgtgcacttaataccccaaatctaacattacgtgttctaataaaggaagacaaatgtgatgattacgtttgagacagcatatttcagtccagaaatatgagtgctgacactagaactaatttgatactgtaaatttctacgcagaaaagatgcagaatgtagtgtttgcttttagtttatttattttgcaggaatctttgactttccgaatatgtactgtttggaggtacgatgcatgcagagccttttaaaatgcctttgtacaatttcatctcaaaatgatttcattcacagcatacacagaaatctaaaagagacatggtatttacaagatttaataagtttttgctgctttaatgaagaaactgatcaattcttttacagtagggaaagaaacatggacattgggtatcataa

SEQ ID NO: 6511 - DNA, 1428 bp, artificial
  synthetic oligonucleotide
acagacgtaagccttgacttcttttctagttgcccttaattattgcttataggaaattgagttacattatttctttaactagctggatgttttaaaatggcactttaaatggcatgtttaaaatgacattttgttttgttttttgttttttgagatggagtctcactctgttgcccaggctggagtgcagtggtgggatctgtgctcactgcaacctctgccctccgagttcaagcgattctcctgcctcagcctcctgagtagctgggattacaggtgcctgccaccgtgcccggctaatttttttgtatttttagtagagacgggggtttcaccatcttggccaggctggtcttgaactcctgacctcatgatccacccgcctcagcctcccaaagtgctgggattacagacatgagccaccgcgcctggccttaaaatggcattttaatcctcctgtctccctccctccaaccccatgccttacacacagatacacagttctcctcactagcggttgaggatgtaattttaactgcaaaattcccacaaaatcaactgatcatttttcccttgtttgtgtactttactatcaatgaatttaaaatactaagaaaaagttgataaaacaaacaaaaaaagatatcattgctccaatttctgctatcagcattaatgataaaagtaatttgatcttttgagagttttatattttaaagaactttgtttttgtttcagttaggctgcagtggatttaagccagtttgattttttttttttttttttgagatggagtttcgctcttgttgcccaggctggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaa

SEQ ID NO: 6512 - DNA, 2175 bp, artificial
  synthetic oligonucleotide
catgggggactctgaagacacaaactggttagcccaccctgtggtaagagagccaatttttataactttgtgtcagcccatcattggtcattagctgtccctgggggatggaagatatataacttcctgaacgaagctcccttttggcagaaaccagtgactacagttctatagagaagagggcagctgtagaccattagcagccaatacgctgagcatctgggggatgggtgcagcatcacggtgaaaggaatatgtgtgcgactcagcatccactacaacccgttattatacatacagtgtttgcctaactatgatccagggagagcgctagagaataatacagcatccgtgtcacatagtgccaaagaaaaagaaggctttggaaaagcaggtaatttttaaggaacagattggggtaagaacatcatccatggcagcataacgccgacattctttcatggagaaagcatggtgatagcagctcccacaagatcacaattctctgcgccacccctgttgtatctcccctggtgttttctgtctacagatcaaagcaggaagtgttcatgatgctctcccagtgtcttgaaaagccccaaaatagcatccttaccagtatctcagacagggagtctgactcatcctggtttgcctgggagtttcccggttttagcagagaaaaatctcacatccaaggaaaccccccagtcgtgaactggtgacccagatggaggatttctatcccctagatggcctctaaggtgaaaaagtcaactgattgcactaaacgaacttggaattctttaggtattttagtacaaattcatgctgcgtgccaagcaaactttagaggagatgctggagaggagagtaaaaagagaaaactacagataagtaagacaggaaacatagggcaatgcttccaaactgggaagttcgtactttgtggagcagggaagaagtgagagatcattggaagactgagtggtggctgacatgcctggagatgcactttaaggagattaatctgagggtagtatataaagtgtgggagaacagagaagtccaaaattcaatgaagtatgagctattatttctctgcgtggcttttgtctagtggactggaacaagtattagtcacatcttctttctcttggtctcgctctgatctgatcttggaaattccagttacatccaagaagctgaatgtttgcttaatataactctagaagtctgcataagaaatttgagaaaaaactaatttactctagggagagctggatggcttggagagtagtggggcagagagatgattcctcacattccctttggaacttttgaatttcgagctatgtaaatatattatcaactcacaagtcattaatacaacttaaattaaataagaaataatacacaagaaggtagaaacaaagaaagacccaggattaatcagtatgagctacattttagaattctgtattcaattttccagagctgaattgaccaattttgggtctaactgaattccatttatgtatattaatcaccaaataactgatggatttaatttaattttgtaagtaatgtcaatgtgaaattacttatagtcattcttctgctaatttttcctgtgtgaaacaaacaaaacaaattaaaacacacacatacacacaagcagaagcaaaagtccaatttaagcagcatgatgtggtagaaggcacatgtgcttgggagtaggtcaactgggttcaaatcctaattgtcacttattagctatgagctctttgggcaggttagttaacctaattgagcccatttataagtgataataatatctgcctcaaagggccactgtaggaattaaatgagaatctatatgtgaaagttcatgaaaagaggaaaatttcccttcctctgccagagcatctggtacaatgctctacacccagatggtgataaataaacatgagctgagtcataaaataaatgccaacatatgattaattgtttgattataattaatttggcatcaataacatagtgtattatttaaaaaatcaaactcggatttaggatatctggattctggccccaacgttctttgaccttaaatgagttacttaaactctttggtattgaattccttcccctggcatgcttttccttcaaaat

SEQ ID NO: 6513 - DNA, 4694 bp, artificial
  synthetic oligonucleotide
aaccagtgcccacagaatccttgacttaatcaaaactgtcaaggagaattacatcaccatcaatcacataatagatattaatagctaatatttatggagcaactgagcacttgtgtgtcaaacatggttccaaaagctttccatgcttctacacatttaatccttataatatctctatgaagtaggttccattattatccccattttgcagatgaggaaactgagtcacagagcagtgagattacttaactttcccttggttactcctgagtaagaggatgaagtaggaatgaagctcaagctgtgtgggtctaaagcctattctattatttattacagtttactgaatctgaatagactcctagctctaaaatgaaattattgacaattctttttaaataggtaatgtggtaaagaataaagaacatgagttttggagggtaggtttatgtcagatctgtcttttactggctgtgtgacctaaaacagtttacataacttctctgaaccttcctttttatgaaagtctgtaaaatgaagataataatacccacctttcaggattaaatttgataaaacttcttaagagcctttcatgatgccagcactggtggctattattgtttaatcaactaactggatggcagtcaatctataattttctctagccaatagggtaaaccgcaagatggagttataagccaaaggaaagcatgactgaagtaggcttcagttgagttgagatctgcccaaagaatcattcactagtctacagtggagtcatatcaaccatatattcaacttttgagaagttggcttgccaaaataacagacagggaatcaataatttcaatgtatagaaaacctcagctatcttaagcctaggagtcagcatgaaatggtgaatcttctttctaacagtctctgtttcaggtagctctgcctgactgacagttgggagcttcttgcctcaataagtgtggttatagcaaagctttcttttttgtcaaacataagcaagttatttaatcttcttgtgcacatctaataaagagtaatatgttccaatattgggggacaaactagcgttggactcattatagttacaacaggaaacaccatgatgatctccaatggggatgtcttccctcaggaatttttaagggaaatatttattacagttgattttcattttatgagcttctgttgtgatgccaccatatttttgacatggttaatttatgttttgggtttgttttttttgacccctgcctttcttgaagaaacttcagtcataaagcctttgggccacgtattggaaagcacgttggcattcaaataccttcatgataaaatacaaaataagtaaatctgttccaagattgttactttatattttttctcgtctgcaaacattttcaaagaaattatcttttcacagtgctgcaaattctccagtagtatcaactgtatatgggaataagttgttctggctttctattcagagtgtatatggttgactatattcctgattaccctattgtttattactgcaagcaatcttatctaaaagagaaaggggagagttcatgttctcataattcagtttgttgatgcctgaggtttagaaccattccaagggcactgcttgtcagctctctttgaaatgtccaaaactctttcaattgctgtgtttgttttctgtgaagtgaacaaacatatacagattcccttatatatttaatgttgatgtatttggtgcctaatcttgttatattatcaagcaaaccatgggccaggtaacaaggatctaatgtacttgcaatatcaatattcattctatggcttatttttctgagttatataatcacataatgaaggttctttagttttaagcaacagaaataatctcattttgctgaggttaaacagaatttatgtggaaaactatcaggagctaatacaggctagggttttgaaatgggccagactcaagactgtcttccaggctggaaaacaggattcagcagttggggcagtcagaacatccctccttttcatcttccaccccaagagggaataaaatttctatgattgttagtctttattcctctgcctgagatttacactggttcagactgggtcaggtgctaacccattggttgaaggaggcagagcctttgttcagagctcaccagactgcattcagtgtggaagaggtaattcctccaaaaattgttgagtgcttttaagaagaggaaatcgatgctggctggcctaaccatacacactttttctccaaccataattttttttttccacagaagacgttttcctaaattgccatttacttaattcccccaaccctcctcctcaacatcataacaggctaagagtttccttctgttcctcattagttcaactcttgcttgatgtaaatctccatccttggagaaaagaaagtgaagtaaacatagacctgggattgactttctgtgattgaagatcttggcgaaatgcagagagctggagtggggtgcttcatttctcttcaagtctacaattcctgcctgatctccgtacccagatctgtcagtttttgagtttctgctaaaaaggcctgatgggtggaaaaggggatgggctagactagacaaatgtcactagagatcatgttgtcaaaactcaaaattgagacatctggtcttaaaagcacctgattaaatcttatcacaagatcttcaagggcattgtgctctttgttctgggaagtaaaaattgatgctgaaatgagtcagagcagggacctctggaattcagaagtgcccaagtcccaggttaaaaagcaaaggtagtcaactagcaagaccctttggtaaatctgctcctgctttgtcagaattctggcaattctctctggtaactgcatgaggggctgtagagtgatcagttccctgctaaggccagttgaacttgaagggaaggcattggaattggccacagaggtgactggttggtactctcatgtaagtggaatcatgcagtatttgtctttctgtgactattttatttcattagcctgacatccttaaggttcatccatgttgtcccatatttcagcatgtccctcttttttaaggttgaataatattccattgtatgtatgcacattttatttatccattcatctgttgatgaacatttaggttgtttctatatcttggctagtgtgaatagagctacaaagaacacagaagtgctaatatctcctcactccaaagactctgagaccatattagaaggcagttctgaagaggacaggtgtgactcgtgtctgggaaccctcaggaaggaggcactataaaggatctggaggcttacttgaaagtaaaatgccaatggctgacatccctgtggccactggggcacaaaagaggggataaggagaggtaggtttctgtggagtactgggatcaggacatgttgcactcttgggctatttttcaaaggcatcttccctccctagtataaccccacaccaagagttttctattctacttcttatttcttttagacttaatttattttaccttgaatattaaaacacaaaatttcaaaaaaataaaaaggcagaactagcaggtggagatcctctcttaggtaactggactttgactgggagctgaggggaattaccacagggcctcctggagtggaggaaaactgccccatattgcccacggtgtcttcttggactggaaggaggacatctgagaaagccttaaccccagagagattgcagtcttgagcaggtgaggctgaggtccctgttgaaaggaagcaaaggtttcccacctctgactgttttcagcttctgcccatccgtggcactctgaggaaacttgtaaagcaatttcactggggtgcctggcagctgccactattctgaaaaggagcagatggcagattgtgttgaagagtaatggggaatgattcgttactttacaccccatccaaacactccacattctaaggagggaaatattcctgagacaggtgctccaaacataaacatggaggcaggttacaaattttttgatgttttttaacttttctttcatgattttccagtgacaaagttatctttggtctgattgtcagagtaattcaaatgataaattgtatttacctttgaagacgtataatcggagttaccctccctgttctctttttattaatgacaataaagcaatatgatattaatatcttcctgatacattagtgaacaaacaaaaattatagaggaaagtatttttctactcatagtacctgcaatgttataaaactttaaaaaacaaaacttagaaagtattgtggagtagaagaaaatattatcttggtttgacagataaaatagtttcctagagaaaagattatttgaaatggcctagaaaagtatacacaatttttaactattaaatggaattttgggaagacaacacctccattatgagaaaagattcaaaagaaagagagttcttgtttagaaaagaatgtttcttttcttttcaaacattaaaatgaagacaactgcaacaaatgtcatgtggttgcaaatgtttattgatgtgtgttttgacttttttttttttataaatgggtttatagatcccaaagatgaggcagaatttttt

SEQ ID NO: 6514 - DNA, 1736 bp, artificial
  synthetic oligonucleotide
gttgagatgcccctcatttccttcaggtactgtttcaggtacataatggctttggtttaacatgaaagcccttgtttagtacagggaggaggcccagttcctaaaagatggtgacactgagggagtatgaggggaccccctccaagaaagaggtaacacagatagagccctatccccactgagacctgggagatccaggtatggtgacatgatgagtctcactcacttcttcctagagcatctcagggaagtggggaacttcatcaaagggggcagccttatgttagcagctagaggattcctaggtaattccaggagtcaaaaagaagaccctgagaactgggggaaccactcatcccataacagtgaaagaaacacggaattccttcctgattttcatccttgggagatgatggacaattgtagccagatgggaaaagtttcacttcttcctcagggagttgtcggggggtgctttgtatgactggataggcgttagatcaagacagagaagtcactgagggaggaatgagatgagcatttacctagagagtggggcttcaccaagttctaccccctctcagctctgggaaaccccaggcagaagtacccagatgtgtcatcccctcaagactagccctgggtactcagagaggtgaaggcttttgtatgagcctggaagaatcaagtgggattagagaggagctcagactctgcttgagtgaagactaaagagaacaacgaccccagaacagtggagccccatagaggacgtggtgactggatgtgattcaggctttctttcatcttgggactatgaggcaatgagaatcttaatctgatgtaaggggcctcaggtcagtagagagaggatttccaggttgtgccaggcctcatagagaggacttgagggaactcccacctcatcagtggggatccctcagagtccctctgtatgtcagcgctaggaagccccgagcataaatgtcagaaatgcccctaaattcctcttcagaagtaacagggaaatgaaggtcttagtcagatgggttagcaggaggggtgggaggcattttaggccctcccaggagtcaaactggagaccttgagtgaggaccatgagtggggctacacatcacagggcttcaacctgccagccacagctttcagcctctggagaatatgggcattgtgaccagatacagccaccctcatttcctccattgggtctcaggcagatgtaggccttactatgagtaaatgtcctcaggtgtagagagaacagagccctaggcccttctgggagtcgaagtgtgagtgtggactgaaggcaccattcccccaagcccccaacccccaccccaaatagaggaaaaacaacgatgctagccctgtctctgcacttagctctgaaaggccttggccaagggttgccaggctgagactttatttctttgcatcaggtctaagggaggtgacagctttggtctgaagatgcagcaccagttagcagaagacaggttcccagaacttagatatagatgagatgaggactctgaattaagattgaggtccaactagcccaggacagagagagttccatagaactgtcagcactgccatcccgcccagcccccggtaaggatggtaggttgaagcagtgcctcatttttctttggtggattccagggagctttgaagtgtcagcttcagagcagcacaggaaggaggtccca

SEQ ID NO: 6515 - DNA, 588 bp, artificial
  synthetic oligonucleotide
ctcaagcatgacttgaggataagaaaagagatgagattaaaaacaactttgaaattaaggctttaatttgaactaaactttaatagccaaaagtggccacaaagctatgaaatcttcaccggatcatattgctggactggaaaaggaagatctaacagtctgagagaagacagtagttggaagcactgcagccattttatctttgatcccaccgagctgaaacttctcaacaaatataaatttgaggtgaacacattcagtctatagcaaggatctcttgccacgttgtaaaaactgtttacacaatggggtagagaagatgaggctaaaaaatggttttccattccatgccagaatgagagaattataatttcaaatgtaaacaattttcatacttccattgaatcttggttgtctggtcatgattaagactaaaggaactaaaaaactgattggaaagtcagaggctccaccctttgtcccaatgccagagacagttgatgctgttaattcctgagttttttgaggattttcaaggtaattcagcatggcttgaaagtaaaaatatattcttcaaaaaactgtgca

SEQ ID NO: 6516 - DNA, 941 bp, artificial
  synthetic oligonucleotide
agatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttt

SEQ ID NO: 6517 - DNA, 1240 bp, artificial
  synthetic oligonucleotide
accatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagct

SEQ ID NO: 6518 - DNA, 2087 bp, artificial
  synthetic oligonucleotide
cttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaacca

SEQ ID NO: 6519 - DNA, 1370 bp, artificial
  synthetic oligonucleotide
gaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcc

SEQ ID NO: 6520 - DNA, 2409 bp, artificial
  synthetic oligonucleotide
gatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggttt

SEQ ID NO: 6521 - DNA, 442 bp, artificial
  synthetic oligonucleotide
agaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaat

SEQ ID NO: 6522 - DNA, 1113 bp, artificial
  synthetic oligonucleotide
tgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattata

SEQ ID NO: 6523 - DNA, 1371 bp, artificial
  synthetic oligonucleotide
aatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgta

SEQ ID NO: 6524 - DNA, 589 bp, artificial
  synthetic oligonucleotide
tttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaat

SEQ ID NO: 6525 - DNA, 1021 bp, artificial
  synthetic oligonucleotide
tgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctat

SEQ ID NO: 6526 - DNA, 2350 bp, artificial
  synthetic oligonucleotide
tgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaa

SEQ ID NO: 6527 - DNA, 1316 bp, artificial
  synthetic oligonucleotide
tattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattc

SEQ ID NO: 6528 - DNA, 2243 bp, artificial
  synthetic oligonucleotide
agatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttcc

SEQ ID NO: 6529 - DNA, 509 bp, artificial
  synthetic oligonucleotide
caacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggatt

SEQ ID NO: 6530 - DNA, 1302 bp, artificial
  synthetic oligonucleotide
cttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgtttt

SEQ ID NO: 6531 - DNA, 605 bp, artificial
  synthetic oligonucleotide
tttaaattcagagtaaccttgaattaacagaagagtattactcagtgctagtatcatgcaaatatgtacacatagaatatgtctgttaaattgaaaatcttaatgttgtggaataaatcccttgctgtatttttacgtgttgtatttataaagatataatgggctctaatttttagagagtcctgagaagtccatgaatattaaacacatcgtgtggatttttatttatcatcatctctgattttatgttcgtgaaattataactcagtttcgttggagttctaactacaggcctagttcaacaaaattctgatttccatcatcttgactacattgattttgtgcactttgatctttactttgtattatataaaagtcaatatgttgatctataaacacatctgctgcttggatagtagttattttagaattggctctctttccaagcacagttatgacactgagaattggtactgtatgctccagtcagcacttcccagtcacaaaccttatgaagaatttaaagaactatgtggaggaaatactctttgttctaattcaacattagtgtatagattgtgtttgtgaaaaactgtatgagaaac

SEQ ID NO: 6532 - DNA, 1823 bp, artificial
  synthetic oligonucleotide
tgatggctcatagatgatattcatgaaaaggttctctcttgccttacaaaactcttctacttatctgttaatgtatacagttaattttctacaattgcataaatacatgcacattaaacattaaaatgacttagtttatgttccaaacttacaaagccaaataaagtcagtggtaatgacagacctttaactctccccattgttcttaatggcaaccattgctactaagacagcctgtgcaattattcagtatctcaggagtacaaaccatatgctggataaaaaagtaggcaaaataagcttgatgtattaacactaggagactgcaggttgtattttgtttcatagatttgagagaatatttttattttgtttttcactattttttttccttcaggagtgtgttgcatgtttattgtcttgtgttatatatgcaacagtagattttcttaactctgtttttataaaatgtcatggattctttcattccattaacttctttgaatgttatgaaaaatgagtgttatgaatagcttaggagacttgagtgtttggagaaactgaggagacttggaggggctgctcagccctgaatatttccttttcttttcttttcttttcttttcttttcttttcttttcgttttgtttcttttcttttctcttcttttccttccttccttccttccttccttccttccttccttccttccttccttccttccttccttcctttctttcctttctctttctttctttctctttctttctttctttctttctttctttctttctttctttctttctttctttctttctttctttttttgagatagagtctcactctgttgcacaggctggaggacagtggtgcgatctcggctcactgcaacctctgcctcccagacttaagtgattctcctgcctcagcttcctgagtagctgggattacaggtgcctgccaccatgcccagctaattttttgtatttttagtagagatggggtttcatcatgttggccaggctggtcttgaactcctaagttcaagtgatccacctgcctcagcctcccaaagtattgggattacaggcatgagccactgtgctcagccagccctgaatacttctgaagtcctttcatttctctaaatattaagagagcaaacaatagaaaagtaataatcaacaaacttgatttcttacaagaaggcttatatgccaatgttttaaagttttaacattttaatatagagattttacatggtttatgttatttcctttttagtatatctttttaacttcttaaagacacaacaaatatggaatattaaacttggataaacaactctttcattataaaacaattcatccaacaaaactgtatcaaatgcctcctcagtgctaagcgttctgctagtcattggtgatacaagttgaatgaggcaaccaatgaccgaggcttcttactgttcacattcaagtggaagtgtgagaaaataaaaaatatgtaatgtagaaaagaaggaaggaaggaaggaaagagtcagggagggagggaaggaaaaaaaaaggggaaaaaagaagggaaataattatccattcagataattgctaaagcagaagtacacaggtacagtgaatagcaatttgcagccagaaaatcactattatatacatttctttgcatgtttccaaataaataactcttccaaatatctaatctctttttttaaaaaaaaaaaatcttagaacattattgaaaactagtttatgggaactagaattgtcctacaggacagaaaaatttggcccaagcagcccagt

SEQ ID NO: 6533 - DNA, 3841 bp, artificial
  synthetic oligonucleotide
tttccctttaataaagtagtcaagtgcttttacatgtgggctgtctgaccccagtaggggcataaaaaggctaagaattctggcttgttggattatggcagttggacatttgaaacctacaattttgatgtgcatccaaaatgccactggctaaagagacccccctctaaccctgtccttgcttgtgctacagctagaagcacacaggtgagagcagaatgaaacacctaagaaatctaaagaattggagtttaggaccagaaaatgaaggttggtgttcgagaggctaactggagattttataatgtctggcactctggggaagagaacccacagtgtaaagtttaaggaagtaaaatgtatctactcctttatattaggcggtagtgtattttgcctgtgtttttgttataatcaacaacattgtgttatgattgatccattttaggtctctcttttgcaagactctctgggttccttggatgatgaaaaggttgttttgtattttcatatgtccagcactgagcaatgtgcttaacacttaatagatgctccagagatatttgctgaatgaattcccatgtcctccaaatttgtcctatcctctctgattagtttatttaattaatttatttatttttgagacggagtctcactctgttgcccaggctggagtgcagaggtgtgatctcggctcactgcaaccttcgcctcctgggttcaagtgattcttgtgcctcagcctcctgagtagctgggactacaggtgcttgccaccacgcctagctaatttttgtgttttagtagaaacggggtttcaccatggtgatcaggctggtcttaaactcctgacctcaaatgatccgcctgccttggcctcccaaagtgctgggattacaggcatgagccaccatgcctggccctccccaattagtttttgtctttttttttttttagtttaatgtattttaatagcaaacttacaggaacagcacagaagacagacaacattcaaaacatgtacttggatgtaggacaactcagtcagaaaagtatagtgaatggatggaatctactgtatgataaaaatgctacaaacaccatttagttgccgtcaataagaaatgtacttgttttgaaaaaatccaaatgccggcattgtccagaaaaatttaacgggtttatttataattattttaaagttgaaccgctgaaacttgttcactgaaacattttaacttgcattaatgctttatgactccacatttatattaaaaattcacacacaaatgaaaatggaaaaactgccaatacctaattactgtcccctatttttccacttgcaatcacatacttaggtacattttgaccccatggaaaaaaattaacgttcagaactaccagtaacaggaagaagagactttttttttttattgagaatgaaatgtttcccatcatagtggattcttaagcacgttctccacgtatgcagcctgctagcttgatgtcttttggcataattgttacacgtttggcatggatagcacacaggttggtgtcttcaaaaaggccaaccagctaggcctcagttgcctcctgcaaagcaccgatagctgcactctggaagcgcagatctgttttaaagtcctgagcaatttcttgcaccaaacgctggacgggaagtttgtgaatcagaagttcagtggacttctgatgactaatttcacgaagtgccacagtaccaggcctgtaacgatgaggtttctccacccctccagtagagggcgcactcttgcaagcggcttttgtagccagttgcttcccgggtgttttaccaccagtcgatttgcgggaagtcagctttgtaggagccatgatatagagacctccttgcttaaccacccttctccttcggctggagctcggcgagctagaggcggcgctggctagaggcgagctagagactggctagctggcgagctagagagcgacggtggcggtggcgcggcggcggctgcgaacacaattgctccaattagttgtaagcatattttttaaaccatgcttacctatgttatactatagttgtgtaaagataatttaaagcattaacaaaggatttaaccatttagtaatcagagaaggaaaaacgtgttagaaaaaaatgaagagattaatctttgtactttagctcaagaaaacctgggtttcttggtaaaaaaaaaaaaaatgtagattcttgggtctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactctagttatttctgttttctcatgtcatgcccaggataaataatgagtctcaaaagcattgaaatacttttgacccctaaaaaacaatctattagtgttttgattttataatacatgtaagagttatttgttacacctgtttcttctcttttttatcctccactcttgtcaaaatgtcagtcattaaataataggtattttagataagaattaaatatgtagatatttattcacaaagaccctgcaattttccccaaaatagaaaaagccaacttttgtcttcagtgaaagacagaaagggtaacatatgatatgaattattagatataggatactcaaattcaaatttgtttattataaatttgttattttagaaatgacagctaggacatggaatgactaaaaatatgtacattcaataacacatttagaaatacaggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaacgtctagctaatcatataaaaactcatatacatgtgcattgacaagtaaatgctggtgatatattatttgattgaggtcaatttttattctaaatatttt

SEQ ID NO: 6534 - DNA, 1157 bp, artificial
  synthetic oligonucleotide
gctgggctaaactggatctcgctggagcatgtccaagtgtctgtagtcagttatagaggggctgcgggctggctcatctggctgtcacctgggtcatgtagctctgataatccagcaggtcagcctgggtttgcttttatctgatggtcacaatgttctgagtgagagaagaagaaacatgaaaggtctcttaaagggtaggctcaggactggcagattgtgatgtctgctgcaatctattaaccaaaagaagtcacaaggccagtacagatgtaagggcaggggaaatggactctgcctctttagtgagaagaatttcaaaatcacattgcaaagtgtgtggacacagggaggggcaaagaattgtggtgtttttgccatctgcctcttgcacttaaccttctcccatgacatagttgtctcaagtaatttcccttctgggagcagctgttttgatatacaggaaatattgatccatcatactctgaagaaaattgcagcacagaaaggattatttaggcatcataggtggtcatgagaataagaaatgctgaagccttaagcagatgagctttaagcagctgagccctttatgttcttaagtgaagcatttttattcttccaagcatcaactgtagtcttgttttcaccagatgaaagcaactccaagtcaaatgcatgaaactgcactaaaattgtgatgcatttggttactctgtatcatgtgtggacaaaataaataccctgatatggagcacagattatacacacatcgtttctctgaattcatagctatgcaaacagttccttacggttgacgggttttattttttatctactgtgattaagttgcagtttagccttgcattatctcatctaaaacattttagcttttctttttaattcttattctctaactcattaaaacttttttagggctttgctagccgattccatttcttcattttatcctaggaagaagaccagcaaaataaatgtggatattaaataatatgtattatcattttgcaaaatcaaaatgttttacatgagactactaaatagcaagttcatagtttgagggacgatgattttgccaatgagacagaattctctcataacacacttagggggcatatcacatgagggtaccttgc

SEQ ID NO: 6535 - DNA, 3389 bp, artificial
  synthetic oligonucleotide
ctgaggtttgtttggagcagcccccgcaccccttctctcttgtaatccatcttaaagtgatacggagaatgggggcgttggggagacagtgatgggggtgggagggtcgcgcgcaataataaatctgcttcaaagagaagagatgaaaaggaggttatcaagagtgtgtcggcttaggcatcactctctgtatctttctgcttcctagagaaatggaaccataattctaaggtggctaaggcaagactgtataagcatccaaatttgccagtctgcttttgcctggaagaacagatttccgttatttgaagcctcccagggtcctttccaaaagattcccaggctaccttccttccacttcggtcttctgagaactcaaactcgcaaagcggtggctgtctgtggattggctagtactaaaatatccattgggtggcagtaatactatcctctttatgacttgcagcaaaccagagaatgcattcaatcaaatgaaccgatcttgtagaaacactggaatcatttatgcgttgcagtttctctttcttgttttcgctccttcttccctgggatattttgagtggattgtggctattaatcaagatctcgtgctattcgtgttttgcttgtggttttcgctcaggattagcatcattcaaggcaaacgcaaagctgcttttcccacccccccccccgactcttttttgaaaaatcatttttgggggctgctgaggagagctaggacccaggagacaccttcccaaacagcaggggttgtgtgctttcacatagcagtactgtacaaggaaaaccccgtcggatctgttattgcgggatacttgtgaaatatacataggattctttcttatggctgcatcccggatctggaaattttacttggggaccaggaggatttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtgggtaaggtcattttatatatgcaaacccatcagtggcatgagcaaacttgggcatttgtaatgggaatgggtgacttgaatgattgctgcatcgcattgatggctgtgatgtggccgttattggcactgaatggaataactgcagttgggtgtgttgatatgtgtgtgtgtgtgtgtgtgtgtgtgtgtgtgtgtgtgtgtatgtgtgtgtgcgtgtgtgtgtatatgtatgtgtgcccgtattctgagtgcaattgaaaatcaaagtatcactctctcccccaattattttgatatggaagagtgtcttgaattaattctgggtagacactctttgtttgaatgtaatatttgtggcccctgcgttctggaaggggtagcagcagtaaaagaaacacttagtgaagagccccatttaaaatgaaacgagctactctctatgcattaaaagaaatatgttttcaactcagtgcagcattctgctgcatttcacagccgcaatgggaccagggacatcccacttgtcaagttcttaaactttaaggtgataatcatcgttaattgttctctaggttgtggttactggagattattaagcgccctgggctacttttttatctactggattatcactcagagtgaaaaaaggaaaagaaaagaaaaagctaaaaatgatggctaacatagagaagaataaggcaacattatcttaaatatcaccacagtgctttctttctcaagttcaattgcccaataatataattatttacccaatatcctaaatagctgaagctgagacccacgtgcaggggagtcgaaggtctgaaagcagagaccgtccttttattgcaatgcagccagcttgggaaatgcaggcaattaattacatacttcccctaaccttaagttgaagatgtgtcctgtctgctacatctattttaccctttcggtaaaaagttagagactagaacactaaggatgtttaagcatattctgcctgggaaatgggataaagaaatcaatattgatgacgtggttcagtgcactgtactgcaatgctaaagttccatattcagtgcctgtgatgagagagtggagcatttacatatgttataaatctcacctggtagattgatccaaaggggaggggagaagatatgtggatatgtaggaagatggatggaagtcgtgcataatcggtgattatgtaacttcattacatcagcgagtttcagtcaacgatagtgagatgagatgattgtatagagagaggctccatcaccctgttaacttttgaaggcttgtaacagctaacagaggaggagggcagagagagattagctccaagggtcctgtaaaccttgatctctatggcaaattttgcatgagttttctcatagtgagtttcggagggacatcagatcatataagctttagggctggacaggaccaattttagccacacccgtggagagtcaaaatgagtctgcgatgtttcagaagtgccccattgagtaactgggactgatgattccagccaaggtcatagttctttaccctaggattgaaatatatgaccccaactgaatggaaagttaaattcattgaaatgatgactgtgaacggaatgaatatttagggtcctttcttgcatttttcctggtagagcttgatgcagatttcagcctggtggttccctcataaaaatgatgattgcttccacagcgtgtcagaaatgactgttttgtccctttatcttaaccatgacaatctctttctgggccattttaaccttctgggaaaagagaagtaaaagcattcaaaggtaacagtaccctgttaaattacaaattaaatggcactggattcattattaacacaaatcccagaaaaaaagagcaatccatgttcaagtttcacttattgaatggcttaaaagacaggttgcagctgccaaagacttttaccatcatatgagataaatgtactgtg

SEQ ID NO: 6536 - DNA, 1710 bp, artificial
  synthetic oligonucleotide
gtatgaattctgccctaccacccccaaagcattcaatgcaggaaatattattattttacctgcttcaaccacaatatctgaagctatttttttgtgcgttcaatttgaagtagaagatatgccacaggttctgtgtcctggatatcatgaagtctgatataaatacatataaaaagtgcaagtggtctatttcagcagaactctatgcagagatcagaaattcaccaggaaataggtctttgtaactcccaagttctggttagattttaataaaatgtaagctttaggagagcaggaaactgaactagatatatccataatgataccctcagtactttgaaccatgcctggcacatagtgggtttccagggcacatttcctgaatcaattacaattttaatatttcacccacctgaaatattgttctgcggttttatttaaactggctgtcagcatggaatgacttctgcattctctcctggaagtgggtgaatttccatggtgagccattcctctatatacagtttgcaaatcattttgggaaccttccaaatgaaaggcactgtataaatataccctcccaccagcagccagccggctttccaccggggatgcatttgcatcgcttatgtacacagtgtttcatttggggcattgcttttatttttatgaccataaaagaaatattcacagtatgaacaataatgtaaactgcattcaagaagatatatatttatatatttttatgattcaaaacttagaaatctgaaagaaaagcaggcatggcatttttctttcctgttgctgtttgctttttcatagcattctttattattcctgaactttatggtggaattttgctgaaatgctcaagtctttgtctgtacctcatttgagaatatgtggtggtgggttcaaatgaatattgctggcaaaaggcctgaaaatgaagagtacttgattttgcatttattcaaggctataataatagtttgctttagcgcagctttttgtggatggaggcttctttaaggagagaaagagaaaaagaagcaacctcaggtataaaataccttctaagtaacttagcatgataatcgaaactttcacagatggaagaggctttgaagagacgtattttagccttcaaaacaaaaggggggctgatttcatagagcattgtggggagctagactttgaattcatatcatatggaaaatgtttagtgaactttgaaataaactgccaacagaattaaatcaaaacctctgtaaattatgtatttatctacatagaatcatctgcacacaaaaatgaactgaattataacttcttaatttatacatttccataattaaatttaaactgaataaaataacccaattcagacatatttcctaaccttaaggatattctagccttaaggattttattaaaaagagaagctactctgaatattcagagtaattttatataaaaagtatctaaaaaggtagattaaataaaactcttgttcacttcactgagtggctggcagctgagtaggctctctttctctctttaaagaagcctccatccacaaaaagctgcgctaaagcaaactattattatagccttcaatgacgtgaaatgtgaagaattaaatttcaactaccaatagttaaagacagaatcaataagaacttgagttcatttcaggtgttgatcatt

SEQ ID NO: 6537 - DNA, 343 bp, artificial
  synthetic oligonucleotide
ttcttctatgtgagcaaaaataataataataataaaataaatatatatatgtatatcttgtatttcataatggggtttaaattggatttctgccacttgcaattgaaacagtactgattattaatgtatgctatgttaaaagtttgcttaatgacaagaaaaggtacacatttatacagagatttacttacttcagaagggcatcttaaggataagaagctgagacttctttattgtattaaaaacctagaaacactaaccattcttctgatactaaatcactaaatctcggtttaagttaataatttaatgttagtgatttgcagggatcttctgtttgaaa

SEQ ID NO: 6538 - DNA, 450 bp, artificial
  synthetic oligonucleotide
tgtgcatttgagcaagctgtctaggtgattctgatatgggtggttcatgaaacaaacttcagaaacaccactatgtatgtctatgagatcattttcaagctatagaaatccctataccaggagttcactgtcaacattggttccataggcaaacctggtaactttctcaggtctgatcaaactacttctcagccactcttagtgttcattatcagtgatgctgctgattgattctcaaaggtagatcaatgaaccagctttaatagaatcagattggagaattactaaaaatatggattcattggtgttgagaaatagtataattaaacatttgaaagtcaaatattaatgtcagaggaaaatttgcagttaactgagaaaaagtagaaaatgttcaatcttttgatcatttttgtggctcagatgttaagacaggatggcttttaataa

SEQ ID NO: 6539 - DNA, 788 bp, artificial
  synthetic oligonucleotide
acataaaatgtactttataacaacattattagatctgtcccattgaaagaaggtagtattatatttgaaatatcaggcttacctccagtctctctaagccaggaaaaggatagtagtgactgaaaagcttggatcagaaggcacagaaatagttcagcgttgtgggtatgcattgtaaagacagattagtcagagttgactggcagagttaaggaaacaaaattgtaagatcactacatggcacagagattttaaacagaaaggaatagaatgattccagtaagcagtttgaaccactgtaataactaattagaaaaacaaggggttgattaatcgaattttaggaggatattattctataagcaatttaagtaaaatttctttacaaaatggtacttaggctacagaattaactgacaaaatgtcctataaaagaggaaaataactagataaatatgtgtcaattacagcacaggcttaaaagggaaaattattgataggcaatgtgcaataatcaataactaggaatagggaagtgaaaattagaattcagttcaaagcaggttacaaaccgatatggagatgataaagtaatttgtcaggtatagaccaagtttatccagcacacacaaaagtttgtaaagcatcaagttaatttgatatgtgtaagcagccgagtttaaagtgacaaagtagagggctgaattatcccttgaagtgtaaaatttaagcaagctttttgcttttgacaattcagggttaaatggaatttttgtaatgaataaaaa

SEQ ID NO: 6540 - DNA, 746 bp, artificial
  synthetic oligonucleotide
cccctatattttcatatctccttcctcatggttcacattccatttaaaaaagcagtccctcaaaaaattctttgcccacaaaatctgaggcagcaaccacttctcttcatactctaacattaccctatttcagtttctcaacagaactttctcaatctagaattaccacatttagttacttttattgtcttattctgctctcatcccactcccccagcccaaaaaagacaaagataggtctcggcccatcttatttttttctgcattgcattatctagaagacaataggtgttcagtgactattatgaatgaatgcatcaaagaatgtgtaaaaatcacccttttcttatagtggaaacatttcatgataaaaaattcaattcctcctcatattattaaaatctatcaatttggtatctgatttcattaacctgttttttttcacgttctttcctaaacttatttctggatgaggataaggaggttaacaaacttgtctgaatttccacagtgagtaaatattctgagctttgatttgaaccctggtagtcagactcaagaatctgtgtatgtaagctctttgctacaagacacatcaccattctctttcccttctctttaaataggtacagaagtcacattttatgtctacgttataaaatcatcaagttagactcttaagcatttggacaggcaatatatgtctccatagatctcttcttatcccccatccccctctttttctt

SEQ ID NO: 6541 - DNA, 1748 bp, artificial
  synthetic oligonucleotide
aataaccacacattgtaaatccagcttgcttttttaatgaatgaaagtacactctgaaagctacttccttccaattacttataagcttaaattttgttatatctttatagaaatgtctgaagagactaacattttttatagttaactttgtttttcatataaacataaacttttgtgttaaaaaggtaactgaaggaaagaataccatggctagtaccattatacaagtaatttgtaggcttttaactgaactgttattatttctaatatatacctctagaacaaaactacattaacattatcgacctggttcttccccattccaaactaagactttccttcccaaagatggtttcctcccccaaatcgtgacacaaattaagactttcttgctaaaaagtttatcacccaggttctggttactgtttttttttaagattatgagaaattttgtttttacagaattaaaccctcttaactcgttatatctgtgatttatcattataagttcacatgaaaaagcttgtggaatcagtctttttagcttatggacgtttatagaatttttgttgagccacattttgagggtgccccatatagattttaggagctaagatgaggtttcttcttgggggatgtttcatcttctttatcttcctctttttcttcttcatcttcctctttttcttcttcatcatctggatgatccactaaacgaaccacactgctaccacttgggctacctgttccaatagcagcacaagcagaataagatgaagagaatttgaagtcaccagaagatgttcttttgggagagtctaccttgccttcatgttcttggtttcttttagtctccataaattcatcgtcatcttccagtggtggcataactgcttctccttcttggtgggttcttttggtctccgtaaatttatcgtcatcttccagtggtggcataactgcttctccttcttgggttcttttggtctccataaattcatcgtcatcttccagtggtggcataactacttctcctgcatcttccataaaacatatttcttcttccagcccaatttcttctatggtacctctgaaaactactatattttgcagtacagaatgtaaattcttttgtatttgactttgtctgtctctctctttttcatatttaatcttcaatcctttgaatgtctgaacatattcaatcgattcaagtgtgttataaaacttttcaactatatgtgaaacaagaggcttgatattttccactcttatgtattcaaatagctcaagaatagctgaattcaacatattgtaccgagttccattatctagaagagcatttacaactggctcaaaaagatttcccttgatgatgtaattattataagcttcatcattaaggcaaatcatccttctcataaagcgaagaacacacaaaatcaggtgagtatgctttgaattcatcaatatcaaggcctttcttagcaagtctttgttcaagatatagcttcttatgtagaatgtatgatgttgtatacaaaatgtaagtagctctaatatcaaagcaagcagttgtgctgtttgattatcattggggcaatttttgcttttgtcatatccagctatatcatcctcctcacagttgtgttctgaggtggcagccaaaagtggtgctgtaaatttatgcatgcaatgtttgtagaagaaatgtagaaattcacttctttcacttttctcaggtgttg

SEQ ID NO: 6542 - DNA, 713 bp, artificial
  synthetic oligonucleotide
aagtaaaaaaaagaaaaattttcctataggacagcaattaatttctcaatacatataagggaagctagaagaaaatgaaacaaaatgtctgaggcacagttatttcaaactatattcagccaaccatctattaagaatgaaaacagtcatactacttttctcacatgctgtcttttccaggaaactgtattagcaagataagcaagaaagaaatcagtaaacagaaagttcagtacaggataataatggtaataataatcattaagtggtggagataggaaattatctgatacatttgcctatatagaaaataatattgaaaaacattttacagaactcttggcctatttaggaaggattagaaaaagatagtttgaaaagtaagcaaatgaaaaaataatatgataatatgagatggcagtggcacaggagcctgctctgaaaggccacgaagatggaagactgaagcttggttttaatggatggtgcagtggaataaaataatggatatttttaaaatagtcttctcagttattgtgttctgagggttaattctaacaattctggaatttgcctgagatgtttcactgacgtatgagatgtatctgcatggtactgactgctggtcaatggtactggctccatgttggtggtttccaatccaagtgacaaagcatggccattgagggccttgcagagggggacaattggag

SEQ ID NO: 6543 - DNA, 1831 bp, artificial
  synthetic oligonucleotide
aatatattcatgcaatgcgcgctttacaggaaagcaagggatcaaacacttaatctctccaaacaaaaatgccctttaggcaggccgcggtgactcaggcttgtaatcccagcactttgggaggccgaggcggctgaatcccctgaggtcaagagtttaagaccagcctggccaacatggtgaaacccgtctctactaaaaatacaaaaaattagccaggcatagtggcagacgcctgtaatcccagctgctcaggaggctgaggcaggagaatcacttgaacccgggaggcgggggttgcagtgagccgagatcgcgccactgcactccagcctgggcaacagggtgagattctgtctcaaaagaaaaaaaaaatgccctttaatacttttttttttttttactctgccactcatatatcataaaaaacaaacatacacacaaaacaaaataaaaggtgataaatgacatgttgccaatgtttttatgagacctaaccacattagacatttgacatttcatctcacctctactatttattaggcccaagaatcaatatttatgttatgttagatgatgtttaacaaatccttgaaggaatcattgtttacaaaaatgtttcttgaaatgatgggctaccagcctaaacacaattatttactctttggcttttgtatgttcataaatcacaagtttaatattcaagactttaacgtgtccttagtcaaagttttctttttaatttggagtaaataaaggaagttaataaaatttatcatgtcatttaacattgatgagttttaattagaacaaatatggtgttgtttcattttgtaaaatgaactttctatagctgttatttctcctatgtccatacagtctttttaagaaaaatctcaattttcacatgcaataacattgtattaaagtatatcattgtccaattaaatataaaatgttagtcacggtgaaatgggagagttccctgatcccctttgcagtacgtgtgatgggtgtggctcacctgtttggtcacccagctgctcaaaccccttgtgggagaggggactacgcagatgcgcaggtgcagaggctggggtgagtgatttgggctcccgcctggtggtagtgtcctaggggtgggtacctgtaacatcagttctacaaagctctttcagctttgccgtctgcagatggcttgagtgttaatcagctcaatggaccctctgcctttttgcaagggcagagggccagtgtgacagctttctgtatcccaagctcttgcccagcatcccagaaaaattgggtcatacatgggcttgaaggatgaatgcaaggttttattgagtggtggaggtggcttttggtgggatggatggggggccagaagcaggagatggagtgggaaggggatcttcccctggagtcaggctgctccgctgctggactcctctccaatggcccctagccaaattcctcttggtgttcagatgttcctcctcttctccctttctctgccacaaagttctgccatctgtttgctggcttgctggtctgcttctggagcttggggcttggggtttagataggtgcagtatagggggcatggtgggccaaaaggcaacttttggtcatgaaaacaggaatgtctgtcctcatttaaggttgtgagtcttctggcttggaaggcagagtctgctggcaaacatcctcttctacccagtatttccctctctcctgtccgtatcaatggtgatcttttacccagctatatttcaataatattacttagaaaaccaatctaaatatgtgtatctttgtattgtatatt

SEQ ID NO: 6544 - DNA, 288 bp, artificial
  synthetic oligonucleotide
taaacattatcttgtattcctttcagcacactgatgatattttgtagtgtgatggattgaagttgtttcagatattctacaatttcagtgattttcacccactgagactctattcagataaagggatcaatctaaattctgatggttaagaattgtttgtgccacttttcaatcacatttcaagaaatcaactgaatataccaaataattccaaagcacttttgtcctatctcaaccctttggatgtgggtttcaatgggaccaaattttaaattttaatcctttttt

SEQ ID NO: 6545 - DNA, 618 bp, artificial
  synthetic oligonucleotide
cattgctttacatttttgcaaatgttttaaatgtctagcctaatagaagacaggtggattctcatatatacttctatgttcaatctgttatgatatgctgctttggtaggattaagtatatgaacaaaatattgcctctcatagataagtatttggaaaagggagaaatattttaatagtcatttaatgtaattttggatactcttctttaatactacactgaaacttcataagtgatgatttcataaaagtaagcagcaatgtgaaatttgaaaccatatcagtagactccttgtactctgttacacctgggacttttaatgtatgttttatacatatatgattttgcattggtcattggaaaacgttggttcactgacatttcattatgtaacataaaaattatattaattcatcagcagtctcatcagaaaaatctaggtattgggaagctgtgaagtttatgtaagcttccaattacaaaatttctaaaatttgaatttttgcataaaatctcaaaatgattcattggcaacaaatattgtcaggttttttgttgaagttgtgggctcactgtgatcattttgagccttccaagtcaacgtcttccaaagtctt

SEQ ID NO: 6546 - DNA, 520 bp, artificial
  synthetic oligonucleotide
ctgaaacagatgaagctcctttggcttctttattcatgcctacatggcctctccacaagatctctccagcatggtagcctcagggtagctagatttgttacatgtcagttcagggttcccgagacttgtgtcccaagggaaagagtgcctggcagaagccatatctgcttttatgacctagctttagaagtgacacagcattatttccatttcattctattcatggaggcagacacaaagcctctttaccatgcaccaagctcaaggggagggaaatatactttgtctcttgatggggaaggagcaagattctagtcattttagcaaaacgcgatctgccatatattcatagctgaataactttttccacttgttccaaataaagtcataaccacatgtattcacgtattcacttgatacagtaagtgaatgcttagtgtgttataaatgagtattttgcttgggaaaactaaataaatattgcaatgtaatttagaatacaggtattttctaggaaccc

SEQ ID NO: 6547 - DNA, 235 bp, artificial
  synthetic oligonucleotide
aaatgtaaaaattgtttaattcttggtttgcctaattcgttttcctatttcttttcatataaataaaggatacctggatttatttaggttattaagactgccgttagtttgttttgttctagtgcacttcatattccatgttatctactgcatcaaaaaacccctctgattggagggtggtattttctgggtttaaaataatcacatgaaatgcagtgatcaatataagccagaa

SEQ ID NO: 6548 - DNA, 393 bp, artificial
  synthetic oligonucleotide
atagcctctaactagtgtgatcttgcttcccttgtgtgatcttctagcaatgcaatgcaaatatgaccctcatctcagtgcctccaacccaaaagaagttcttaaataattctcctttccattttatgaaaataagtcattaaaaggtttacaaggccttattctggctaattctaccatcctagattcttgatttttttctactatgcgccagctgaaaatagagtgtaatgattgaagaggtcaaggatctgaaatagaattctagtttatcacatggaagtctgtgtgatttgacaagttacttactctctatgatgattcaattatattatctgttaaattgggaggataatatcttctaaattggctcatgaggattattataaaggt

SEQ ID NO: 6549 - DNA, 3308 bp, artificial
  synthetic oligonucleotide
aaaagaatttctttttttttcattattggcaggcatagttttctttttctggtttaatctgttctccataagtgattgtctaaattgaataactcaaattggaaggtactgctgtaatgccttttctacaaatatctgtgataccaattggaagagcactggtatccatgttgatcttgtcctctttgaaaagcaattgtgccaaaactgctttgtttgcctccatttgaccacacttgaatccatctggcttctgactcttggctccatctctgctaccagtgactctgctactctctttggactggatgcttctttctagccaacgtggctttaactcttggatttatctcaaggactttggcttgtatttggacaaggatgctcttcagggggccctgaatataatgatttcctcacaatctgtttctttggccaattaaggccggactagcaacagactgggcttgactggccagaagattcacctaatgcaaaagagcattgaaagatgggggctttcatcaaggctgtatcagaacctttaaacttattcagaattagttatttcaacagccttctattactcttgggggaaaacagagtttgtgagtcaaaataaatgattgaaggtttcaaagaaacatcattcaataggacccttgtcttacaccatatacaaaaatcaactccagatggattaaagacttaaatataagacctggaactataaaaaatactagaagaaaacataggagaaaagctccatgacattgatctgggttgaatttgacttcaaagtgtatgggattatatcaaactaaaaactttttacatcgtaaagaaaacattaacagagtgaagaggtaacatatagattggggaaaaatgtttgtaaacctatatgtaataaggggttaatattcaaaatatataaggaactcaatggcaaagtaataaataacccagtttaaaaatgggtaaaggacctgaatagaaatttctcaaaagaagacataaaaatggccaacaggtatataagaaatactcaacattggtaatcattagggaaatgcaaattgaaatcaaaattatatatcatctcacacctgtcagactggctataataaaaaaagacgaaagataataaacgttggtgagaacatagggaaaaagaaacccttgtgcactgttggtaggaatgtaaattaggacagccattgtggaaatatgtatggaggttctttgaaagactaaaaatagaattaccatatgatccagaaatcccactcctgggtatatacccaaaagatttgaaatcagaatgtcagagatgtctccactcccatgtttattgcagcgctattcacaatagccaagttatggaatcagcctaagtgaccatccacagattaatggataaagaaaatgtggtatatatacaaaatggaataccattaatccttatataataaggaaattctgtcattggcagcaacatggatggaattgcgaacattttgctaagtaaaataagccaggcacagaaagacaaatacatgttttcaattatatctgtaatctaaaacaattaaactcatagaaacagagagtggaatgggggttatagagcctggggtaggggaagtgaggaaataatggtctaagggtacaaagtctaagtttgacaggaggaataaggttttttgttgagatctattgtacagtgtggtgaatatagttaatgatagtgtattgtacatttcaagatcgctaagaaagtaaatttcaaagttctcaccacaaaaataagtatttgaggtgatggatatatgaattagcaattattccacattgcatttatacaccataacattactttgtacctagtaatatatacaattataaattgacagtttacaataacaatttttaaagaggggtcattggacccagatagttaaaaaaaggaaacaagtatagagttctacttaaaacactagagatacatgtctgtctgtttctctgtagtgctactgaataccatatcagaaaatatagccatatgtttctccctctgctgtaaaatgcctggcacaatgacattgtctatcaaccttcataaatactgttggtcttcggtatatataaatactgttggtcttcagtatctatgggttctgcatccatggattcaaccaataggggattgaaaatattctgaaaataaaaacaataaagtagcaatacaacaatgaaagtaatacacattttaaaaccaatacagcataacaactatttacatagcttttacatcgtattaggtattgtaggtaatctagagatgatttaacatacataaaaggatgtacacaggttatatgcaagccctctgccattttattatataaaggacttgagcacccatggactttggtatccaccgggttgtagaaccaatcccccatggataccgaaggacaactgtgttagagaagatttcccatttctgctactcagaagaaaatacaagcaacacaaatctcaacgagacagattagagagctttcatgatatttgaggtcaattttccaacaagcattctttgcaggtatgattaaattctgtgtggttttcaagtatcaacttagaagtgaagtttctctttttttttatatgtctgacataaaacactgatggtttccaataatacaataaaaattgttgacattttcagttttcaattagcaatattgttttaagcccttactttgaagtaaaacttcacacatttatgacatttataaatgaaagcatttggctgactgattttaatggttgaatcatgagagatgcaaatttcagaaaagtgaaaactgctatttgtttttctattatgtagtcttgttagtatttcagtatagccatttgttttaaacatgtcaactttctttaattgttccatttagcaatcactacttgctatatcctatttaagtgatcttggaacatgtgtaggctaaaggcaaggttagtgttctgaatatgggaacaagatttgaatattttttaaggtcaaataaagtttgatatgtgactgacctgaagctggggggaggtcatattcacaaagaattccaaccaagtacaaggcccaagcagatcagtattgctgcatggcagatgttaaagcacttcagagatggtagaagcccaggaagatacatttaatgaggaagtccagtagtgtgttctggggagccagactgtagaaaactgggatgtaggcaaagatggtgaggttagaa

SEQ ID NO: 6550 - DNA, 1031 bp, artificial
  synthetic oligonucleotide
ctcctgtgggaaagacatcagaaggggagagaccacggaaaagaaggttggagacagttgaagctgggtgattaagaccaaacaagttcacatcaaaattaaaagggctcattttcagtgcaacacaggttcttaaagcactttaagtacaacacaatgcaactggttactttataattataaattcgttttggctgcgggaatgaagtgttcttagtgagatcttttctgctcagcaagtagaattgaaatgtaggaaaacagagcaatgaaagaagctcatgctgtatgtggggctgaagcactgccattatggagcaccatgggccccatgggctggggtagatgacgcttaagcattagttcatatttgccaattaagcgtaagttgtgtttctttatgtgcttcaaaagagttagtcatttagtccccataaggagcattttatcaaaaggagcgattatagccagagacaaagaagcctgcaactggattataggcctccctccattctgacaggactcaactctatagatagctaattgtgatataatagtgatagcttttggagtgaaaatagttgtcaatacaagaggaagctggcaagatattatgaatgaaatgatgattaaagagttaaaatataatccattaaaacttctacaaaaccatataattaagcataaatgaaatgagcaaatatatagcatacacatttcatattggaattaattttctgttagccttttatttgttcagttcatgtaagtttgtctttctgggttttactttatatttacaggccagaaacttacttagaggaggtaccttaaataggttagatatcttcagattgcaacttaaagattattgattatgccacagtacattttagtctgaaatccatgttttgtacctactaacgtctacataatactctactgtcctcagaagaaaaaggagcctcctacatacatcattccaagattgaataggtatctccaggttatggaagcggtaggtcaggtga

SEQ ID NO: 6551 - DNA, 4580 bp, artificial
  synthetic oligonucleotide
tagcctgtatttactctggctgaattgtgagcaatatttaaaaagcattcactagatattacatctaattaatctcctgccagacacttaatctgctgtgaaattcagctgccatgaagataatttgacaaagtggcttaaattgttaatagtaaagctatttgaatatgaggaccaaattatagatgcctccatcatctgtaggtcagtgctggcctagaaagcaaaacgaatgcccaaaagtaccagttttctacttatttggatgtaattgttatttaaggaggtactggtaaggctttctgcctaccacaaccattttagacctctcttgaccagcaatgggtggtttagatgagtctagaatggatgcaataggttttggccagttttgactggtcatggctggttccaaccagtccaggctggtttggactgtcatgggttagactgactgtgactggcctcaactggtttagagagattttgaacagcactgacctgtttagccacaactggtttagtccggttgtgactggccacagccagtttacactggtttagacaagctgcaaccagatttgaatggttttgactagccatgactgacttaggctttgactggtttgaaccattcttggttggatgcaacttgtttagaccagttttggctggccacaactggattagactttccacgaccagttcagaccagcattgattggtctagatcagcttcaatcaacttaggttggactcaactgtttttgtttgttgattttgtttttgagacaggatctcactctgttgccaaggctgaagtgcagtggtgcgatcatggctcactgcagcctcaacctcctgggctcaagtgatcctcccacctcagcctcctgagtaaccggggctacgggcatgtaacaccatgcctggctaattttttgtatttttttgtggagacagggttttgccatgttgcccaggctggtctccaactcctgggctcaagcaatcctcctgccttggcctccggaagtgctggaattacaggcttgaaccactgcacctggcctaaactgggttagacttgttgcaaatggcgtaggccagttgtgcctggcggcaaccagtttaagctgattttcactggccgtgaccagtttagaccaggtacaaccagtttagatgagttttgcccagatgtaaatggattcaactggctgtgacttgtttggatcagcctcaaacacactctgatgactacaacaggaactgactggccttgattggccattactggcattgactggtttcagctggcaatgactgttagacctgtcttgactagccctgggaagtttagatcagcctagactggacatgactggtttaggccagttttgaccaatcagggttagttctgaccagtctaggctggtttggactggtcataaatggcttaggcaggttatgactgggctcaactggcttcgggtggtttttttccagccctcaacaagcttaggccggtttcagcaagcccagccacactgttttatataggtttacaccatcaacaattggatttggctggttttgactgtcactggcaacaactggttgagtcatgtgtcagctggttttgaccagttttgtctggctacaatcatttctactagccacaaggggtttagattggttgcattatgatgtgactggttttgaatgcccactaccagttcagagaagcatcaagtggttaaaaccagttttgaccagtttagaccagctgcaaccacatttgaccagtttacacaaggcagaagatgtttgggtatatctcaaccatcttgaactggtttggacctgccacaactggttttagcaggtcttgaccagcttgaactggttgtgaccagctgaaactggttttggctgtttttgactggccgtgatttggtgagactggccacaatgagatttgaacaggtttttccaggagcgaccagtttagatgagtttagactggacctgaccagttcaggccagttttgaccagttcctaccaggtccacttaggttgttgtgaccagtctaggctggtttagactggccacaattggtttaaaactgttgtaactggccttgacttgttttgagtgtttttgaccagtctctactggtttagactggttgtgactggtcacaacctgattagactggtttagactgtctgcaacttgatttagccaatttcacctggacacaactggatttgactttttgactggcaatatctgtttaaagtaggcctctaccagtttagactggtttgactagctgcatccagtttagaccagttttgtctggcataactggctttgaccagctacaatcagtttaggtcagtttcaagtggttacaactggtttatcctggccatgactggtttagaccagccacagtgggatttaataaattttgactggccataacccattcagatggcactggcttcttcagactggcctcaatcagtttaggctggccacaatcagactcaattggtttaactggctataccagatttggccagtttggactggccatgacttgtttagactggctttgactggtatagaccagctacaaatagatcagacatattttgagttttcataaataactctggactttacatgaccagattagaccagtttcgactggtcatggctagttctaatccctccaggctagttttagtttggttgtaactgaccttggccactttacaccagttttgaatgtctataccagtttagacttgctgccatcattttaggccagttttgagtgtccacaagccacaacagggcctaaccttttttgaccagtcatgacaagtttagattggcctggaccagtttaaactgttttttgactagccgcaactgatttgggctgggttcaacttgccacaactggttttgaatggccacaactggtttagaccagccacaactggtttagactagcttcaactggtttcaagcagccacaactggtttagtctaaatttggtgtagccagcttagtctttgttttgcccagcggccaccaaattcaactgtttttgatggcccacaattggtttggactgacttcaactggtttcaactcccatgacaaatttataatgattttggttggcaaggactggttgtttcaggatttgaccagccataaccattttagactggttttgactggccaggactggtttagatggtctagattggcttcagtctatttagacttgttttggctagtcatcacaggttctgactggtttctatggccacagcagctttatactcatcacaattgatctaaactagttttatctggaaaccaccagataaacttcttttgactggtcagtaccagtttagactggcttagaccagttttgaccagcttcagctggctttggctgtccataactggtttctaatgtttacaactagttatgaatggttttgtctataatggtttctactggttttggctggttgtgacttgttttaaccagtttcatttttaactggctttgatcagcttctactggctttgactggctgtgacttgtttctgttcattttggctggttgcaatgagttttgccatgactgggttcaactggctttgactacctttgattgtcaatgactattggtgtcctttagtcaccagcagtgtcccctggtgactggtcatgaacagccatagcacagtagcagcacatggtgttgttcatgtgttcgtgtgttcactatgtggctgattgaggctagggcaggtctttgcatgttttcttcaaaggcttgactagacacacctacatcacattagatacttaatgatctggcagagtacacttttccattgggggatggaaagattaagccacctggggcatcagcaagggaggataggggctatggggatggctgccagagccagattccatggggttgaatcctgttctgccacttcctagttgtgtgactttggcaagtcacttaactactctgctcctctgtttcctgatctgtagatggggatgataataggacctagttcatggagtacttgtaacgatcaaatgagaacatgcctaacacaagtcccacatcagtaatatataataataatccttattattttatgtgataatatactgatatactactgatgcttctactatataagatttcttagtttcattttctatcttctgccatgttgttatctcaaatagggaattggatttgtagatatttgctgctctgctacatccaggtgatgaacagagactattggagaagctgagggcccaaatacagtgctttctcctcacactcacaaggtctgagatacatccaggctaagaccttgggggtcacccaagggttgggacatgaataaacacttcaaaatattaaaacccatctgattatgccatgagtgaatatgttccacctgataacaaaatgagttgaaagtcagaaacaagcaaa

SEQ ID NO: 6552 - DNA, 678 bp, artificial
  synthetic oligonucleotide
ctttgttctctgttgaaaattcctaaaacttcattgacagacctttagaaattcttccagatagattattattatgcacattgcctaaactcccgtgggtgtctttctttcccactttaaacaggcacacatgtatgtatacacacacacacacaaacatacacacatgcctttgacttatataatgaagcacatcttcaaattatgagtgtaactaatttggtaaacaatactaccatgagcagttaaaagatgaggagagttgtaaccattaatgctgattctataatgctgaagtataatgtttcccatatccacatggacattttgtaactattattattgaaacatccttatataatttgggagataatgcatcgtgctttctttgccagaaatacagatgttttgatgagagtcttctgcctaatttcctttcaaaactgagtggagtatcaggaaacatgtttgctctttatgaaggcatctattcaaagtgaaataggaagatcctggcacaaaactagaccgttttatttgtctatagtcgtctccatattttatccatcctatctccaaaatcccaaaggaatcctggcattcatgttctgtgttctaggaaaataggtgagaattacaaaaaggctgtgctttgttttttttctagtactctaatat

SEQ ID NO: 6553 - DNA, 1972 bp, artificial
  synthetic oligonucleotide
ataaatttagaagcgtaatgtttgtgttaactttaatcctttcccttccaggatttttgctccttactggaatatctgctcacagctgtcaagggatgtttagtttcattctactttaggtacattattgttaatttttttttaggtgttctttttttcttggtgaaagtgggctgttttaaatgtgtgctttgagtattcaaataaaacagaattttcatctcctaaaagttagggtaaagagaaagcaagaaatatttcttttttgacttgcatgcttttctcctgaaactccatgcagtaaataaagaacattggaacaaaaaaaaaaaaaaaaaaaaaaaaaaaaggcaccactgcatcatgtcttgtcacgttctgctcacccctacacctgatttcaaatgtaaattgcatggcatttagcgctaatgaaaatactctagtgaaggaaattgttaagattttctggtgctcccctaggggtaatattaaaaaccccgttactaacatctcactctgagaagacaaaaatgtgcactgagaatacaaaagccctgttggcatctaaatgtgggccaattaatttgctgttattgacgtgtggatttatgaggagatgtaaaagtaggacccaggaaagctattgagatcctcgtactgcgggacttcttgaccctggattttcaatgcttgcctaatcatggcattctgctttctatttatttatacagttgcttcaatgaacaaattaataattatacagcacattgacaaacatgccgggtaatatttgccagattttaaattaatttaattcaagggccacttcatttacaggattcatctgcacatcaggcatcagccttacctcgttgctattcatgctataccaagatttttcatcgttttctcccttcttttcttctctacagacaaagacagcacaacttgccatgccaaataaatagacactaacaggcaggtggaagacagatagatgacagacaaataggaatatagataaatgcacagatgacataaatttagaaggaaggataatagctgttactatgatatgtggaagacaattagattccactaaaatcttgtatttattttctctttagctccaatttgcaatttatcttctcttgttttgcacccacaagccttcttcacaatttacagactggaaattcaaatggatagcttatagttccagaaatgatcactcttcttggaaacagaaaaaaaaaacatgtaaaaatggaacttcatgggcttaggaagccaggcaaaattctgggttgctttatatatcagtgaggtttgagtgaaagtgaatgacaagattggattgcagagaaggggtcagttacttttaggaaaatcgcaattgaaacgtcggacataattgtacttgggtttgtaagaaagaaaaaggggttttaatttacttgtatattatcatatacacagtgatggctaaagatgaaactttggccagttggaaggaataacaccaagaaaattaatgaattacttttcatgtgtatgtctttttttttttttttttttttgagatggagtctcgctctgtcgcccaggctggagtgcagtggcatgatcttggctcactgcaacctccgcttcccaggttcaagcaattctcgtgcctcagcctcccaagtagctgggattacaagtgcacaccaccatgcctggctaatttttgtatttttagtggagacgggatttcactacgttggccaggctggtcttgaactcctgaccttcaagtgatccacctgcctcggcctcccaaagtgctcggattacaggcatgagccactgcgcctggccatatatgtcttcattacatatgttgttactgattgagccagggtttctgccatttaaagcctggacctcaaatatgttatcttatgttcatggacagtaatgaaat

SEQ ID NO: 6554 - DNA, 2027 bp, artificial
  synthetic oligonucleotide
tgatataaatgccaaagaaggtagatcttctctaaagatcagacttcaagcataaatgagcctgttggaagttcaggtcctttcttcctcacactatgcatgggatagagcctctgaaaggtaatatcaaacaggacaaggaacatctgaaagaaggtgcatagactttgttggaaccaataagtgggcaaattaatatgctagctacattcacaacaaatggagctattattgttttccttagcaaatatttaggtaattatttgggaaataccttaagtgtggaaggagaattcttgaaagtgaagaccctacttcttttatctattatctacatatcttttatctatacatatcttttatctattatctacatctattacttatctacaaacatgtctataaatgttaagaaacaagagagtacaggacactaggggaatggcagtttgtaagctgagaccaggctatacttaggaaatcatttatatagttgtccatccatccaacaagtgatttatgcatttagtgattacacattataaggataaatgttataaatgtaacaaatgtggtcaactctatgcagattaggtcttagctacagcttgagctaggacctaatctgcatggctctctgctcctttatccttttaactttttcagctgatgacttttcaccctagcctgtgtgttcagctttttaggctgtgggaccaagggtaactctaggcagagagatttttgaggaacgctagctcaatagccatgaccaagcctcagtctttctagcataagctctcctggatcgctgcttaatggagaccactggcctcaagttgccatattatactactccagactgtgtgaataacagcccttggaattctgcatgcacaacccatgcagcctaacatggcagctttgcataggaagcaattctcttcatttccctttgtcctcccaggaaatctacactaaagtatccttattataagaggataaaaatacacaaggatttaggctgatttctggtttcttatatcccagagaattcacaattctatgagagactctttgtctattagcttctagagaacaaacactatatcttggataacttagaatctcactgaagatgttgatagaattgacctgggatcacaactgaatcatttaacttctgttcatgctgttgcaaactggaattcaaatctgtctttagaacagaaatttcaatgcaaagttctgccttctggggcaaaacttaagtgccttagtggtggtggagaatgtgaattgaatttcagattatgtaccaagtggtggtggaaattgccattctgatttatttggatccatagctttggctctgtccaccatgagtaccagtgtagactctgctggggacaaaaacttaaaggaaaaagatgtgtatgtgtcactctagctatccaagttttcagtggcagtaaagggtcaggtttaatttgagctgtggtggttctgaaagtgtttcagccaagtggttagattgcatatttggctaggccctgtgtgctatttgcaacagtaatacaaacatcacataaaagtcatttagtccatggaagcttcccacaactgagcagagcttaattttgatgctctgctggggttgtatggggttgccaggcattggtatgtatttttccagtgacccaggccttttaatatgtactaaagagggcactgaatcttcatatgcaaacccacctgtttgtactatctttccatttaggtgtcggtcttttggaacttaggaacttcatcttcttgcttagttgtactagagaaatattacctacatatgaggtgcccaagaaatattagatactaaaaaaaattgtccaggccaatttgtatcttaaaaacagcatttcacttgtcttacaggggtaaaataaaaacgctgagctggtaaaattgcttggacctgatgtgttgtatttgatgcccagagcagtagcaaatctgctgacaggctt

SEQ ID NO: 6555 - DNA, 1226 bp, artificial
  synthetic oligonucleotide
cagagctaaaagagggcaggtggagctgttctcagttttttacatgtgaagaaaacattgggctgactccattctggttccgcagagctaaaatgtgccttgatgactgttgttgttttatttaacacaagcacccggggctgcgtgaggatcagggcttgatgagccaaaggattctgagaaaaaaggtgaacagctgtggttcttgtcaaacacaaactcttaatcgttgcttaatcattcccccatattagacatttgtgttattttaattgtttgctatcgcaaatagcattgtaatgaaaacctttgggcacctaacttattcttttgcattatttcctttacataatttcctgagagtgggattactgattaaagcgtatgaacattttagtctcttgaaatattgccaaaatgtctccaactggttgaaccaattgacactacctttacatgaatgtaccaattttgctacaaccttgccagcattatgtattacagcttccccctgccacccccgcctcaaaatatggtgatttaaaaaactctatacttgactctagttctcctaactctatgctcggtatcttccccctcactccagcatctctatctcttgcctgtctgaatggcttgaactaagacgacaagaatacatgagaagaaaggtaatcctggccgggcacggtggctcacacctgtaaggcgggtggatcacctgaggtcaggagttcgagaccagcctggttaacatggtgaaaccccatctctactaaaaaaatacaaacaattagccaggtgtggtggcgggcgccttgattccagctactcgggaggctgaggcaggagaatcacttgaacttgggaggtggagtttgcagtgagccgagattgtgccactgcactccagcctgggcaacaagagcaaaactccgtctcaaaaaaaaaaaaaaaaaaaaaaaagaaagaaaggtaatcctaaagcagtgcacatctgccatgctcggcaaggtttggaagacatctgtaacagaatgtgcagtatatgaggccctgggctctggaatcaatgagacagggcttggagccaattctttccacttctggctctgtagccatgggcaatcaaattaaccttcagtttcttcacctgaaaattgaagatgataaaagtacctgcagcactgtgctacactatagatgctaaataaaagtcagcttat

SEQ ID NO: 6556 - DNA, 21557 bp, artificial
  synthetic oligonucleotide
gtctgagtttcaagtcccaaggaggcccaaagtttctcaacagtcactctccctaattattccacttacctccccacacacctaagatgcccgccctgactactgtccacagttcgggccatgggtagttggtgatggaaggacacctctgataatattatgccaaatgcgccctttttgccttccaggacctcctccagatctggctaacctgtctgaaaatgtagcaaattaacttactcctttccctcaaccctcccacagaggcctgtcccaggcttcaattacccctcaccccaagatgctgtgggggtggccctgggaaagcaggtgttgggccattctgccttgggtgtgataggacacagccatgccctgaactgggccctcgcaaactccctggggctctgcatgtcctccatggtggaagaggtttgcttaaggttggggggggggggtcagccgctcccagcattgtgaccaagttcccagatattggggccaaattgggttgccattcattaataatgctcacaataagattaaatcattctggaaaatctcataaaatccccctaagtacgctccagtggctctttccaatccccatcattcagcacttggggaggtttggaaggagaagaaaattggtttctttgcttttaatgctgctttgaaaagatactcagagtttttcatgcgtgacatgtcacatgtttaatgtggacttgctggaagtcagggggtctttagcgtgtgatatttatggggaatattaagtgcagaatgaggtccctccagctggggaaagttgaaagaataggaggcccaggactgggcttgtttgcagcatcagaatgacataggattaagagtttgtaaaacaaggcgaggggttctcattggccagtaataaatgtaatccttggaggtaatttcacgcaatttgcttctgttccatggaagggtcaaatgagaaaaaatgacttaaaaaagagttcattaacaggaagaatggtactgtttctcgtataccatccaactagcagcctagaggggggaaaagaagccctactaaacaaaaaggcaaaatcgacgcaaaattgatatcgaccacaacacacacacacacacacagacacacacacacacacacacacccaactcctttccctcagtcttctccagcagtcccgtctcctccccaaactctccagcggccctgaccaccccaggaaagcggctttcactcagggagagcctgtggatgtggagtctgagggttttagactctcagacctccagtaaggccctagaaagttcccaccgggcctactaaacccgggaacggagtgtgtggtaggaatggtagttggcggccgctccccataccccaggccggggcccttcttgcgagtgccgcccccgtgagtccagggctagcgttgggtggcggtgatccacccgacgacccaagtgccagaagcggccaccagccggcgagccggttccgtgagctctccaacgtttcgggcgggcggggtctccgggcgtctggacccggggttggagaggaggggattgaagttgggggtgaaggggggtgcaggataggaggcgagcccgggacgtgcgggctccagcgccgaagctgccgggcgggctgcccacacccaggtgggcacagcgcctggcaggccgctgacctctgcccaaccctgcaccctcccctcggccgcgcacacttgcgccctgggccgcgaggggacccggcccccctcctccagggcgcgcgcggagcccgacggccccagcccagagaggcacccgcgccccccgcggcgaccgactggccggcggcggcggcggcgtggcggggctgccggccccagctccgcaatcgcggtagtcacgccgcggcacccccgcacccctcccgcctgcccctctccccaaaggtccggcgcgctaattacagcaaattgaaactaattaagcttctcttccctttcccatcaccctgggagcgtcggcgagacccagcccccgcgggcgggcttccaccaagcggtcacccggaggggcgcgggcagggcccgggggagggagaagctgcggtccccgccgcgaggagggaggcgtgcgccgaggtggttaaggattgcaaatctgtttgggtctcctcacgaaatctgagttgtttagatttttttaaatgtatacatttaccaatgcctggataagtgatgtaatgacatttgtcgagttaagatctgccatttggatacccctcgctgcctttccatcactactgctcccgcatgtttctctctctctccctccctctctctctctctcacacacacacgcacacacaacacaatacacacacacactccctcctccctgcgaacatgccgtggagcccgccccctcggaagggagcgcctgggcttctcgctctcgccattacctgtcatctcggactgcgcacttcacttcctggctacgtggcactttccaacagctcccttcgccttccgagccaagactcccgcttgcttcaaatttctgactccaccgtcaacaacgcccaccatccacccacccatcctggaacccaccccacctccgtggcccgggacccccagctcccgctgtgacacgacccgggagagcccaggtgcgcgtggaaagtaccgcggcggcgtccttaaccttcgtaggaaatccggttccctttgaggatcggattcaaaccaggggcctctgccaggaaaacgcgtgtgcagataatcccaggagatgcctggacgctggagcccacccttgactcccggggggtgggggtgggggcttctactgtcccctcagcgcctgtatggagcattcacacttcgttttgttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttttttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaaaaaaaaagaaagaaagaaagaaagaaaagaaaggctaagtggggtgtcaggaggaagaggttgggctttttaaattttttacttcaatatcaggcgtctgggggagaaaacctccccgatattttcaggaaagtaagaacaagagagagtggatgttggagttggagcgaggttggcagtagcaggggcaggggcaggggcgggtggacagccagccgaggaggtgccacgtcccggagcgccgagggctgccatgcccgcatccagactgctgtgaaggcggctgcgctctctcagtgccgtctcgggagtgtgctggtcctctgtttccatttggtcttgagtggtgctgagtgaggtgacctttcggggcgcgcgcggggcgcgggtgtggagggcagcctttagcacacctccttgcccgtgctggtgcccggcaggatgttgagctgcgtgagctgcgccgcgtgctccttggccttgagcctcagcgcggctatgctagaggcgcgtctgtctgcggccgccgtggccgggtcggccagggcgcccgatgccactgcgccctccacggcgggtgtgggctgtctcaggagcgcggccgcggtcgacgcgctggtcaggggggccattgtggaaaagagcctgcagggagagcaaacagcgcggtcatggcctcgggagctgtgcgcggcgcctcgggcagcgtctcccgccgcttgtcgccggggcagctgaggggcgcggtacccacgggacccggatgggccgcggcggggaagtgggcagagggcgcgggcggaagctggaccccgcagagagggctttcctggggcagggaaccgactggggggaaaagaccgagtccagatattccccgaggggccgggccgggccggggtccacaggccggcgtggagacctcaagccccacggcccagtggcgtggattcggtggtttcgcttaaacggacggtttattccaaggccaggggctgcaatgacactatctcccaggagagaatgcggaaggagaaaaggagaggagagcaaaagaagggaaggtggagggtgggaggggggaggaaaaaaaagacggagaaggtgggattccagctgcccggacgcacgccgcaggctctgagatctccctccggctccttggcccgggactttctgcgccctgaagaaacaggcctagctcgccggcctcccgggccacccgcgccgccgcggccgcccttccgcgcgggactcagctacccgcgtctggccagcgcctgcgggtgagagtgaagggcgaccgcctgttgatttcggctccacgggcgggtgtcacctgccagcagccccacatcctggcgcggcgaccccagctgtcttccccgcgcccctgtagcctctggcctcagggagcccccgacccacgaccctggcgcgcggcgcaaggcgatgcccaagcctgggacccacgccagcgccaccgcctccaagcggcgaccgaattactccacgtgacgcttccaccccatgcacacagcaccgggacattagctgtggccggagccgcccggggccaccggacaccacccccacgcccaccgccttggagcgcccgcgagctttcccgaccgcctccctgaggggtctggctccaggcccgcggggccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagctactctgagatttctctgatttgacatcggcctctgtggtaccttcatatcactcatggtcccctcctatcttctgatttgagaataccccactctgtgattctaagttccctgagctcagattttggggctcccatcttctgaagctaggagtgtccactttttgactagatgatcccctacctcccgtctctgggatttctccatcttctgacttgatggacttctgggccaccaccctgctccatctccccccaggcatcctcctctcccactcctttcacttctcctgcaacatttgcctctggaaatcctcaaatcccagcttccactacttccactactcatacattacctactccctcttggtctggccagaaattgagaaaagagaaatgcagggttcttgtccaaccctctttgacttgttcaacctggaaataactgaattttcttgaagcccttacaacctctggtttaaaaaaaaaaagttaaagacgaagcttttacaaatgtaaaaaattcccagttcaaatcgatccataacttacttcttttgcaccgagtgtgtcaatctgaactcatcaatcagaaaaacagaaatcgtgcttctaaagacctgcaggattttaaagttataccaaggccaccaaaacacttactaggtagggcctagaaaggaagaatccaaaaatagtagcgacaacagctcccagagtcccttattttgcgatgtgtcttgctaattgggaagttcaacacgaggctttccctgcccatacaaggctggtatttcagagcgggaggagcagatggaaggggtcctgtgggaagggaggtgtgggtgtccctgtgtttaattaagagttgt

SEQ ID NO: 6557 - DNA, 1436 bp, artificial
  synthetic oligonucleotide
taggcacaccagagatgaaacacagaagcctgcatgtaccaggaatgggctttcaacatcatttggttggcaataggctgtacacatcattcatgatgtttctattaacctattaccgttgttatttttcttaaatgacagtttaaataaccctcagcatcctgatgtcaggttcagcatgcatgaattaccgagtagaaaacaaaaacaccaagtcaaagattttggcgggagggaggagattatatgaaaatgaattctgctcaataggctagccccgtgtggccctgcacactattacacaggcgcacactaccagggctcactgctttattttctaatcactgtgttttcaagtctgccttcaagattgttgagtgctaaactgtctctttatccccaagcaaggtcagcttcccagcctcccatacaacccagttcatgctgggataaagaggaaggtaggaatgttaaaacaataatgctatggtctgaggccagcaacgggtaatcagatcctagcaaggtagaggctgttacctgggagattattggaagaaaataggcctagcttgcaatgacttagtttgtttctaccttccttgcttttttttccttttcattcttccccccagtgatctgatgggataattattttcctgcatttatttccctaacagtcactgagaagctttgtgtggggcaccagctaaagatgtaagagttttgggactacagcctgacccattgctggactttaaccccaagtagcaagcttagatggacaacattgattaagaaaggcctctatagttcaagcccatactgccatgcctcaaagaaggcccaatgtttcaaacttctgtagtatgaaatagataaattaggaggctactgttcacattaagaagagattcaacacaggtttcccgaaacaatgaatagaacattccatatatgatttggaatacattcaacctgtctgagaaagcatctgaagaataaaacagaagacagcagaagtggtttgtacaacatcaatgtaaaacttcaaagtgcttgtgaacatttgttattcatatttagccagtgtgtcttaccataagatcatgcaacctgtttttaccccaaatggataaaaccaacagggggtgaggaatggggtagcccagacttttgataggagcatgagctcaaacagaacatactgcagtagaccaagttccaaggcaatgaaagctagaatcacactctaaggatctatccaatccattgtcggggacagaatggaatccagagaggaaagtgatttgcttaagtgcacacaataattcaatggcaaaactgacactggaacaagactatgggctccagcaagtccagaccaagctttagcacatttgtcttgacagccccctgtcctttcaccgtgggct

SEQ ID NO: 6558 - DNA, 409 bp, artificial
  synthetic oligonucleotide
tcattctattatgaagtaaagctatgagctacctttgattcagcctggttaaaattaaaaagtgaaaatactggtcccaaaaatatttcatgggaatccctgagaggaaataatttttgacttaaggtgatttgagaattcaaaatgcagtattgattattgctgactcaacaagaaggaagaggaatgtaaaaggaacatgccccacatcagtattagcactgaatctgttcgaatcacaactttattttctcatacagcctcatagggagaaatctaacactaacaagtgatttatgccacttctatagtagtgaaattatacgttacagttaatcacttttgagctggtgtgtccattacagtttattttcttacaacacatgctttctatcaaatataaattcct

SEQ ID NO: 6559 - DNA, 1332 bp, artificial
  synthetic oligonucleotide
gttataaaagtgactagatctgcgccaaatgacatcattttttgtaaggcaacttgcagtggactattgcgtcactgtccacttggcttactgcacaacaattacacgtttcagaaatcgatttcccaagggtgggaaaattcataaaaaattgcatgtctgcaccacccggagataatgccggatttaaaaaagctgtctctacttgcgtcaaaataatcaagaacgaacattcagagggcagtgatttttgttgttcgttttttatagaattctagctagtactttttaaatattaccttttcttgacaagaatataaaactagactataggactgttttgtaaatttattatggcatctctttctgggaaaagtgtagatgacggaaatacacagttggaagcccgtggatctacaattaaccttaaattagggcatccattgcccatagcagatcctaaactgaggtatttcggcttcccccacccccaccccccgccgccattttctctctagaccaatatcccgatgaactttccgtgagaggtgtcgctaaaagcgataattatctctttctagcaaacttgaacataccatctttcccaagaggccaaaatagcacacggtgtactgttttgctgaagtagactacttcgtgggagagataacacaatcacttcaatcttttggaaatacgcttccttattccgatttaaactataacaagctttaaaaaaactgtaagacactgaaattcccaagttgttcacactttctttccatcttttccaatagctcctttaagatatttctgttcattatttaaaaatccctgcttgccatatttgtatctattactacatgacaaattaccccagaatttcacattaaaacaaatttttaaaattaaatcataaaataaactttaaaaatgcatacattccacttctgaatatttaaatgttcatgcattattcccgaacatctaaacgctgagtttggatttttgtacattaactaacattttaagctatacattactatgtggcactgacctgtctaaagagaggcttctgttcttgattcaagcaagagttgaaacgtttctgcgctctttgtaccaggtataaatgtagtgagtgtatgtcataagccattgtgtgatcaccgtgcttcccgtccctccttattttgacattgcaaggtctcgtggaatttcaaatgtgcttttttggatatttatgtagttttaaaactgggctgtgtctttcaatcaatctatacgtttactatatgaacccctccccaagttatcttcaatcaatgatgc

SEQ ID NO: 6560 - DNA, 5640 bp, artificial
  synthetic oligonucleotide
agccgagacatatgcagtaacttattttctacctaaaaagcttagtgcatttatcaataagactacaactttagaggagcagcagtactttacacttttatggtaagcgtgtattaagtagaaaacagtgaaacactcagtgattaagtgaccaacatgatagagtctctagatggtagtagtaagtaagggtataggtctggcgtcagatgcctgggtttgaagcgtggttctacctcttattagctctgtgatattggggcaagctactcagcctctctgtgctctaaaatgtaaaatctggaccggacacggtggctcacgcccataatcccaacagtctgggaggccgaggtgggcagatcacctgaggtcaggagttccagaccagcctggccaatgtggtggaaccccgtctctactacaaatacaaaaattagccgggcatggtagctggcacctgtaatcccagctacttgggaggctgaggcaggagaatcgcttgaacctgggaggcggaggttgcagtaagccgagatcgggccgctgcactccagcctgggcaacaagagtgaaactccatctcaaattaattaattagttaattaatttaaaaagtgtaaaatctaaaacttttaaattggggtacttcaggccaggcacggtgactcacgcttgtaatctcagcactttgggaggccaaggcgggcagatcatgaggtcaggagatcgagaccatcctggctaacatggtgaaaccccgtctctactaaaaaattagctgggcatggtggcaggagcctgtagtcccagctacttgggaggctgaggcaggagaatggcgtgaacctggaaggcagagcttgcagtgagccgagatggtgccactgcactccagcctgggcgacagagcaagactctgtctcaaaaaaaaaaaaaaaaaaaaaaaaaaaaagggggggtatacttggccaggtgcagtggctcatgcctgtaatcccagcatattgggaggccgaggcaagtggatcacttgaggtcaggagttcgagaccagctggccaacatggcaaaaccccatctctactacaaataaaaaaaaaattggctaggtgttgtggctcacgcctgtaatcccagctagtcgggaggttgaggtgggagaatcgcttgaacccaggaggcggagattgcagtgagcagagatggcaccactgcactccagcctgggcaaaagagtgagatcatgtctcaaaaaaaaaattggggtactaatattaatagaacctaccttacaggttgctgcgataataaagtaagttaatggatgtaaagcacttagtacagtgcatggaccttaagtacactgtaacattaaggcttattatcatgccccttcgtgtggtactactacagccaaaatagtaagcctgatctagttaactttgaagaaaccccccagcccaccttctgagtatagtttctcaagactcaggacccaggtcaactctaactccacagatgaagacagtaataatgtccacgggtgaactgactttttattcaaggtcatagaactagtagctagaaataaagttaagactagattctagcctgcgcaacatatcaaaaccccgtctctacaaaaattagctgggcgtggtagtgtgtgcctgtagtctcagctacttgggagactgaggcaggaagattgcttgagcccaggaggcagaggttgcagtgagctgagatggcgccattgtactccagcctgggcaacaaactaagagcctgtctcaaaaaaaaaaaaaaaaaaattagattctatttgcaaaaaatacaaaatagtgtggtcggaaagagcaaaacctctgaaatcagagtgcttactgtgtgacctacagaaattttgttaacttcctatcttggtttccatccatacattactaataatcatcatcatcttattatcaagttagggtggtgaataaatgaattaacctaagtgagaaccctcagtctcccctctctaccaaccccatgcctccctagggtttatcataatgcagatttataacagatcagagtcaggcgcagtggctcacgtctataatcccaccactttgggaggccgagatgggcatatcgcttgagctcgggagttcgaggccagcatgggcaacgtggcaaaaccccatctctactaaaaacataaaaattagtcagacgtggtggtgtgtgactgtagtcccagctactcaggaggctgaggtcagaggataaactgagcccgggaggccgaggctgcaatgagctataatccaccactgaacttcagcctgggcaacagagtgagaccatgtcccaaaaaaaaaaaaaaaaaaaaaaaaaaattgtgtacataattctttaactggttacagcggcctcatgcctgtaatcccaacattttgggaggcaaggcacgaggatcacttgatccagttcaagaccagcctgggcaatgtggccagacctcttccctacaaaaaaatttttttaaatagcagagcttggtggcgtgctcctgtggccccagctacttgggaggctgaggcaggaaaatcgcttgcggtgaggatgtcgaggctgcagtgaaccacgatgaagccactgcattccagtctgggcaacagaacaaggccctgtctctaaaaagaaatctaagtacagaattatatcaatttaaggaagaaaactattataagaactactttgcaatggcagagacagccgcggcagcagtagcgtgctcaacaagaagtgcgtagccccactctcccaaaagaaaaaaacgaatcattgtaaaacacaaaaaccttaaataagaactctttaaatgagtgctggaggaaaaatttaagaggctttgaggaaaaacatttactgacaaaatgttcaatgtacaaaaattctgtatccttacttttcatatataggtttatcaacactttatacatggccttcagaatttcaaatagtaggttttttttttttcaagagggaaaccaattagaccaaatgacaaggcatacttatactaccaggaaagaaatactgaagaacgtgtcttgtttcataaacttggtactgactaaataaaagaaagcctcacatttttgtgcctaagaatgattagtatagggattctcaaagcatgatctggggacaagtgaatccagttgtcctaaaagatcccagtccccactaaaggggcttcccaatgtcaaaattattatccaaataatttttttaaagttattggtcagccgggcacagtggctcacatccgtgatcctagcaccttgggaggtagaggtgggctgatcacttgagctcaggagttcaaaaccagcctggtcaatatggtgaaaccctatctctactaaaaaatacaaaacttagccaggggtgatggcatgtgcgtctgattccagctactcaggagggtgaggcacgagaattgcttgaacccaggaggcagaggttgcagtgagccaagattgcgccacctccagccagggcgacagagcaagactccttctcaaaataaatacataaataaagaatagttatttgtctttttcactttcattctgttttctagaggtttacacatggtatgtgatattgcaacagactgaatgcagaagctgatgagaagcccattggcttttattaagccagatattaaagagatatgcaaaaatttaaaacaatgccactcttttcaccaagttcttaactgttttagaaaagttatttttcataaaaaaatgttatttaggttaccatgtaatagaattaatttttatttgtttatttattttttgagacagtctcactctgcacccaggctggagtacagtggcatgatctctgcaacctctgctccggggttcaagcgattctcctgcctcagcctcctgagtagctgggattacaggagcccaccaccacgcccagctcatttttttatttttagtagagacggagtttcaccatgttgcccaggctggtctcgaactcctggcctcaagcgatccacccgcctcggcctctcaaagtgctgggattacaggtgtgagccaccaagcccggcccccactaatttttaagagtacaaataagtacaaagaagtcctgagaccacaggcttgagaacaactgaaagtgtaagagataagtgacaacacacacacacacacacacacgtgcacgcacaaacctcaacctcttcctacctctgccctggaagactattactgctatttatatcacagaatttttgaacacttcaaactctctagtgaccagtaaaaaaagaagtttggtgggggtaaaactggacaggaaattaaaggcaaagaaattaaatgcttccttttcagttataaggctgccattctgatgtgaaggcaaaattataggcaattaaaagacatttcaaaattaacctctatgtttgtgccataagcaataatttattgctttcacattccttccacagctgcttgaaaattcatacaaaagcttaaggtattcaatgcaaaagctagattctcagaggttgatataatatacttaccctcaatgaaaaatttaaatgatttcatactatcttcatccccaaactgttctcctaccaaaattgatgcctatgcagaaaatgccacagttgcatatcgaaaagagaatgcaaaggcttactacggataaaaacagaattaatttctgagtcataacatttctcacttctgtaacccataaagtaaaaaaatgtaaatttgacaatctcaaagcagccaacttctcaacataccaatataaaagaaaagacaaatttaaagacagacttttaagctctattagcggtcactttactctcaatacactactcaaattgaaaactcactttaatatgggaggagacgttgtgtaagttaactttaatttgtttaatactggaaattctttcttgtcatcaaaatatttttataactcaggaccaaattgcaaatgaccatttaactaagctattaggagggccctgggtcctccagcctccagactggcaccaaattacttcacttttcaggtatgtttagcatttcgtcatcctataatacaagaagccttataagaaaaaaaaaaccctgcttgaatgctatttttcatcagaagactttaatttaatgcttctctgcttattccacactatgactagaagtagtccaagagtgatgtcatggaaaacagcttccctagcctttagagattggatccagtgagaattctaggaaaagcctctattggggaataaaaccccaaatcttctaagttctattctaacatgaaatcacaaatactgtaatgttagcctttcagttcctcataagaattatacaaccaaactaaatattttggaaagtcttgctgttatgatacagatttcctgcaaatcattagtctataatatatatcattaactaaattcaaagatcttatcagagacaaagggtatttttttctatccattcttacatgtttcagtgattgagcctgatgagctttaagggtcttacgttaaaaacagaaaac

SEQ ID NO: 6561 - DNA, 3165 bp, artificial
  synthetic oligonucleotide
gggggtctcccgcctccgcccggcagccgctcatccccagtagaccagtgaatgaaccgcggggccgggacgcagccggcccagtggcgggaaaagcctcggggtgagccaggcctggctgcagagaggccccaagagagcgcggggagggctcgggcggccgggagggggcggtgacagctgtgactcgactccacgctctcaccttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacgtttttagacaaacatgtaaaaactctccactgtgctaggcactgaggactctgtagttaacaagatgcctcctgccctcaatgagcttgttggtagacagctggagagtgaggagattgaattattgagttaaaaagttaactccaggtgtagtgtggaagatgaataagaggagaaaaagactggagacagaccagttagaaggctatggatagatttacttgtcttttccatataccatataatatttttagtacacaaagaatgtaaactgtaagcaactttaagagatccacaatgccttcctttttaaaggattcagaattagtacaacaatcatatggcacttgagtcttgtccaaacagtgtaatagtataaattatgacctcaaagggttaatttatgtactttcagattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcgtaagtacctgtgttttgccttgtgttatcttccacaactgtacagtttccaaacagtacttattcagataacttcaaatgcttcttgttttgtaaatcaaagtttttgtgttttaaaattactttcaaattgagtaattataattgcattttctaatttacaaagcatattaacacacatctacttgatcctgatacaaccttgtgaaacaatttttacattttataaatgaag

SEQ ID NO: 6562 - DNA, 238 bp, artificial
  synthetic oligonucleotide
tttaatcatttttttacaataatcatacaatgtagaaatcctcgttgttttacacacacatgaagaaaccaaagaaatgaggtggaaaaacttccccaagatcacatactagtcactggaagagccagggtttgagtcctagagagtttaattgttctgggtttatagtggcaatatgtaaatcttcaaggatgtgttagtctttattcattattaagaaattccttcagaaatcagg

SEQ ID NO: 6563 - DNA, 1564 bp, artificial
  synthetic oligonucleotide
gcttgtgcccaggggactcaaggccgctctgcctctccacccgacagtccgcaaagcgggttccaaaggagaggggcgagcgaccgggactccgacccgcctagtccttagtgccctcctccagtccgtaggagcagagcacgcgggaatgcacccgaccgcgggcaggcggaggctcctggctgtacgcaacgcttacccagcccggtcaggttcctagcccggttattgtccgctgagccgccctgggccgggctgcagcctcggctgccacggctgagagcgccgccaccgcagctgctgccgccgtcgccgcggctccagtcacctccagcactgactccccttccccaggctttgggtagctcccccataccccctcccccagtactccaaggccaccgggtggggcatctgcgtcctgattggcaggcatatggcccaatcgctatggtgggaaggcgtgccccggcccgcccactgttttccttggtgcgtttctctttaaatgcaaataagtgcaggcgtggtgttggcagggggcggagagggtgcggaaccactggctggggctccccactcccgcccccacgccgggctggtagtggcgtggctacaccgtggcctcaaggagccagtcctgcccggatggggctcgccggatcggtttcggttttcacgcactcccatttctgtggccgctgtgcattcgcggtactgtgccctggccgccaccaggacgtttattcctgagctagaggccggcggggagtaacgaggcagagaggttgaggaatctgggaagactgcagaaacctaagggccggcctatccttagtcgtagagacaaggccctgcggatcgcgccgccaggccacccagaggagggactcacctgccaggaaagctagctgcagcgcctgcgccctaacttcgtccgcctctctggcacaccagtgcccttagagaccatagaggccaacttccacccgttaccgacgggccctctgctgcccagagtggggaaagtccctccccacagttacccagcctgccggcgacaagggccaatttggaatccagagccccgggctccctttccaggattgctttcacttttcttctctgagatgatacctgtttccatagtttgaccctcacccaaatttcgcaccttctatggaatgtggagggaatccccaaggtctccagagtcccccttcccccatcctttgtgagcctggctttcggcaggcctttttccttgaaaagtctaaatattgagaggaaaatcttgtctgggcccaaaccggaggtcaggctgaggacaaagtgaggaggcctgtaccagccttgtctgctactgtgtgtgggatgtggcagggagcccggcgaacttgggtctctagcctaaggacattaagtggcatcagtggctgccagggccaggtgagctgaggcagcaaagaatctagttccaccactagttcaagaatatccagaaggcccagccctaaaactctgtgtgtgtctaaaaagggaggtgggtggattaaagctgagg

SEQ ID NO: 6564 - DNA, 2848 bp, artificial
  synthetic oligonucleotide
tgttctgtcaacaggttgaaaaaaaaaataccagttaatttttatgcactttgcaataattatccagcagagggaaatcttttgccttaaaaatctgtaaaacaaagtcctcttccataaaatattctggggcaaaaaagaaaggagtaagagacctaaggaagagggatattaatattttaaaagggatgcagactgagcagatgagatctggcaagggtgatgtaaaggagaggtcatggcagactacgcaagtacaaagttgaagaaagaagaggaagaatggggagttcactaaagaaggcaggttttcactatctctgcctgagttgacatagaacatcatggaatcctgggtagtggttttaggagaaatgctctacacccaagagtcttgtaaggccccaatcccaccttgccccctttctgaccctaatcattttgtagtcgataacagatcaccaaaactgtctgatatcaactttattcttttgaggtctaaattcaacttcatcagcacagtgatgaaatcagactgaatccttataccaaattaaagaagataatttcttaccttaaggatgataaaatgaatcccaaatttatttaatacttatgctggtttgcctatccctgaaaatcaacctctgtatttccacagagagaaataattttcataccaactagacccagatgaactttattgaattatgaaactgcacatcttagtcccttttccagatcaacactgctataattcagtactatttaagctagatttgtacaatagttaaacacctaaccacttattgactctgctcacctgcttgcttttatattccaccccaaatcaggcatgctttctgcttacatgataacgcaaagctatggccgcttgcctagccaaggtgaaatccctgtaccttccaagagtttctgcagactgctccgcattacatggatgttctcaatgcccatgaatctgaagcgaatgttggcatagttgtcttcattttcataccccttcccagctgctcggttggccatggcattcaactgcaatagcagaggacataatagagcagataggccagatgatgaaagaatggagttcatcaatctcaatgcctcattctgaaccgtttaaaatcctacccaattaaaaagaagttaaatcagatgagatacattctggaatggagagaatttcactagtttttacatcaggtacttttagtaacagactcatataggggaaaaatagggagatacagtgttttgtttcattatgaaaacctttcttaagagagaaaagttatggcagctatgaggatatctgatctaaaaaactgaaataataattttgagctgcctaccacaaatgttttctcagctgaaagggttttatactgagaaacatgcaaaagttcaaaaatatttacaactgagaagctctagaaagaagcctaagaacttcaggatgaattaattttatttatttatttaagagacagtgtctcactctgtcattaaggctggagtgcagcagcacaatcacaaggttcaatgcagccttgaactcctgggctcaggcaatccttctgcctcagcctcctgaacagctaagactacaggcacgtaccaccatgcctggctaattttttttacaaaaaatgttttttgtaaagacagtctcgctgttccccacactggccttgaactcttggactcatgtaatcctcttgccttggcttcccaaagtgctgggattacaggcataagccaccacatacagcccaattaaatagctattctagaaaaatgtctaaaatgtgactgcatgagataaatgacttttactcactgacaaaattgaaatggagacatcaccaactgttttaacactatgttcagtttgtggtaatcagaaaatctctaggtcatatgaagaatgctgggtggggtagggagtaaatgagacttgtggaaatatgaatataataaccagaaggcagccaagatactgtctacgataatgaccatcttactaattaagtgattttctgttttctgggcctattttctcatctcccaatattgtgcatttcagaaggcaggaggagcatgtatgtggacagggtataatttttgtattaaaagaatacaaaaacctcaagacacaaactattcaagttagaacatgcagagggaaaaaagtcagtgtgctaaacatattctgtttacaatgcaagacatctgttaaaaggggaaatgtgatggtaattttgatcttttatcacattgatagtgttactgagctttcattaaattaatgacaaatgtcaaaggaacacccgtggaagcataagcaatagtcacctagtagcaaggatgtttgttatgagtgatgcttcagcaaaaataataataataataataattacagtagtcactacccaggcctgggtaggccacctaatgcagataactagctacctcataccagtattcactctttaaaaatatgtctggcagatctgagtaacagatacctatttaatgttcaggtggcaaactgagaggaaaatggagagacaaaaatggaacctgttaaaaggggctttttggtgttggatttgaacaaaatgcaccaacccttttgtttcttcaaaagcttggtgtagttctctttactattttaagattatttaatctttaaagatacagacgcgattaaactctttccaattgcagaatgtcagatgtaatatttattgtaatgtaatatttattgagctcctattatatgcctgacactgtgctaaatcctttatgtacattatctcac

SEQ ID NO: 6565 - DNA, 1470 bp, artificial
  synthetic oligonucleotide
aaaagggactttcctggggaaatacttcttagtatcaaatcctgcataaagacttagggcttccgcctcccaggccagcagtcttttctcctagatcagtgattctcaaaatgtggccaagggatcagcagcatcagcatcacctgggaactcagaaatgcatattcttaggttcacctcagacatacaaaatcagaaaatcaggggtggagtctagcaatatgtgtcttaggctctcaaagtggctttgatgcatgctcaagtttgagatccactggcttatattcttagcccttctggcaaatatcttcctcatttaactggccctgtatcattggttagctggcagccaaactgtcaacactttatgagatctagaattctgcgatctctaacacagaaaatcccaattgcttactgtccaaacctcattcatatttcctttatgatcctaggtctgacaacatcagaaaatgagtattgccacagaaatgagttttccagaaatataaacttagttcctttgaaagtaaattttaaaaatatattcttcatggttatgggtgataagggtttgaaaagaccttactggtcagcactgccaacctccttccttgtgaaggaatcatcagtacagtagctcatacaagtgtccattaagatgctgcttgaataattccaaagaggggagcttaccaccttagcagacagttcatattctgtgttccaagagtttccaaaggatatatcaatgaggaagctccactttggtagcaggcagaaatgatttgtttggtctgactgaaagcttggagtgctttaaactacattccagaggcagctgcctgctctgcttttccccaaggctagctctcaactcccagaatcccagaatgagagcacatcaaatcagtacatttagagggtactgagtcccccttatagtgcagagagggaaaatgaggcccagagagaagggacttgtccagtgatatatagtcagttagtgacagagccagggctggatctcagaactcctgaattcttctgctctaccacagcctgcactgatgcctgctccccgagctaggcctaagccacatctcaaggaaaggccctatcattcaccactacctctttctcaaaggctttagagataggctccaggcagccacgtaccacattgatgtcagcgtggatcagtcggagttcctccacatgggccatcttctcctgtagcagaaggtccatctcctgcttgtattccttcaggtgcctttcctctgactcaagtgcctcaaactcagccttcaaacgagccttgatcttctccatctgcagggtcttgttcctgcaatttgcaaaaagcaggaaacaggccagcaaaagaagggagaaaatagaaatggagccaggactttttttctaagccatctttacaagcttccccctctccaggcagagccaacc

SEQ ID NO: 6566 - DNA, 1646 bp, artificial
  synthetic oligonucleotide
ccttctcctcttccttgacatcattaacactgccctgctcctcctgttgctgggcctttgcttcagacccgaagctggagctggctggcttgacgctccaatacaggctgtctagtgtatatggagacttcccaatgggggaggcctcagagccctcctgcaccaggctgttttctccactctgggtataaatggaacagatgcgcagcagcttctcctgctcctcgtctggcaggccctgccccatggctttgaagatgctgagcaaagggagggatggggtaggaaagattcaaaatctcaagccacttcataccccaacactccagggtttgaacttggtctctgaacttccagacctgcctctgaaaggcagtgtagtagagcagacagaacatagaaacaacaggaccatggacccagaacaaactctgtggttcatctctgtgcctcacttccattctcaggtaaaatgaggacaataatgatacctaatgtataggattgttgggaggagtaaataagaaagctcacatagaatgcctggcacagtgcctggcacatagtgggcatgcaataaatgatagctattagtctgcacttaaaagctacataaatgcacaaaacagccaacaggcctgcagggctggaaatgaacagatccctctcttctctggcctagctgagcaacctgtcttgagctccaaggatatgcctggaagtgttctgtgctccttctgcgtggaacacaaactgtgatccctttatgggagcagctacagcccagcctggaatggaggaaaagaaaaaaaaagcagcggctgacaagacaaagcaggatgtgggagggaggccagatgagcactgcgaacctactgcaggcactgcggggctgagggagacagagagcacgaggagggcaggaaagaccaagggagggctttgtgcaggaggtagggcccgggaagcccagagacaagagcaagcacacggtgctgctgcgtgcagtgagtagcccagctagagggcacggcctgtgctgaggagccgtgggaggaagagagggctgggaaggtaagtgtgtgcattggtgtgtgtgtgagggttcacctgccaattctgagtacacatgaaggctatgtttctgaagatcaccaagtgaccatgtggaggctggcctggacaggcagcctggaggcagggagaccagggaggagcctgttccgacagttgaggccagagtcggggagggctgacctggggcactggcagtggagatgggagggagtgaagctgtgaaggacacacagacagacagagagcagggcttggtgactgatggcaggggtcaggcagagttaaagatgatgacactgtgcacacaaaagacggcgccaacagcaaaaccaccaacagatacagagctgctgggaaggggagctcgaggggagaggagggtgagcacccctcacagagcctctcatagagcctggcacctaacaggcacccagtcacagatggatgcggatggttcacagacgggccatgagctcagcaggctgttttctctctgggcacatgcagactggtcacatatgcagggtgactggtcagtgggggcagggctggggggctgatgacttcac

SEQ ID NO: 6567 - DNA, 966 bp, artificial
  synthetic oligonucleotide
ccacatttattgaacttttactatttgccactgtcctaagctcttcgtgtatttgaattttttttttttagtcaccagtaaaagctgtctgagttaggaactatgattatttccattccattttacagatgggcaaattgtgttcagagaagttaagtaacttgttcaacatcccactaatttggaagtggcagagtcagcaatcaatccaagtggcttggctccaaagcttggagttataagcactatgccctaaggcctcccatatgtatcagaatgatgctaagtcaggctacattgacgaggagtcgatcacttaaggagtcagtccacagttggttgtctctttgttactgcatattgtgtcaagctatgtgaaattgccttttatgtgggtttaaagtggtcaaatatgagcaatttcatatgctgatatttgaaatttttaatagttaaatctaaaactttcatgttttgatcagtacaatgccatttcctcttgttttgtcctaaacaaagatagtcactttttggtcagtatcctctggaaaaggaacctctcaaggcttgaagatggggggcaaaattatgactctttttcttctttcccagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggtaaaccattccaccgtttctttcccccatgcccaacaaatatcacttttcctttattgccaggtgaaggagaagaactggtagtgaagattttcttttcttcctattt

SEQ ID NO: 6568 - DNA, 1638 bp, artificial
  synthetic oligonucleotide
atgaagagggagggagagaagaagagagagagagaggaactcgcattcagagagaccaaagagagcaaggaccacagttaataggctagtggaggccaagactacatctttgcacttttgcttgcctctgcctatctgatcctcccacattaaccccgttctaccactcctctgtacttctccagatagagttcagaagttttgtcttcagctacttgtcaaaacatttgtcatttcccaaccaaaccttaagctgttttgggcccttaggaaaccagctcagggtcagatacagagaacatgctccttggacttccagttgatgtatcttagcagtctttctgtggaaactgctgcagagggatcaaagaagatcaatgattcccagcccccattcagtatctgttctagggtggatctatatggtagaaccaacatttattaactccttcaaatgtttttacttatggtctctgctctgtggactaaaggcacagctttttttttcctattctttcctccttttttctttattcattttttcaaaaatcttatctggtagccatataatttctccaaacgtagttctagctaaatacagaaggtttaactcccactcagaataccaggattcaattaaattttctgactagccattcagtggtaacctatcagcccatcttcccacgagttggagcactccaaaaaggctacaagacactcagagcttttctttaatcattccttaacccataagcaacaaaatgtaaccagggttcctgcatgtacacacacacacacacacacacacacacacacacacacacacacacacaagtgtgtatggttgaagtttgcttgcctcttttatggctgcttaatgacttctcatgcctggataatgatgatgacaataataatggtgataatgaatttctgcttatgccttaataagtagttactgacattattgacatcgagtggctcctcttcaggatcctctaggagaagagggatgcagctgctgacctcctccacagcccttgtgtgatggggttgaataggatgtcatgagattgtggttaaaacaaataccaggacttctccgaatgacagcttgctgcagagcaaatcattctcaatgccaggctcttcgcttctcatttctagtcttgatgcttctggtaactctttgtgaccttaaactcttcacctcccaagcctcagtttttctacctgtaaatgagagtggggcatgtaggggatgataagaaaaggacactctctaactctgaaaagttcagggcattgttttgtgcccccccaaacatttccaaggggcagctctgttactctacttgtggctcaaacgtttctggactccttctctggaaggtagcttaaaattctcaagggaaaaggcagtctccgcccatgagccctagcctttttattactgtaaccccaaagattgagctccatctcttcatttgcggttttggactccggaaaaatagttttacagaggtttcctaagccctaaactgtccttggggacatggtttcagtctcatgagtaacctgccacagtccagttcccaaagtggtactccctgaatgtctcaggggactatagtg

SEQ ID NO: 6569 - DNA, 1408 bp, artificial
  synthetic oligonucleotide
tgtctttcggtagaacctgtgttcagagcaattaggaatggcagggtgatcaaacaagcaatgcacttggaccagttcttcctgggaaagcagctcctaagaatcttgccaacctgaaagtaagtgcccacccctctttctgagttatctgcctctgtgtctttttctgactcagagacccagacactctacttcttcccccattcatgacaccatgtagccaaaaggagacctaattccacaagagaggggtgcactgctttgataccaagtacatcataacttcttttaagtctacagtgagatttaccttgaactttggtcttcagctgagagtgatgatggaaaagcggtcaagtactcatctgtgactgacaatgtgctaagcactttatagaggtatcttgggaagacaccacttctctcttctgggagcttaaactgaatattatgtttataagaagaatatttcgactaagttctgagaggtgaggatgggagaaacctccaacagctagaaaagcccagacaagcttggtctcataaagcaagctcacctgggcaaacagtccccacagacagcattagaggtagctgtgcagttgaccttctgaacacgattgatgacagcacaggtgatgcaactctgacatctgtggtggccccagctgcttttgtacctgcgaggagggcaggctgtgcagtaggcatctccaccctctccataaccacaatcctgtagacagatgggggttgttaatattgctttataggagcttggagatgggatcacctgtgggacaagtggactgtacagggtagtattttgcaacttgcaaccccattactaagtcataaaaccaattcactagcttccagccagcattgaaagataaaatagaatgaaatagaataatagtatcaaatataagagtacatggaatgaagtaaagctaagtatttgtatcagtcagcataggctatgctgcagtatggcaaaagtcaaaccctaaatctcagtgtcttaaaagaataaaagtttatttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttg

SEQ ID NO: 6570 - DNA, 331 bp, artificial
  synthetic oligonucleotide
tcattacttccccttattgtctgctctcaccttactcaaatcacttcaaatgtagttctgactcagacaagtagccaaaccctctatgcctactctataccttagcaggcctatgctcagaagctcagcacacactgaccagaaggctctgcaataatgactattctacacatgtatttgttaataatattactttaaagtaatgtgggatataaccctttaaagtcctgtatacatgtacctcattcaatctttataatcacaggaaagtggaattactcttattgtagcaatttactaattggaaagggcagaattgctgtctgttgga

SEQ ID NO: 6571 - DNA, 488 bp, artificial
  synthetic oligonucleotide
atttttttcagataaggaagctaatatgtaaggaaggcctcaggagactgcaagggaactaagtcagcttaattctgcaaacgtgctaaattctgtgctggtgctaggaatacagaggaccatgggaatacataaccccagtaatgtgggagagcagaaagataaacaatcagacaatcaccagttttatatacagttatatatatagtgtctactatataccaggcactgtgctaagtacttaagttagatgataaacagtgttatagtgcagagtgaccaatgccgtggcaaaagtaagcatgggggctatgatatcgcaactgggagagtggcatggggagtcatttaagggatcctagagaaaatgatctctggacaattgctactcttcagatacttacaaaagactagccaaagcttgcctttcttaactaaaaagccagatcactcacccatcccctctggcccaagaaagcccacagtta

SEQ ID NO: 6572 - DNA, 1718 bp, artificial
  synthetic oligonucleotide
agagtgatctcccccatcaagtgtttgacaaggggattgaaacatgactgttcaggcatgaaaccctgtgtttctgttaattatgatcatacagctgctaagagattgattaagggcttaaaatctatgcatcctgatgactgatgttgcacttttgatctcaaatcttacctttcgatgagggtggcacacagttcagccccaagctctggaaaaagtagagatcctgccaaaggaagatttcatccccattttcccaaacctcattttctcaactcagaaacattttctatcatcatctccaccatgatgctactgccctaggactcctaaaaactgttcaaagaaataatctcatatgtatacatgtgccatgctggtgtgctgcacccattgactcgtcatttagcattaggtaactaatctgcacattgtgcacgtgtaccctaaaacttaaagtataataataaaaaaagatgattatcaaaaaaaaaaaaagaaataagctcataggagactgaattttcaacgtttctcttggaccctctgcctgctttctcttcagcccatctgatttcatttcaacagtagctactacagggtatatgtgtctgtgggttgtagtacagttgtgggaaacaataatttccctagtgtaagccggcatgtaggtaagctgagaacctacactgctcctcagcagatgtgtctcacatgtgcccattgcttgaagagctttggtttccacttattttactcaacaattaattttcctaatttggactggaaagaaaaataggaggagggggacaaaaagagaaaacaatcaagaaagggctgaagaggaggggtggtgggggcactaaaaccactgctatgtaaccagccaacaatgatactacatgtttatgggctttggttgccatggagacagttacgtaactccaactggtggtgaaatttcatactgcttgtggtggtgagcgatatttcagtcacttagggctacttttaaagagaacaaataaagtagctgaggggccctttgtcttgctcactacaacccgaactaagtttcggccctgcacgccagtcattttccagtttcccgtgtgtagcaaaatgttcccaattattctctgagtagaactaggcactaactcctctcctcagcccagaatggctaggcgtaaggctcaaagcaaaaagagaaaataaataaataaaaaggcccccttttggggtggaaagcccgagtggaaaatttctgcttggaaagcttgtttttgggaaaattatgagttgaggggagggcatttatttttcactagcacagagtccaaaagcttggtatgttctctgtgttcaatctctctctctctcttgctcactattgctctctttctctcacacacacacatgtacacacacttgaatttgcactcaatctcattctttcttctaaatacttatattcacttgcatgctcatgtagattcatgtccacacatgttctacgaaaaacatacatatttgattccacatacaattcacacaaaaatacacatgtgcttgaacacataattaatttactcataatatgtaccttggcttgttcacatacaactcactcatatattctcactcttacacacttacatagtagactgaaccttgtgaaactgccattgttatagttttgtttacacacagggaca

SEQ ID NO: 6573 - DNA, 6825 bp, artificial
  synthetic oligonucleotide
aagtatctacgcattctacttacatatggtgaggtatattcaaggaaggctgtagccattaaaatctcaggaaataatttttcacctcctcaggtgaaagggtcttcaggcctttgtgttctggaaggttcatttatagccatttcccaaatgacaatgcgattgatgagtctagagtctagctcaaatagcaatggactggaagactagtttaggttttactaatgtggaacatagaacaaattatgtccttgtttcagcctgttcatctgtgaaatagagcctatcatatccagtcttccttgcctttaggtttgagttaccttctttggtcaaggtaagtaaatgcctatgatgtttggctgtgcacaagataaagctacaacaaagctacaacccatcttttctctgtagaagactgcaaaaagcaaaagagacccaggcaaaaatctcggaatgacttttggaacagagagcctccccagaatcagaagtcaaaggaatttaaaacatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagcttctttatgaggaaggttatcatatcttggtgcctccttgacagtccgcttaaattaatgacataaactaatgagaatttagcagttcctgcagaaagtacaagtttattttttttttctggtttgtgattgctgcactgaatatgaggagtctagttaaagggacaactggtgttcctgtcttgtgagttgacgaagactttccatttctaggatatagaaaatccttaagccggtttattgaaaattaatcaatttaatcagaatgcaatcaattccaatacaaaagttagtattttctttctttttattgaaaattaatttaatcagaatacaatcaattccaatccaaaagttgatattttcttactttctctttttttccctcattttgtagggatacaatttggtgaaaggcaagagatttcttaagccaaagcaagagtgtcttccctctctgtgttgcatgcattatgtgccatgtttgagctaaaaatctcaaaattgggcag

SEQ ID NO: 6574 - DNA, 1013 bp, artificial
  synthetic oligonucleotide
cactgtgctcatcttaactaaaaccactggcaagcagagtaagttgcaattttccgtttacttatctgcctctcctactaaatgataaacaacttccaagtgtgtgtgcctgccacacagcaggtactaatgaattatttgtaaaggaattgagctccctagtgctgtttcaaacagtcctggaggcagccaagtaaaaggcaagaatctcttttggtcagtttggctgtaggaacagcccaactgactacccgaaacactcactctccacacctaccaaggctaaggcccagaagagaatggcaggttcttaacactgagtgggtaattgaggaggacagaatccttagacaaatcttaatgtgaagtctgttaagccctagacaaagctgagtaccattcagatggaaatgaacagcaaccattcatagcttttgatattgctgggctggtgatgtgttccttttaacagtttcaatacccctgcaattaatctttattctttagtgacggaagtttttttcagatattaaaatggaaaagtatctccatgctaacaccaagtgaccctaaaaggctaaaccacaagggcacttgtgtatctccttttgtgaactttgaaaggaactgatctttgttcagtgtcccagcagctcacagaatcatcacaactccaaaaagcagagtattttagctttgaagcctaggtttaccaagagcaaagcacttggcaaggtcatatggcaaggcagagattcaagcccatatttgttgctccccaagtcttatagttatcccattgcatcccactgcctgcttgtctaacttttctggagaaatcaaaactcatatgtgagctcttctaagctaaagccaccttctgattctctgagggagttacttggcatcccatttaggatactcttccttcttggccttcttatgagatttggaagttcacctattctttggggaaattgctttgcatttagtgtctctctttttattatata

SEQ ID NO: 6575 - DNA, 2553 bp, artificial
  synthetic oligonucleotide
atatccttaacctcttaaggatcagcatttcagatactactaggagtttactcttggtcaggccacaataagacaaatcattaaaagatcaaacacaatcaaatgacctgcaggaacttcgacagtgtacatattctgaccaaaagtgggcagagagcatgtgaaggaaaagcaccgactccacagggcaaatcagaagggctgcacaagaaataccagctggcagcagttaccaacacactaccactttcttttctttttttgagatggagtttcactcttgttgcccaggctgtagtgcaatggcacggtctcggctcactgcaaccaacatctcctgggttcaagtgattctcctgcctcagcctcctgagtagctggaattacaggtgcctgccaccatgcccagctaattttttttttttttttgtatttttagtagagacagggtttcaccatgttagccaggctggtctcgaactcctgatctcaggtgattcacccgccttggcctcccaaagtgctgggattacaggcgtgagccacctcgcccagcctcgcactaccactttcaaatctttctttctccctgctcttggttgactgcatccgcctaagaaggttgccacactggtcctagaccctgtatttggtgataaattcactcaaaacaaagttataaccatataggacatacttgccaatgactctgagtttatttttcacaatcatctttcagccaagagaaaaaattaattatcactccacccaatcattaccctccattcttctgtgtatatgctttggcataaagggttggcttgcctgcactctcgttggggatgtttattattctttcttttactccaagcctcctaccaacaagcagaaaaaaaacctccacacacaatgggggaaggagagagcttcccacagctgagtcagctgtgagcactggaaaagcgaagctaggtgaagttccttcagcccagcagcccccaaccctatccctattttactccctgggggctgggccccttgtggcagggactaagtagtcagctctttgttccacactcaagcagaattcagtggcaggtgaagccatccaataatcctgaacttagactgaccttgacctaaaccatagctcagtgtgataaagaaaataattcactggggcaaaggtgctttccttaaaaaataacttgccatggcgaattttttactgccccccacacttatctgtagcaaccagagaccaggacaaaattattattcaagctgctgaccttaatccccaattgtttaggaggtgctggggcagttccttggtcagcttggatgtcactttgccccagacaggggtgctgaatatgtctaacagtacagcagattgtcccttaagaacaatcatctgccaagtaagggtaattgctgagcaagagggtccctggcacagctacggatcacgtcttataaggtcaaaaccactaaaggaaaaggcccaaagttctggttgtatccaccactttccacttctactatctccactccccaagtgtgggaaacccatttgcctcagagatctgggctgggagtcaccctgcaatctcccttcccctggtggtgtggaaaggcttaaaggccagacacaccagctcagagaaacagctcatcgaagccttgcacttacttctcatagcgctgataagcgcgttgccgtctttgattacgtctttgatgaatttgttggtcctctccagttcctgctcataacacttgagcctctcgcggaaatcggggctgtccaggtagcagtcgctgaactccagcgggggatgacccatggttctgatggccgggagtagggggaaaggggaaagacacaaagaccgagagcatcaatggcacagtagaggaagtagaggggacggactgagcgcgcgacccgcttaaggaagctcatagcctccgtccctttggaggacaggtacctgtttcagtgagactcctgaggagcgctggctggtccggacagagaacaggcgccccggcgatggcttcagggccagggagagctaactatcgcagtcggatcccggcagggtgctgcctagcaagcagcatgtcccttaggcatcgccttcccagataagcagcaaaaaccgcagcccgacttgcctccggagacgggccggatccttcctgagcaattgcaaacgtgacacttgggcccgcccaaggtgtaggcgaggttagagctggagctgggaacagcctctctacaggctcctcgctccggagcgagcggaagacttccttggccgaactccgcgggcaacccggattgcactgtcccctcccctttcttaaagccaacgcctgcgccccgccccagcgaagcccgaggaccaaaccggagcgctctggctccttcctcaactgttttccttgtaccttagagtttcctgaccagggcccgctggctgctaagacttcttcctggtgcaagggagccggccggccggccgtccttttaggcgccggaag

SEQ ID NO: 6576 - DNA, 1840 bp, artificial
  synthetic oligonucleotide
cccactcaatcactctctacctcatcctgtctttaaaagtttctccttcttggttcttagtgatgactgaaatttccttatttctttgtttacttatttattgtttgtctcttcctactaagagttcagctgcgtaaggatctcatctgtctagatcactgctatatccttagcatctagcatagtgctctgaagggcactggtattgtataaatatttgttgaatgcatgaatttatagagtgcttaatcattttaaaaagtgcctttatgtacgttaatttgtcacaaagcctgtgaagtcgggattattgctttcctagtcttatgaatgcagatgctgaggctaaagaggttatgagtgatgttcaatgtcacataatcagtaagcaggggaaggtgaccctgaacttgggttctccaattctgaatactgcccttgccaccaacacatcctgtttctagccttgttgatgctataccaaggatggtatgtgccaagcaaatgttgacttattctttaataatctttcttatcaggcctcggaacagtactgtgagctgtggcagagtgtctccaatcccctgacctgggggccttctccattcagggagagtgaagtgaaccagcaggatcagccatggggtagcagaaagtacagttgtatggagtgggcagccaggagtctgggtctgggctccactttgctccttacttcattttccttttctttggacctccatgtgtctttctgtaaaatgggtaatgggtagatcgaacttgctaactttaagatcgctttcagttcagatattgcatctctgcaatgccttgacttcttctctgtttcttttgcagtgcttcccattgctgcaggtgaagaagaacgctggtaagtacacgaggtgggcattgcaagtggcatacaaagagactgagcttctcagtagtcctcatggggcaaccgatcaggtccctgggcagcagagccaacggccgagatgcaaaagccggagacatcctctctgtctccctccactgggcatttgctgtcctcctcgggccctgctttttggctcacgtgcagagcctctttatttctcagccggaggttttgctcttgtcagagagccaggggaggacttccctccagagctttcagcaagtggcagccacccatatacttcccttgttctcaaatgccttctttccactgggaagtgtattaggggtgagagatgcctcaggagagaaaacaggtaagtggagggtaaaggaaggagacttggaatttggggttcagtgtctgttatattcccagcacttgctttatctagaaggcttccaacaggaggtaggctttggagttcattagactgaggtgatatatatagccttttccttttgctctctcacaagtttctgtgagcccaacttcccatcttcctggtgcctctggtgtcctacttgggtgtggataagtggatggcatactgggagcaactaccttccattgagaaggatacagttgtctagagagggataacagctttgtggaggaagagaaagaaggctactggccagggaagagtttggtgctggagcctgaactcctggtatcagctgggctttgctaaggtcatcgaggccatcgtcctggctctagcctgacttcagccattcccattggctccaatttttcatcaggatgagctcatgacttgaatgagcatagcttctaggagacagttaggattggggttgccaaaacagaaaggcatctattaacaagtggcatgctaagggcctgtgcaaggcatcttgggaagacgttggaaga

SEQ ID NO: 6577 - DNA, 2666 bp, artificial
  synthetic oligonucleotide
cgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttaggctcccagtttggttaggatcaggtgtcatggccctgggccttgggaaagctgttcagcagataaaatagggacagcagatttcaaagatacaagggctttagggtgggaagtgtgagctcccggagatctaggtgagttttacattcttccccaccccacaacagggtagttgggcactg

SEQ ID NO: 6578 - DNA, 3800 bp, artificial
  synthetic oligonucleotide
gtattcaggttttgatgtcctagcatgcactccagggatcccagtctcccagctagactactggtgtgtccctacaccctattcatctcatctctccttccttacaccccaatgcagggtccagctgagagctcagagaccccaaacagctccttctttccctacctacccagagccacttcaccctcaagggctgcccctggaagtgggaagggcccagattttccctattttctcctctatttgggagaaaataaaaagacaaaatctgggctattcccacctctacagccacaaagatcatcagaggatccactgagaaacgcagtagctcagtcacctattaagcgagatgatggacatgaaactgtgtgaatggtggagcactttgggaatgttgctcatctaattatctccataaagaaaaagtggggagaccttgtattcttggcagtccctaagcctaccccaaactcagatatccttctagttctttcccttcctccccatacagggtgacggtttttgccaaggctacgcctgtcccaggtcttgtgctatggcaagctccgggtttatcccaggcgcccgcagtgctatggaagtccagcagggggagacattagcacgtgggtacgtcctctggggtccgaccagcgagagtgggtcggacctggaaggtctgagctatgggatcgagccaagttataagcaaagaggcaaggcggggcgggaagaatgggccagggctgggagacaaagacccagatggcgaggccgggacaggctggagtccggcttctccggtccaggatgcccgcttttgctttttcaaaagtctcatgccctgtgctttttcctctttgccctcgaggtgtctttctttatcgacgtgccctctcatccccgcttgcctatcccgggaccttgcccgcgccttcggacaggacaagactaaatcttggctccagaggtcccacaaggctcccccagaaagctgagattccgaaggcctggtccccaggggcgatgaacacgccttctctccccaccacaccccaccctgctccccgccccacctctaaccccaatcaagtactggaccctcaccagtttccccctcccactgttctcacttttatgttcctgactccgggtccaagtgcaagcagacagtgcattttgagggcgagaggaggaaagcccactaaagccttacgtgggactggacgaggagcagacaggctgtccttgacacggaggtgggcacagagcaggacttcaggggtcctgtgtgtaaaaagaaaatggaaatactttcctggggtacttgggacagggtcagtgggctggggtgttgaccagacgcgtggagaggagagcaggccggcagctcttgagagtgccaacttcccacgggttgagctctctgggaacaggactgagagggacccaaccctaaccgcacgagccgcacactcagattggtgccatcgggcgcgcggcgtccttaagagctccctgaaaccccgcccccttcctgctctgggggcgtggtatggggcaaggaccccgccactgagcttgctattggctaagagagcagggttggccttgcgttcgcctgagcaagggagtagacagcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcacaactaccccaccaccaccacacacacaacccctccaaacaacacgcacacctttcagggcggtggctcagtggtttctgggcttttagtgggaagtcgctggggctgttgtagtgacctctggaccttctcttttggcatccaggactcaggttggaaccaagggtcaaaattgcccttcctctcaattttctggaggtcccagcaatgtgcgaacaaccccacttagcaggaaactggggagctttgacctgctccatccgtgatcactgattcctgtatctcaaatttcttcct

SEQ ID NO: 6579 - DNA, 1342 bp, artificial
  synthetic oligonucleotide
ggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctc

SEQ ID NO: 6580 - DNA, 1371 bp, artificial
  synthetic oligonucleotide
gggatatgtgagttactaagaaaccaagaattctgagagagaaagagagctagagttagttcattagggatacttgggacctttgtggagatgcagaggcctccctgccctgggcagctttgtctgttgcccaagcaatagtccattaaagcttcctgggctggtggtggcggggcacaggccaacagtggtgggaggggagggagcccagcagggcctgagccctggtacagcaccacccctggctctgagaagggctcagaggcagaagcgcagccaggcctgacccggagagggcaccgccagctggaggcttgctgctgggccgagacactcccgaacagatgagcctctctatgtccggacgccttcctgccagccttgctcagtggacctagggattctcctttgacaaacgtggaaaccgagaggctgcagagctactgaagagccggggcaggatttgaatcctggctgtgcttcgtccttagcccggcagcccggggaaccggaaggaaggctcagggttctaagcccaagtcgccccggccaggctggcacagggcagcccggggaaccggaaggaaggctcagggttctaagcctaagtcgccccggccaggctggcacagggcagggctgagcgcgggaagtgctggcgcaggctgccgggagggagagctgtgtgtgtttccgtgtctttttgtgggcgtgtgtatgcctgcgcgtttctgtatgtgtctctcccggcggctgttctgcttcctcagcaagcctttccctcccccctccacttcgtttttctttcttcttctccttattcctcattgtcgtcttcttttttttaatgagtcttaattagcgtcgagttcctcctcccgctccctacccgcccccctctccgcccctgccctcccttccctcctctccctcctccccgaggtacaggccaagcgatctgacaaatgcacttgagaacaaagcgccaggctaattcggggcctgctcaggaagcaggagctgagctgagataatgggtctgaaatagcccagcatgattatgcttcctcagcctgtggccaggcgggtgcaggctcaggcgggcaggcaggcaggcagtcggcgggcgggcggacgggcgggcgccggacgccactcgcccagggtggtgagggccatgcttctgcacccacgccggccctcctctggccttcgcaggagctgctatccctcagagagtccggtagtccccagtggggatggtccaagggtcagccagaatcacacactcaaccacagttacccgacaggttgatggcaaagctgagtcacgaatccaagcagccaggctccctgacttcagttctcctt

SEQ ID NO: 6581 - DNA, 2404 bp, artificial
  synthetic oligonucleotide
tacagttgccagagtaaggacagggctactggtggatttggctctggggtactgcctctctccagccagggctaaaggacaagtgacagaccagctgtggctttgcatagtatctgcctggctctttgtcaaggcccaggcagaatatatttcccaaggaaggccttgaaggactgaggcactgctagatgggagctttgtaagcaagacagggtgggagcaggatcactggtcagtcaacaggccatcaagaaaccctgggtcctggaccatgtgttcccactcacccaattctagtgcacagcagcctccttctgggggtacattctgtccattcttcaggggcatgaaatttgggtgagggttgaattccaactcaggatggtggtggagttatatagacgtggtgattgtcagagctgatgtgtgccttagagactgccataaacaggcaccttatgggccacttaagaccctcaaagtgttttctttggctcacacagtgcctacattaataagaaatgagctgccatcacttaaaattcagagtttgatgtaaaaattcagatttataacttctaaaaaaatctgaatttctagtaataccaagctcacattctcgcagggcaaccgacagctggagctgagcgacagctgtctcctgagccagggcacatgctctttgcttcttcatgatccccacctgcctgagtttgcccttcatgtggcaaatggggaaactgaggcccagagagaaaggcgggcacttgcccaaggtcactcagcccaggtcggggacagagccaatatttgaacccaggcctcctgcctgctggccaaccccagaccctttccccatcctcctcctccccagacctctgccacggggccacaaggctcctctgtcagaaccagccccctgcgttcccaaggcctgacagcctctgtggccagcctttgtccagccaccttcctgtgtagccccttcagccgcccgggccccagccctggcccaggcccccttcgggtgagagcagaggcgctgcggggcctctgcagcccggccccatctcccgcagctcggaacaagaatctcattaagtgcagggggcggctgccgccgggcctggggcgccctgaccacagagctggcttccttctgcaaacagcccaggccaggccgggctagaccgggctcgggctgggcgggccttgtgtgtgcgcacggagcgggcaccgcagccgcccctcggctcctcctgctgcctcgggcctcctccccagcccggccctctgccggccccatccctgcttgggtctccctaccgctcctcctgcccccccacccctttatttctctctcccttccactcctttcctctctcggcccggctctgtttctgcggcattctgtcttggttttgtcatcatctcaagtgcagccccgttcttctccgtggtctagtttcccatctcagcctcccaggccggcctcctcccctctgtctccgtcttgctgtcttgctgctccagaggggtgccctcgtaggctctgtcactctccatctccgagctccactctctgtgtctcctcgccagtctctcggctttctgtgtcccttgggtctccctcactcgggctctctggcctgctctgagtctgggtttctgaggctgccccaaggcacttctgcggaggtttgctgtgctggataaacatggccccagcagcaggacgtgaggaattctgctgacggcgctttcctcaggggctgaggaggggcagtgtgagcctgcgggcaggggcctcagggagagggcagtgtcttctccatgcctgtgtccctgccttctgaccctctcagtcagctcaggggtgtctccccagctggaaaaaaagaacaggccccaaggggctgctcacctggcctcgcccgctccccaacaatctcccctgacacacacacacacacacacacacacacacacacacacacacgcagccgcagccgccgcagccgcagccgcagccgcagcagcagcagcagcagcagcacacacttccctctggtatctgcagcccagaaccaactaaatggaattcagtcctgtgtttctcctggcctggcctgcctagacctcaagggcagggtctctgggaagggaaacaacccagaagaccttgaagcaaagcattggaggcaaggacccgttagagatcattgcagccgtctctctgctctcagatagctccctgccctttgccatcattccatacttacaagccttaccccctgaggaaaagcttatcccctaccccctatttggaggctttatcccactgtcggttggaaggttctttatttaaaccgaaatccttgtcctgaggttcagatacacagaa

SEQ ID NO: 6582 - DNA, 3561 bp, artificial
  synthetic oligonucleotide
tagacagactactcatggtttccaaagcactctgcattttcctgcctccgtgtttttacctcacccagctcctggaatgtccactccacccagtcccgcccctccaacttccaccccttctcatctcctgggcttgtggaagtccttattcttcagagctgtgacacctcttctgattcctgaaagctgaaggacttcctgtgctcctagagagttttggtgctctcttgtcttgtgtcactagatgctgtgtccacagaacaagatgaatcttggaggtggttgagccagaccttctcagtgctctgagaagaaacctgagagagccagagagaggaaagagcttgaatattcttctgtgtttctccctatccttctggccactgtttcacaatctctttgcttggaggtcctcggagctctagaccctctcccctcttcccccctccctttctcctttctttcctgagggaagttcatctctctgatcttggccttaaaatatagtatttatttcctttctttctttccttttttggaaactgtgtctcactctgtcacccaggctggagtgaaatggcaagatcatagctcattgtagcttggaactcccggctcaagtgatcttcccacggcagtctcctgagtagctgggaggtatgtaccaacacacccagctaatttttgtgttttttttatagagatggggttttgccatgttgcctaggatgctcttgaactcctgagctgaagcagtcatcccaactcagcctcccaaagtgctgggattacaggtgtgatcccctgtgcctggccaaggacaatatttctaattgcctccaggtcatccccatcacatgccctcccccactcacactcatctccagttcaatgtgtcccaattaaatgtcagctgctaccctctttaaacctgctcctgctcttttccttgtgttccctgtgccacactaccacatcctcaacagaatgctggagtcatcctctacacctctttctccccagtcctcatcacatccaatcaattgccaaatcctgcccattctacctccaaggcatgctgagtccaccctcttctctctccagctccacagcctccaccgtggtccaggtctcatcatctgttgcctgtggttgcctccttccctctcctcctacttccacccttgttcatggccaccagtccatttaccacaaggtagtcagagggaaggtttcacaagtcaaagcagataatatgactgccatgctcagcaaccccagtggcttctcagaggtggagaataaatgttgagacactgcaagagctccccttgctcccctcctctcctgtgttttctcttccctgccgtatggaatgtgccaggcctcatctgctcctgagctttgcccaggctgcagcttctgcctggaatacttttctcttcactcttcacatggccacctcctcctcagccttcagacctcagattatagattactctgatgtgtcctttttttcttttttcttttctttttatttttttgtgggaaacagtttgctctgtcacccaggctagagtacagtggcatgattatagctcactgtaaccttgaacttctgtgctcaagtgatcctcctgccttagcctccctagtagctggaactacagttgtgtaccaccatgcccagctaatttttattttatttttttaagagctagggtcttgctatgttgcctaggctagccttgaactcccagcctcaagggatccttccacctcggcctcccaaatcgctgggactacaggcatgagccaccacgcccagcccctgatgtgtcttttgggacccagctccagtaccacctcttcctacaggccttcccagacttatcctctcctccagtctgggttaggtgccccttctgtaggctctgatcctcctctaccactctcctctgctgccctgtcaagctcctatcacagcatggttcatcatggattgtaaatacttaagcacctgtttgcccccctccccccacccaccctgaccctgccaacccctgcaactaaactaggggccaggaaactacagcctgcaggccaaatctggcccactgcctgtttttgtaaataaagttttattggaacatagtcatgtctattcatttacatgttgtctatgactgctatcatgctacaatggcagagttgagtaattgtggcagagactgtaaagccccaaataattattatctggcctttaacagaaaagattgctgaccctctgccccacaagggcagggacagtgtctgtcagttcattgctgaaccctcagcacccaacacaatggctggtggttgataggtggtcaaaaacagttgtcaaatagtgggtgaaatatacaaggtcacagagtaagtccgattagacccagaattcctggatccccaagtatgctctgacctttgatttctcagttctgtgtccctagagacaagagtgaggtcagattgcttgtgtgctcccagccttccctagagcagggccaggcccagagagcaagctgactgactgcccagaggactaggccagagaggaaggcaggacagtgaagctgctctgaagggactttcagtcacctcaaggctgtccctaacactaaggcagtggttctcaatcagaactgattttgcaccccaggggacatttgacaattcttggagacatttttgcttgtcacatattggggacaggagagaggtagctgctagaggcatctggtgggtagaggccagggttgctgctaaaaatcctacagcctcacacagccaaaatgatctggcctaaaatgtcaatagtgctgaggctgggaaatcctgctataaagtgagggccctcagacctgcatgcatattaaaaacactggatgagtttttgaaactcaccaacatggccgggcatggtggctcacgcctgtaatccctgcactttgggaggccgaggcaggcggaccatgaggtcaggagatcaagaccatcctggctaacatggtgaaaccccgtctctactaaaaatacaaaaaaattagccgggtgtggtgatgggtgcctgtagtcccagctactcgggaggctgaggcaggagaatggcgtgaacctgggaggcggagcttgcagtgagccgagattgagccactgcactccagcctgggcgacagagcgagactccatctcaaaaagaaaaaaaggaaaaaaagaaagaaagaaactcaccaacacttgggctcttgcctagaccaattagaacagaacctctgggactggggcctaggcatcagcattttataatctccccaggtgattctaatgtgaagccagggttgagaacctcctctctgggggaagtttataaggacagaccctgcagatatccccaaatcacccaggatggtctttgcctgaaatatttggccccactgtcaggccctgggtcatttcagcaaatctggctgctatgcgtgtggggtatctctgaacactgagaggggagaagagccc

SEQ ID NO: 6583 - DNA, 2017 bp, artificial
  synthetic oligonucleotide
ccccattcaggcctagtatgaatgaagagcaggctggttggtggctcacctgccttgccagctgcccaggccccagcctagctgagtgccaccttaccttgctgttgcatgtgcacccatgagccgctggctccctggactgactgttggaggactatactgccgacagtgagcccatgcccaactatctgagaaggtgtcccactgccccactgcctggctgctggctttcactagcctcttgcatgtgtgccattgggagggtcgagcctcctggctcagtgtagcaacccctgtgtggcagtgtgggtgtgtgtaagcccgtgttctgccctggggtggataaggcagagctcagctctgcagcctggggcctcctccaagggaagatggaagcagaaatagcagctttgttctggaggagaggaagaaagatgcaggccctcctgggcccactccagtgtcccaggggctctggctgccagctcaaccaggaaatgtgccttctaaacaatgcccaggccagcctgtcttgagccctacttcccatccttggtcagagtcctgggggagacgcctctgaccattgttccgagggacagctcatcagggtcaggcctaggccaagctgggtccacagaccccacaccctgggaggaggcacatgatgtcccagagaagtggttcctccagcctttgttcttggctgggcaggaagccacacgtgacaccatggtttggggtggggagtaggggagaggcgagctttggggtaaacagttttcctttttatttcccttgggaagggtttatgatgggggtaaactgaggtagagaacagacacttggcccaggatcatgacagagttagaacggtaccacaaactggaagggaccgcaaagtggacttagttaggctccatgggggcagggactttgtcctgctgtatccttagtgcctggaacaatgcctggtacataggaagtgctcaatgcatctttgttggaagtaggaacccctctgctttcccatctggtgctccactcacgtgattgaaggttgccaatgcttatagtgctctggagtcgcagacaaacctggcttccaattctgtccacatcactttttagctgggtgaccccaggactcagttttcttatctgtgtgatggaaacagttattcccacctctgagttgttgggagaattttttggagacagctttggtagctttccaggcacatggtaggtactccttcgttgtaagttctcttcccgtttcttctcaccaagtcttctcttttccaggctagacagcctggctcggcagtcacagacattccttattctctcaatgaatcctcacaaaaggccctgtcaggtgtggtacagttaatatccccatcttacagatatggaaactgaggcctgatgagagagattctggccatgcagtaagtggtgtagtcaggatttgaacagcgttctgtctggctactcgtctttttctctaacataacacttgatctacccattgataaatcgcttacgcctcatactctagccatgtgacctcaggcacctcactacatctctatgatcctccctttcttcagctgtccaatgggttaatcatcccaagtcccccagccttgatgacaatccagggggctggggtatatctgccattgtttgcctttcccttgcttctctctgagtgattggcagacagcaggcctctgaatgccatcctccccagcattcttggcaaggcggctgaaactccagcacttttgctctctttccaggaagcatatctgaatgcaagtgagtgagcaggacattattagagggataacattgggtcaactctcgtttattaaaacagcagtaaatcatttcttacaactattattagcaacaaatgacttttgacacactgtgcaattgattgtgacacaccagtaggtcatgactcctcagggagaactgttggtatttctgatagttcttttgg

SEQ ID NO: 6584 - DNA, 2563 bp, artificial
  synthetic oligonucleotide
tttaagcaaggaaacagatttcactttcaatcttctttccaagagattgttataaacaaaaacaggtctggggcaggaggaggagggggaagagaggaaaatgatttgggagattaaggaggcagccacgacagcgtccccttttaaacctcaataacgttgtttttcttggttgttttttcctccttccctctccagccagcgttacttaaaaggaacattatgttatcacaaatcagatttccaaacatcatctccaggtcactgtgaacagctcagcaatttggctgcagattcctggagaaggcgtcccctttaacctcaaactcaggagggagctgcccccattgcaaatgctggggaagccctccctgcggagactgagagaggagagcagccaggccaggctgggccgggcggagtgggtgggggtgctgcatctacaggcagcaggcagtgccacacggctccatgccaccccacctccactgtgccctaaggggcagctgggggatcttgctgcttcttggaggacatccctggctctgctgttggggcctggacctggcaggataatgtgggcttcattttccctctgccataaacatggggcttatcgatgccacggagctgccagggaagattaaagtcagggctggcgccctagttccaatgccaatgagatactacaagtattccagctggggcggtgcagggcagggtgacatgagggtgaggcagagggtatgggacagctgaagggcttctggaagagtgatgttgctccatagtctgctccatctggccaaacacaaagctgccctttgccctccaccttactctttcctctggggacaggtcaggagtcgaggaggaggaaagagaagccaggttaggaggtatctgagatgtataggcctgaaactgcagcaagaaggatttgggctagatgcaaaggatttctaaacagtgaagattcagcacccatgaggcaatttttttcacaaagaattgaggggaacgaatgaactgtaaagagttggtgattttggcatctaaccaatggaaacagctgagggacagcaattgggattggggtccctgcatgttctgtgtgtcctccatggggcccagaattgagccaagccagaaggttcaattccaggtccttgagccaaaacattctttcaatgatcctactgccgttaacgtttgtgcatttcccaatagccctgagatgcaagaactgggacctccattttatagatggaaaaacagaagttcaaagaggaaatggcttccaaagactacagaaggaatgagctaaggagttgaaactagccctgagatctcctggccttcaccttcaggctcttttctttgacccttgccactgtgaggtggacccttgtaggccagcccttgctccattgagtttctaaatgaagcaagtgacaaagcaggcccaagagtgagctcttggccttgaacagggtggaggtggtgagattgtccaaaaaggtaaagaatggtcctgaaaaatctggaactcagagaaagagttccacgggcaaggctgacactcagtcagagagctggcagagaggcctgcccagtgttgtggtgagggccatgtgcaaggctgagatggcagagatgactggagataaagggatggcccagagactacgggtctgtccgggaagaacttcattcagcaaaactgtgcctggagggtcaaagagccacttctgcctggcccaggtggcaagaggctagatacctccatagtcactctatgaccttggggtaagaggaatcagtggggattctttggagacaactcaggagtaacagttggccaagatcttctccctccagagcactgcaggattgggcctcaaatggcagcctggggcccacatccagcacagagaagggcaaagcagctcatgcttaccaggtgcctggcccttgcatgtggttacctcattgactcccgccaacagtcctgtgaggtggagatttggctctccattttaggatggcaaagtaaggcttagggaagggaaggggcttgtccaatactcgtcaaaaatacaacccagaggctagatttgaactcgggtctgtttctctcaagatttatactctctgctaagccatgacctcaagggtacagcctggccccctcaggagtcacagtgaaaggtgcctggtagtggccctcagggaactctgagtttggggggttctgggcctttggtcctccaggttccccactctgagggccctccaactctctgagatcaggaaatggacatggggagacctaggtaggccaaagacaggaagctctgggggccagggggctggttggggaaagatttctgccactgccccgagctacagattcccccctcctcctaggttccctagccctcccttcaaggccctcatagactcagcaccccaagaaagctctgttccatgaagggggcacacagggggcttctgccttgctcctcatgctactgattcctgggcatctggcccggccact

SEQ ID NO: 6585 - DNA, 320 bp, artificial
  synthetic oligonucleotide
cctccctagctgcctttcctccttctatcgcctctcaaatctgcctgctgccagctgccagctgccctccaccctcctctgctcttttcccagcctcatcccggccagctggttctacatggccccttgttcttcccctccagaggcaggggctgcccaagtaccacacaaagaggcaccaaacttccatccctctggtagagagccacaaagctagaggcagccctaaaggtgagcttgtccagccctactctcccctttttttatagatgaggagactgaggccagagggatggagtcaaacagctataacagagcca

SEQ ID NO: 6586 - DNA, 1571 bp, artificial
  synthetic oligonucleotide
actccaaaattcttccatgttctgccacaaacttcattctctgcttcacgaggccctctgaagctgtagaaatggaaggcagctgacatccactgagcacctactaaggccaggcattttcatgccttctacctcattttcgtattaatatcttcacagtgcctgctaaggaaactgaggctcgaaatggagaaatgacccacaggcctaaggccaggaaatggtggcaccacaacttgagcctgggtagttggaccctctcatctgtgttctttccttgtccccttcacatgcccatgcctgcacaccaatgtcctcttgtcacagaaagaggtccagttcatccgtacttgctttgcagcagctagtcatagagcttcagatcctgctcagtcttcaaatggtgaaactttgtgctgacctgtgtgcagcttgtgatctactctggcctgaggctccatctcagctctatttccctaaaattgtattattctaaagctaaaggcagagtgaagaagaaaagtgtacaccaaggacagagcacttggaagagcgagggaatgccttgtgtgtctcaagttatccaaccaactgagcactgattgtgtgtcaaccactggtagccagtttcacacaccttctcttgtttgaatactcacaacaaccctttgggcaagcaacaatcttggcctttttatagatgagagactgaggcacagacagaagaagtaacttgcctaagaccacacaatgagaaagtagcacggtatttttcccatacccactcctacacctcagcctggcctattcccaagggaagaaaggtgatttctgcaagaagaggttccccctgtcccaaagacctcgggcccagaaaaagcgccatgagcacagagaacctatatggcagaggtcaggactacagtcctcagtcagattttgccttatccctgctgcctggagctcacccttgcactggctctgggggattgcctgtctctctccccatctgtctttctcatccttccccactctggttctcagcagtgaatttgtgtgaaacctggactgaattaccacccattacccaacctgcctcattccaaatccctggcattaatgcaatcaatggaggggaagcaggctcccttcagccgcctgtctggcccgccctgcactggcttcttggtgctgctaaagccctgcgccccaaccccttctcctccttgcacgtgtacaggccccacacaccattcacacatgttccttgtagaaactgagcaggtcctctacccacggaaaaggctcttctgaaaactcaactgaatgaagatatatacgtgcatatttattatttcaatgaacgtttatggggcaccaactctgtgccaagcactgtttcaaggcactggagatacagcagtgaacagcccaaagtccttgttttcatgaactttagcatttagcctggggaaggggtgaacaataaacaagtaaccataagttaacaagttaatcccagattgtgacaggagctatgaagaaaataaaccaggcttatgtaattatga

SEQ ID NO: 6587 - DNA, 1674 bp, artificial
  synthetic oligonucleotide
aggcagctttgggtgtgaaggagcccatcttacttgcagggtcccagaggcctggcaggtggcagttggtatctatggcccctccaagcctgagagatcagattatccttttcaaggagaaatcttgcaagccccagttccagccaaaagcttaggttgcccatgcactgccctctttgttctttgtttcccaatatcccagcgactccaacttagagcctcacacagtgggtagcctggatcctggtgctcagagaactataataataacaatgataataataatagttaacacttattgaacactactgtgtgtcaggcactttgccaaatgctttgcatgtattcactcatgactcttcacaacaactctttgaggtaggtcctatatccccattttataggtgaacaaactgaggcacagacagattaagtacattacccatggttacacagctagtaagcggtagaatgaggatgctttttcttctcttaattccttcagggagaggaagattctgataatgataatagtaatagttaatatttattcatcttcacgggcactgggcagctgaaagatcctcaaagctaaagggatgaagggttaaatccttggtttgctcctcagtagctgtgtgactctgagcaaatgccttcacctttcatagcttcttgagtttcctcatctgtaaaatagaaataatcacaatagctggctctcagagtggcgagaggattgtaggagatgatgtgtgaggaagtacttagcacagaggagctcacatcaccctctttccccttctgaaagatacctggggcttttttgtctcattctctccagtggccgggtggagaccacctgaagtcctgagcccaagctgttctttccacgtggcactaaaggcacagtacccagggcctccgggcttttcaggggcctatgaaaacatgtgagccccaagaaaatttattggctctaaaatatgaaaagaaaacagcagaattggaattaataaatgttctattatacgtctacaaaatgtaatataataccaacctcattaattgttaaatttagtattcctaaaaatttcattacatttgaaaacaatttgttggttagatttcctcactttgcaagaattcccaagtatgcacagtgattacaaagaaatcagagccaattgggaatgaaacgagttactcataggcaaataatttcgaaagcggaattataaaatcctttgaaatattttatggcaaaaattacatttaatatgggatgtgggagcattttcatatatatgacacgctgtggggtgaagcctctaaaagtgagagtgcctagggcctgccccaagacagagggaacaagagtccctttgtgaggcacactgggatggggggaagcgtccatgcgccatggtgggcgcccaccgctctggttgttcccctcatctcctaaaaaaacaaacaaacaaaaaaaccaaaaaacaaacaaacaaacaaaacaccaaccaaaaaaaccaccctggccacatgcgtataagcgctggcagaatggccctttcggagcagccctttcatgtactgccctcggctcttatcaaaggccctttcaagaaacaggcatgcctgtgtgcctttcataatcgggaagagaaataaaca

SEQ ID NO: 6588 - DNA, 1138 bp, artificial
  synthetic oligonucleotide
tttctataaaaaagggaactctactaaacatgcagcttgctatccctacttcttcctgtggagcaggattctgtcaggtggagaaaagcattctaagccagtggggagacgagtacaagagcatggaggtggggaaatacgtgatgtgtgttaggaagatcagagagggtggagatgtagacgagggctggatcccgagggcctcaaaggctccctttacatgacaggactgggaagaaagcccaggactcctcaagaccctgagagcactgccctcacatcgtatctcagccctcatctcagcttctttggcaaacctctagcagggttgctgaaacagggactggccttccccaggcaccagcgtttccactgtccagacagctgtttttctctgtctgcccaggtccgggctccaggactggttcctactcaggcattcaaagcattctcttctcctcagaagagagaggcagggggagggggccggcaggggcagggccccctccacatctggaggcgccacattggggtgagctcacctctgaaagccaggatggggaaggcaaggtgaaggggccgggacagcctgccagggtgggctccccttctcagccaaggtctaatgggagctgacaacagcagctgtgggcctttgatctgcccttcaggtatgtgtcccagctcaggatggcgaagctagaatgaggaatgttgatgagggcggagataagaaaagatcagtccaaccaggcagaaagggcctgggccaccaggccagggctcagaagaagaaggagagaaaagcttgtgctagagaaaggcctgcacagccccatcccgtggctgtctggccccttccttcccctcaaaagcgagagaggctcctctggactcagccaggccctgcttgcgtgggtggggttcaacctgccatgtggtcttcatttcaggtcttcacacacacacacacacacacacacacacacacacacacgtacacacacacgttccaccctgcctgcacctggggagacataaggtgggctgagcttgggacttaaatcagcctcagcaggtgaattggggtgggggcctcctggagctgccagcactgagatcaagggtccagcccagg

SEQ ID NO: 6589 - DNA, 1903 bp, artificial
  synthetic oligonucleotide
caacagaagaagaattgtggtactcgtccttaaaaagagacacacaaattattggggatggtcagaaaacaaaaaagtaggaaaagtagagttagtgaaggagataatttcatttggcattcaactcaccacccaattcccgtttgtccttccctgtgttcattaagaccctggacacttgggcaagagcgtctttgtgtggcacagtcacataggaagtcacaagaccccccacagtccgctccaactcatttgggtgccttagtgcgtgtgcatatgtgtttgcatgtctgtgtacacatatgcacatgcatgtataggataaatgtgtatgtgtgtgtgcacatgttcatgagaatcttaggggagaaaaagagtgggttaagatgaggcaagagaagcaggtggcagggagaaaggctcccgtctcccctctgccagctcctctctccctcttcccagtgctgggtggcagcccctgtttacagagttcaaggagctcgactacccacccactgccccacttcaggcccctctcttccactcggcacccccttccatccctgatactcccgatttcttccaagctgtatttgtacacacagttcccagagcatttgcccctcccctgtcccattagattggtcccacagttccgacaactaggtgctattaatatccgttttaaagatggggaaactggggcacagagaaatgatatgacacatcccctccaaaaattgtgctcgaagataagcttcttaaaccctagtcccttggcctctatgggggatcccaccaactctttgaggggcggggtgggggattgaaaaggaaagctgcttctttgtctgggggccggggatcacttgggttccagctccacatcttttcttcacacttcagtttcactgccccccaccttttcctcaccccacagagatgagggaactggcaggctcctgggcaggcggtagggctgtgggggttaattaactgtttcccaaaaagctttgaagatgaaggctcctgcaggaggcaggcagtgcaggccagcttgcaggcaggcagaactgccaatgagttggggcgccaggttgttactaaggaaaaattcccagcttctggcctccactccacccaccccctgccaggtgctctgtactccgcaagctctcgagactccgtgacctatcatgcctgggcgagctttttgaaggtatgcagccctggtggagggggagatgagaccctggtctctggtgggcaaatgaggagggaggggaacgacccgaggctggaggtaatgcaggtcccagggccatgcagaagggaagctggaggtgctgcccaaacatcctgcctgcgagcctgtcccggctcgatttggctctggccttagctcaaccacgccaggttagcccggcacactcctctggcatgtgcctatgtgtgggtgtgatccagaggggcagaaagatggctcctgattcagtgccttgggtcctcagaaggccagaattgggatccgagatgtttttccccaggaaaaccaggtgaaaagtaaacttgttcccacctacaagccagaaagtttccacaactgcttctttattctctttcttgcttccctccctctctcctggtgctgcagatatagaaatggcaataccctgaccctagactgctggaacttacagtctagttggagcgaccaagttgttagataaaatacaactatttaacccagcattcctcttctatgagccatcctacactcatgcacgggaaattgtacacaacctaaatggccatcattagggggctggttttaaaagctattccatactatggaatacaatgcagttggtcaaaagaataagatagatcaatgcatgcagaa

SEQ ID NO: 6590 - DNA, 3053 bp, artificial
  synthetic oligonucleotide
agctcaatctatctaatctaaacaaatctctgagcttgatttagaaagggtgcttgaggcctttggtgccaggcggcctcgtgggcagaggcagggcgagctgtggtcacattccctggaggctttcctgccagctctctgcaaggctggcccagatctgttggctatgggcagggcctgagaaagagcctcagtccaggaggggacagagcaaggacttcctatttctctgctgcctcctacccactctagcagcactgaggcaggcatgaggctgcgtggaaagcagggggagtgcaagatggctacagaaggcaacccaggctatccaagggagaaggggaggattcttctggctggagggtggcctcaggggttctcctgctatcctacccctcctctgagctgactacccaatcaaccacgttggtggctggctctcctaccctccctcccctctccactgccagggcacaactatcaggactcaagccctttccaggcacttagactacctcatgggctcctggcttctcactcacactaggtgagttgccctcttagagagatgagtcttgggggactctggatgggtctgttcaggacctcaggcaggtctaggccactggcttggaggcctacactctgcagccatggctggctcagggggattagcaattatctgaactcacacttagaaatccttgacctgttccccttggtccatcagctatacggcaaaattaaggactgcagcctggagaaaaaagttccttcccactgttgcttgactgagctgccatgggcaatgccaggaggtgcatgggtgtcggtgaataggacagagagacctgcagagtgcaattccaaccctgccactattcgctgtgtaaccttgggtaaggccctcccctctctagctttccattacaacccctaggtcacagaattgctggaggctcaaatgagtcaatggttataaacaaactttgtaacacaaataatttattgagtgctcactaactgctgggcactattctaagcactttctagtattaactcatttaagtctcacggcaaccctgtgacctagggacttatggttgtcacaattatacagggggattgggggagacctaaagcacaaagaaactgtgtaactcaccctaagtcacagagctactaagtagtgaaccaaaagttaagttcaggagacttggctccaaacatttccccttatttccccttaaacactatgctacacagacagtcactaacttataatggttcgacttagaattttttgactttacaatgctgcaaaagcaataggcattcagtagaaactgtaattcgagtacccatacaaccattgtttttactttcgatacagtattcaataaaatacatgagatattcaacacttcattataaaatacactttgtgttagatgactttgcctaactgtaggctaatgtaagtgttctgagcacgtttgaggtaggcgaggctaagctaggatgttcagtaggtgaggtgtattaaatgaatgctcgacttatgatattttcaacttatgatgggtttatgtgaacatacccaaccttaaggtgcatctgcactattaaaggctgcacatgcctcagtatgatttttaaataactgcctctaactaaggcttgtcgtggtgttcttcagagaggaggctctaagggagagcaaatgaggatttggagaggaaagaacaagtgagtgcctgtttttgaagctggtggaggtatgcagaggtcagcttgtgcctgccctggctaggagcctggggccccttggatttcggggagcctctgggcggctcccgttcactctggctgcgggagcaggtcggtggggcaggagcagcgggtgagcagctaatcagaagcagcgggtctgcccgggctgcgccttgaccgcttgactcgctcctacgcagcagcgagcgcctgctgaaaggcctctgctccaccccggagctactggccgtggaggctgcggcggtggtggcggcggcggcggggcgaagatggagagcccgcgaagctcctccccaggggcaggctgcccgccactttgctttgatagcctggtccgggaggcaagtccgcagtcccgcagctcctccggcgctgcacgcattcttcccggccaagaaggaacgcggcgagctaacgggatccagatgtaggagtcctctgggcttggaccccaaataccctaaataccagccaggccaccgggagacctggggacgtgcaggaggcatgctggggactcccggcctcatcgagggcctggaccccaccctcaagccccctccagttgtgctccaggggcctgagggcaagatctggagcctgggcccaggcctctcctctctcttgagtctgtgcttggtcctggtgcttagctgcgaggctccccagctctttccccatgggagatgaggagcctggtgggtagctctgaggcccatggaagaggttatgtgctcctgttggactcagaagccctatcctctgacactgccaccacactcggttctgtccccagcctgagctggccctctttgtccagaggggactttgggcagccatgacgtccaaggatcacaagacttgagtgccaagtcttgggtgcgtgtcacttcagttttccagggctcagttacctcatccctagaatgggagtatgtgtgggcagttctgctatgtgaggaaaaatagatcccagccctgaaagctgaacctggcacctggtggctcagagggaaaggaggcaactctccagagacctctggagtggtgcccccgcccccactcttacatgcttgcttcttctcccacagggcccggccatgctaagcagaaggaaaaggactggcaatgtgtgtttgggtccctgctgcaggaactagaggctgggaggaaagtttgggcaggcaaatctggatgcatccttggacatattccattaagagcggtgccactcaacctatggcggtaagctgtgatcc

SEQ ID NO: 6591 - DNA, 1847 bp, artificial
  synthetic oligonucleotide
cccccccctttataacccccactcccccagtcaccagttagtcattctcctcaaggaaggcttgaggcaagtagtgaaggctgtgggcctctgggcagactgaagaaggcagaaccccaggcagcaaactgtctgcatgtacagaaatcctggggaagcctttggattatctcaaggttcaggccaagctcacccatatttgataagggcagggatccacagccacagtggctgcgtgaccctagacaattaacttcatcacacctcggtgttcccattttaaaaatggggaaataagagggctttcctttcagagtggttatgagaattaacagacaaaatgtgtgagtggacttctgtaaaggcccatctaaatattatcattttattataattactattcaacaaattcaataaacatgctttggctcctttggtgcacaaggcagcattccaggcacttaggcacgagggaggaaaagcgacgggtgtggaggggtacacagagatgagtacaatgcagtccctgctgtctacaagcggaagcagacagacaaacaatttgggttgaaccatatgaaattgccaacattcatccatttttggcccacaaaccagtactacttttgacatcaggcaaagtgaaataaacccaaaatagaaaccaaggagggaatgattttctctagctggaaaaaggagggaaggtttcccttgaggaagtgagatttgactgaatcctgaaggatgggttggactccaataggctggaaaccagtgagaaaacccttgcagcctaggaggaagggagagcatagacaaaggcatggaggcggagtcgtgcagagcttgtttgggaaatggggatggaccgtgttgctaaaggcataaggtacctgggggaatgcactgcagaggagcccagagagccgagcgggacccattgttgggggtcttagctgctgaccttgtcttcccttgggacttggtggctgtccatcagcaaacaggggatgccatcattcctgcgtgcttatttgggcaagtgacccaaagtgggtcggcagcctttctatgttaccacaaaaggctgaaatggtagtcagccaaaagaaagaactttctggaagtgaactataagaacctattctagaatgaccaaggaaggctgaggattcccttcacctggagaccttgaaaagcagaagagattctcatctgtctggttccagaacaattctgcccagaggcagggggctggaccagatgacctatttgggttctttccagtctgctgccttgatgatctcatctttccctcttcctctggatgaggcttcttcaccccagcttagactcatggggattactcctgttgctagagatctcccaggtccccaaagccacagttcttccagttggtgattcacagctttgtcagcaagatcatcccaaacatctagcctccctcatccttgctgtcaacttgagtaagctcagcctttctcctcctagcttcccttggaggtaagaaaaagcaggctattagccttgtatagccaagacccttcctgttcagtcttatcattagccttcctctcacctttgaagagatagggaggacctcccacatgcaatagattttagagtcaaaaggcctgggtttgaattgagactggctgtatgaccttgggcaagtcgtttaagggcacttactgtgtgctaagtgacaacttgttgaataaatccagttgtatgcattatccccattttatgggcaaggaaactgagtgagcctccaagaggttaagtctcttgctcactgtcacccagctagtaagtggtag

SEQ ID NO: 6592 - DNA, 2211 bp, artificial
  synthetic oligonucleotide
caaccggggctggctttcatacctccccacacacctctttcgctcagaagcttcgaggcttttgataaatgttggcgcggttcagcgcccgaagaaggcaggccgctcctgggaggagcctgtcgacattcgacactgggagaaggatggccccacatgggagcagggtgggggtgggggctgcagcccaattccccacagaacaaaaagagatttctctctcccttgcaccagctgctgagtcccagccccggcttgatcatttttcaaactgcagtaaattaacattttctggagcaggaaaaccacactgagaggcctaaataccaaatttagggatggcctcaagcccctttgggcctgcttcccctccccccattcttgctggggactggggaggacagagccccaaaggaacagcttcttccatttcactcacacctttcctgggactggctgagggcccctcccccgttccctgcacacagccctgcctgtcacctcctctttgctgacattcccttctccacctctcccaccccatagaatgtagtgcaggcgtgtttattcccacttggcagaggcgagccggaggacctgggaaagagtgggggagaaagggtccagtgagagtgcagggaggggtcctgacgttgggcccctgaggcacaagttagaagtcctgatacccctggtttcccaaacctgaacttgatttatttccactgagttgtgaagcatacagtttagataggacaaggaagcccccaggctctctggatcatcttcctgtctctgcagggtgggagctcccctattccaagccttcaagggaagacattccgggaataaagtctgctgtgggtatctctgcttttgtatctccttgttgagatacagaagtgttcgtttattctgagcaaggcggttgccctttgctgtgtgcttagtatgtgtcaagtagcacgttgggtgctttccaggcatcatgtcattgaaacctcagagaatacttccagggaagggaaacagaggcagacactgaggctcagagaagtgaaatgactttcccaaggtcccacgtcagaggcaggactgctgtccaggtctattgggtgtcagagcagtgctctcttctcctgccactgtcccgtcacccttcccgctcctctgttcagtgggcccagctgcccatggcgaccttcccctgttccctctgtctcttctgactcaggactgcccacagaggcttgaaccagctgcactgtcctgtcaccagctggggcctcagctctagcagtggggagccaggatcttggcctcacaatggactgggggggggtggccacagctggaagcagctggaaggcaggccttgtagaaggaagtgcaatggcacacacacacacacagagatacacagagacacacacacacagacacacacacactggggttgggtgggtgctcagggaaaccattccctttgcctttccagagagcagaaggaaaaaaaggagtcaggctgtggcctgaacccttgtgtagctcaagccctggggcgcttggctctctcaacatcagagggctatgaagtccctcaaaatctggcacccatctaccttttggaacttatttcctgccccttctctttatactctctggttcaaccaaactcaacattcctcctctgtgccttccctcatgctgttcctgctgcctggatacctgccctcctcacttccccgtatgcaaattctatccatcagctagggcccaggtcaacagccacttcccgcaggaagccttcttggtcctcctcacctcgatacctccctcttctctgccccaacctgaaagaaattcttccctcctcggcacttcctctcttaaggcattagctactttctccctggaatttgaatcatctggatctgcctcttagactccttctagaccaggagttctccgagggaggagcttggtcagattcatctctgtattttctagcaccttgcttgagatttctctgaaatgtattgtctaccgcatacctcacacgggagggtggcatagtgtagtgggaaaaacaaggctttggagtcagaggcacctagggttaaatccctgccctgcttctttccagctggtgcccttgaaccagttaccttcccactgaggcttgattttcctcagctcttgtaagataaa

SEQ ID NO: 6593 - DNA, 1666 bp, artificial
  synthetic oligonucleotide
aggggaaatctacctaggcacctctaggaaagatttccttcctcctagggagacaaagagagagtttctgtcttcctctaggtgatgttaacacctagaagtgacatttggcacagatgtattcatctccaaccaccaggggaaccaaccttaaaaagaagttttgctaaggatggtggaaaaaagagacggaaagattctagttccctgatgatattgttgaaccactgattttgtcatgcttgagcccactctacccctggaattctgttatttgagatagtaattttctaattggttaggctggtttgagtcatggtttctcttactcgcagctaaaaccgtcctaatggacacaagtacctatttcacacagatcttaaaataaaaaagataatccatgtaaagggcatagcactcaatacctattatctttaagtacctagaaattaaaaactgtttgcaggtttatttactacccaaatggtttctcttgtgactcttttttagagaagggacaaagtagcaaatgtacatctctctacacatcctcatagtttatatcttgctggggttgaggtggagagagagaaaaagcatgagtctttgtcttgtcctagaacaatcaagagttgatgtccctctgaggaactggatgggttgaacgcaaattttctgttttgacacaccagttacatcagtaaagagtgactaaagaaagaaaggaattagcaagtcctttgcaatctagaaacctcccaatcaggatgccatgcacctctaagaatctctagagttttcaaaacaggcctcccatagagggattcacaaaaactggaatgtttcctccgtgagaagacagagctgaggccagaacacagctcgttctccagtattccccatctctgaaaatggcaccactatccattcagaagcaaagcatcatctttgacactttcctgtctccttctctgccctcatatacagtacaaccccaagtcctgttaggaggactcaatgaactaataatgcctaaaagtaagcattcagtagatgcctggtacatattaagtgctcaataagtggtagctgctatcattatcatgcaacataccagcctcaggatgggcaccaagctattcccttggttccctcaaacatattagtacgagctgactttttcacaaggaaaatgaacaaagagaagaaggaaatactataatttacaaaaccacaggcagcataaaaacaatctgtcaggatcaattccagtttaatcctagtgaaaaaactaataaacttggaggaccctcaaacagtgtctcttgaagggatggcacactcactcctgatgacctgacacaatcctagcggcacttttgtctggtgtcttctccacaactctctgcctgtcttaccatgtggtctccctaacccaggagcttggactcttgtctcattctagtacaagtgtcaacttcccaacccttccatttacaacacaccagtagctctagtcagtgacacacagctagttcatagctgataggtagagtcacaatgagtgaagcatttgcaccccctagcaggaggaggcctttagaagtccatgatggcagccctgctgttgtagatgatgttgggccagctccccttttccagctat

SEQ ID NO: 6594 - DNA, 379 bp, artificial
  synthetic oligonucleotide
tatcttaatatcttacatttgtatagcattttatattttacaaattctaccatactttcttttactcatcctaattctagcatcattatttattaacagaatatatatatattctatatatattctatatatatatatatacacattgatatcataagactgaagatcaacttggagctcatcttcatacaccaactgctcaccttggacctaggcttccatgattcccatccttccaggagccagactgttaccctgtagcgtccattcctggatttttactcatcaagtgttaagcagcttagaagcgtgcttaaattccaataggctattaatttagcatttcttagcccaggactgctagttctctgagttgttt

SEQ ID NO: 6595 - DNA, 2059 bp, artificial
  synthetic oligonucleotide
aggtgtacctgagaagttcgtgttaaagagtctcataaagtctcatattatctgtgacctctgcacatttaccaacacaagaaccatgttgtacctgagagtattgtggagactctttataatacttggaaggtcatgcacagttcaaattagatttagggagtgccttgttcaaccacatttatgatgtgtcccttattggccagagtagatcctgacacctaagcagaatgaagaacatttcctgggtgcagtacatacttcaaaacatttaatattagtgtgttgaaaagagcatcaaggcaacacttttaaaattttaagtaaaagtataggaaaatgtatttatgagtttggagtagggaaacctttttttttgagagacagggtcttgctctatcgcccaggctggagtacagtaccatgatcaggactcagtgcagcgtcaaactcctagtctttagtgatcctcctgcctcagcctccctagtacctaggactacaggcacatgccatctttttttttttcttaagaaacagggtctcactgtgttgcctaagctggtctcaaactcctgggctcaagttatcctcccaccttagcctcccaaagtgctgggattttaggcatgaaccactcactgtacccagcagggaaattcttaagataaactgaggatcactcataagaagtttataaatttgacacattaaaattataaatttctgttcatcaaaaaacataattaaaatgtgaaacaaaatccaaaaaccagaagatatttgttacacatatgactgataagggattgttaccaagaatatataaagaacttctcaaaccattttttataaaagacacccattataaaaatgatttgaataagcagttcgtagaagaagaaacatgaatgactaataaacataaaaagattatcattcttactagtaatctggaaaatacaagttaataccaccaagttaacatttcatgcctatcaaatttgcaaaaaatcaccaagtctgacagttccaattttggctagaatgtagaacgagagacattttctacactgctggtggtagtgtaaatagttacaaccactttggagaacaatatggcaatagctattaaagttgaagatgtatgtaactgatgaatgacccaggcacttttactcctaggcgaattcctggagagactttctcatgataagtcaggagatatgcacatgaatatatttttaaaagcacattgtttataatatcaagaaattggaaacaacttaaatccccacgagcaagggaataaataaattatggtatattaaatatacagtgaatactatatactagaggaaaatgaatggactagaactacatgaataaatatagatgaatatcacaagcatagtgctgagcaaaaaaaacaagtgtagaagaatatgtatataatggaacagtttatataaagttttaaaatatcctcaacaattctattgctgtaatatataattatataatatataattctatgtagtatacttataagtatatatagaaatatataaaaattataaacaaattcaagatggtatttaattgttgggcaagaaagggcaaggtgatcagggaagaggtacacaataaaaattcaactatattcgtaatgttttatttcttaagttgagtagtaggaacataagtatttattgtattattctttgtgcctttttataacttgtaaacattttaaatggtttttgaaggtattggattggatttagagtcagaaggagactctagcttgccactaaccaactgtatgtccttaggcaagtcacttttccagagaaaattggaacagcttttatgacaccagaagttggacttatttaaaatcatggacaaactgtaatatacacttgtcaatggctgtctggcagtgtctgcacagtttttcagtttcaccaaaatttattgaagtcaaaagaaaaatacgcataaaggccacaaaacactaaagtaaaacttacaatgtcaaaaaccttgaccacat

SEQ ID NO: 6596 - DNA, 2101 bp, artificial
  synthetic oligonucleotide
ttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaattcaaggttttctttctttctttctttctttctttctttctttctttctctttctctttctctttctctttctttcttctttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaaaaaaaaacaaaaaaaaaaaaccactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctag

SEQ ID NO: 6597 - DNA, 479 bp, artificial
  synthetic oligonucleotide
cacaggcttaaaagtaaaatacagaactataaaacttttagtttttagaaaaaaataagagaaaagctttgggaccccgggctaggcaaaaactttctaggcttgtcaccaaaagcataatctataacagaaaaaattgataaattgacttcatcaaaataaaaaatttttgctctgtgaaagacatgttttagtcacacaaaaccatgaattttcataacagctttattcataatagccaaaatgtgcaagcaacccgacgttcttcatcaaatgactagttaaacaaactgtggtacatctctaccatggaatactactcaccaataaaaaggaataaattattggtacattcaacaacttggatgaatctctagggaattatgctgagtgaaaaaaagctacttccaaaaggttatataccgtatgattacacttttataacattcttgaaatagcaaaactatagcgatggagaa

SEQ ID NO: 6598 - DNA, 760 bp, artificial
  synthetic oligonucleotide
ggctagatgtgactttcaggctgtcattttgtaacctctggtatacgtctttccatctcctttttttgtgtagggaaactggctgaccttttattcaagaaaaaaaaatcccaaacaaagaaacaaaacaacaaccataggaagtaacactaagaaacattactctggcagcagtattacagatcaagattatgctgattttttttttttgctgctttttttccttttaattctcactatggattaaccccactgtgatccaactagactgaaaattgggtttgatttgaaaaaggctctgaatgggttgatgaatactagttcagatgtaactgttagatattggagaataaagtagcctaaatctctcagattaagcagtgtaaataagcaatcaaatcggttttaagtatcagaggaactttgggatagactcataaattaaccaacttatttaaggttcccaagtattctatatttctaaaacctaaatcattttttcacatttctacaaaatcttcacaagctatggaaagaaatctttagttaaaaatatatgttgttccaggaagagatgcatttttccttttattctaatcttcttttatgtccccttagtagagttttatattacttttcatttaagttgtgcatatttcttgtttattcttagtttttcaatatggtttgttacctctgtgaagattgtcttgtttgcatcatattttctaatgtgtttttctatcaaggtacatttgtg

SEQ ID NO: 6599 - DNA, 3456 bp, artificial
  synthetic oligonucleotide
aaaagtatttacagaacacttgccatgtatcaggtagtattgcaggctttggggaaacaacacagataagacagacaaggttcctgcttttgtggaatacatgtactactgaagaaaacagaataaaccacttaacaaaatacatgcatattgaaaagtgaaaaagtgttatgaagacaaaacagagagatgtagaagagtggttaggtttgggagtgatgggctggggcagggaggtgggtgcacccacattaggaaggctggttaaagaggtgatatctaagctgagacctgaatggtcacagggagctaactatgagctgcagaacaggaacagcagtctaatgagcaaggggaaggggaagctagagaagcaggcaggggccaaattgggtaggaccttgtaggccacgggaaggattttattccacaacagacatcagggtaagagagcgtgaatcagggagagtcccagatgtgagctgagccccagaagctgacccagctgaaccatgacagacttcaaagcatctggttgctaaagcctcttataaggtccttgtgttcagatagaaaaatgtgaactgaatgatagcccagttatcatacatatttctttttttaatttgaattttaattaaaaaaattttttttagagatagagtctcactctgtcaccaagcctgtagtgcagtggcctgatcagagctcactgcagctttgaactcctgggctcaagtgatcctgagtagctaggactataggcacacaccactatgcaaggctatttttttttttttttttttagagacaggttcctactacctgcccaggctggtctcaaactactggcctcaagcaatcttcctgcctcggcctcccaaagtgctgggattacaggcctgagccactgcccccctcagcctcccggttataagcatgagctatctcacctagctatgtaagtatttatttccccgagttatcaccaaagaggaagacatgacatagggtttggttctcaccttagtcttgtcctggtcaatatcagctgctaatcaactgctgatcatgtttccaaaagatgtgaattggtattgaatacactgatgatggaatcgaggccctgaaaggtctaggtgctgtaaaaagataggccaaatctagcaagatgaaatgcaccagggatagatggaaagacctctatttggggcccaaaagaatttcagttgcacaaagaccagagaggagacactggcatcaacaggaacatgtgtgaaaaagaccagggctttcattgaacagtatacctagtgagtcatcagtgggatgtaacattgccgaaggctaacctgactctggactacctgaatacaggcatagtgcccagaggacaggaggagatagttttgctctattcaaaggtgacccaagctggctgggcatggtggctcccacctgtaatcccagcactttgggaggccaaggcaggaggttcacttgagcctaggagttcaagactagcctgggcaacatagcaaaaccccgtctctataaaataaaataaaataaaaaccagctgaacatggtggtgcccacctatagtcccagctacactggaggctgagcctaggaggtcaagctgcagtgagccaagactgccactgcactccagagcaagatcctgtctcaaaaaaaaaaaggctggtccaagcccatctgggatattattttcagagacgggccccatattttcaaaggaacattgataaattggaatatatcatattagagaggcttgtacagggaaggaaatgataagagtaatggctgaaggagctggggctgtggggcctagagaagagaaggctcagggagacagggcctctgctcaggacccaggggagagacacattgtgtggccccagatagcaaagctaggacccatgggtggaatccaccagaagacagagttcagctatgaaaggaaaatcattgttggtcaggggctgctatggaaaggcagagctgatacctccttggcagtggcactgtagattcaagcacaggcagggggctgcctcccatgtcctgtgcaccatgattctggacattccctattttctttcccaccttcacagggcattgcataaggataatgtctcggtgaacctatttgtagtgaacaagccctggctcttctctctgctttggtgtgcaggggtggattcggtcaccaccaacgactgccagctgctgcagcagatgcgttaccctatctggcttattgtaagggctctgggactgtcacctctcctcttctcccatccctggttttccttaaccctgtccctctcttccttacttatttcccctgacattctacccttggggccttttcctattttcacagacccctcaaacctacctaatcatatgggtcattaccaattgtgtttccaccatgctgcttttgtggaccttcctcctccaaaggtgagtgctttgtgcctcagctttctgggtccttactttctccagggccctggtgatgaggctgcttcagactcacatatgctgcccaaggcttggggtctctttagttcctttgagattcttaggcccttccttatactatcaaattggcttgaatgtaggaaaggcagttggggggagcaggtgtgggggctggaagggcctgcttgaagctagctgaactcataatgggaagcttttctccccacagaagatttgttaagaagagagggaaaactggtaagaactttctcccctcacctcatgtttctcctcctgtagctttccccttgcttaactccctagatgacccaccctccccctcctccccaggcttagaaacagcagtgctgctgacaaggatcaacaatttcatgatggagtgaatgccctgccctgcttccccacccaagccagtctacattgcccaaacagcaagggttggagagtggcttaagtggaatgcttcaggggtggtgggttgcaagtggggggagctttgccaacaggaggttttgaaccatgagggccctctgcccaggtgatgggcattccctaagctgctatggaatctgctccctttggggttttgacctgagatgtttgggaagagagtgagtaatgagaagtttctcctcaaatgaaactagaacagaggaagtaaaagggagattgctcggataatgtctcagacttgtgtgcacgtgttcttgcatagaaggcacagggtgtgtcggggtgggatagcttggaagagggactgaaggagataacgaaatggtcttttccggagaactgtaagatgatagagacaccatcgccactccacgatgtactgtcttcctcgacccttgcagcttagctgttttcctgcctagaggctaggagctgaagagcccgtctagccgtgtaattctgtgc

SEQ ID NO: 6600 - DNA, 1466 bp, artificial
  synthetic oligonucleotide
gagagatgctcttgactccactcagatccatcctggggaccagagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagcggtggggcaacccaggagggctggagagtgggggcctagaggcctgggatgcagtaggggtcgctggggctccaagcctgtggaccccgagccctagcattgcagctgggcaaagagaggcggtgggaaatgtgtggttccctgtgtgtgtctgtttgggggtctccattagaagactgggaggagccgtgtgtcagggggtaagggcatggcggaggggcacattttcctgtgtgggggaattgggtttgtctcagtgtgggggtttggcaatgtctctgtgtctggcagggggcgggaggttctgcgggggctgtgtgtggtgtgtgtctccaccggaggggaggggagggggcatggtgctctgcgtaggggggacatatgtgtgtgtatgtatgttggggtgtgtggaggaaggcaatggagctgccgtgaatccgtgtggaggagcccatgtgcccggctcgctgagcttcatcccttgatgccatgagtccctctccgtcccagtccctttgtgtgtgaatgtgcacatggatgtgtggagatgtcactctgaatgtggagaggtctctgtagaggaggctgcagggatggctgtgtttgtgtgtgtggctacatgtatatgtgtgtgagcatgtggctgcaagagtgtgcacgcgtgtgcctggtgtgtgtgtgtgagtgtgtgtttgtatgtgttg

SEQ ID NO: 6601 - DNA, 1806 bp, artificial
  synthetic oligonucleotide
tgagctagtcctctctccctctcctcctctctgcttcttgaagccaaagctgtgtggggtggaggtgggacgggggaagcacagcaggacatgtggaggagcccccaccctggtttccagctccccacttctgaggaggaggctagaggtcagggaagggacaacatagccagagaaaggtgggggaggggtgccagggtacctggggagacaggcaagagggcttctccattcttggaggtgaaagtgggagccagcaggcaggtgctgcttgtatgtccagaatcacattttcacttgacaaatagatacacacatgtcctgtctgggaggccatctctgtgggttggccaaatcacccctgtgtttctgaccccttcccttgcctcttcttgcatggctactacatattgaaaaccatggactctgctgccaatcagcctgtgggtcaccaacttctccctcatggggaatcttgtctaccctgctccagtcccacccgtggctttgtctctgactcctgaccagatcccaccctcgccctttctgctgggaaaaacaaagggctcagaatcaaaaatcctttggtagaaaatggattaggactttgactccttctgcctatttgaggaattgggttcctggagtccaagaaagaggtatagagtgaagactcacgaggtgctccaaagtggggcaactgtcctttttcccatgagctctgctggggtacggggatgagtgaccaaaacatcagtggccttaagagcttactgtaatcaaaagaacacctggatatcctattgctctgtcactaattcccagtgtgcccttaggcacatcccatgtcttctctgggcctccgtgtcacctactgtcacataaaggggataggacaagatgatgtctgctgtccttccagttcggacacagtgggagtctatgatcccccagtcagggagaactgtggttcagaaggggaagggttatctgtctaggccactgggtatcccctatggacactgggtgtggcatggtttgcctgccatgctccatctctgccatcccccttaggccaggcctgcacccctcctagtgaaccctgagacactgaagcacagcctctcggtgagtgcaccactggctggctcagtctcagacaattgatctgggctaaatgagcagcttggtttgggctgatatggttggaagcaaagcagggattggtggggtgagtgaggagcggcctcttccaggtcagcctgtcctcatctgtggccaagaggtgacctggggtgcacttgggctcttctactctgtgggagtaggggaggaggcaggttgactaaggggcagatggctggaagggcagggggcactaagggaactgcctgtgtctccccctaggtgaatggcagtgatggcatgttcaaatatgaggaaatcgtacttgagagggtgagtctgccagtggggaaaagcggaaagggaaggagagggttggagccaggataagggagacccctgaatcatggtttcaagacccatggggggacctgcatttagaggatggtgaaacagcggccctcagaggctgcttcactgcatcaatcaatcaacccactaacaaatattaattgaccttgctcactgaggcctggggaattggggaggggatgggtttcccaaaatgatcagcagaggctgggtgtctgacaaatgtgcccagcctgccatggccccttctgaggcctggagaactagctctgggatataaggggagatgaggtacccagaactctcctt

SEQ ID NO: 6602 - DNA, 1221 bp, artificial
  synthetic oligonucleotide
tgagagtggcaattgtgttaaaaaatattaccagtatttctctgtacatttcaacaaacagctaagattgcatcacttttgattgttgaagcactcagttatttctagctagcccagaaaaactttctaaagtttgagctccccctgttgtgtagttacataattaaattccacacagaaaaaatttgagcacctattaggagcaatgaacttcgctagggtttgtaagtacaaattaagtaattattgtttatgaccctaaagagattataatctcatagagtgaagaagataaatgcacaaatgatcataatacaaaatagtctaagaatggcattagagaaggagaaacaaagtgctatgagaaaaaattatttcctacctggaggtaagaaagaagagtaaagagaagaaaaaaagtcatacgatctaaatgggcaccagccttacaaaagcataaatatagctcttacttgcaattgtttcaaaagttttagtttctaaatgaggcaactcccacactgattccaggaagctttccagtaatggatcattcaatttggctctaacttcaaactcgtacagcagaagcaatttctcacatgaatcatttgagaaggtccctaagaaagaggcaaaaatgcaacattctttgtgattatattatattattctctttggttgtaatttcactaactggagaggttttccttctaagaaatattaattttacttacaatttgaaggtcatcttcactgctgtagacagattctaaattttatttttgttttttatttgattctaacattttaaaatctctaagctaaccgctacttccaacattctgtagcgcattcactagaactacctatattttctcaaacaattgccacgatgcttctaaacagcctgagaaaaccctgctgctattattgattctaaatcaaatccagtgtttacttgcttcttgtgaactttcaactgggctggtgctcactctaatggccgagttaaccagaagatacagtgctgtataaaccaacagtgactttattttaagcagaatagaggagagtttccaaactgtttcattagtcgacagaatttcttgggcatcagcatagaaagaatttcatgtcaggtgtcatacactaaactatgtgagacacttttcattcatccttcttggtagattgaacattgaaaaatgttttgaggta

SEQ ID NO: 6603 - DNA, 1943 bp, artificial
  synthetic oligonucleotide
aaattttgcatgctaaagttttgctactaagtgttgtcaaggagacagaagtgtagcagaaagaatatggagtcagacatatttgtgttcaaattccagccctgtcagttatagttacgtgtacttgggcaagttacttaaactgcattcctcctcagtttcccatgtgtaaaacgaagttctgtaaggattaacacaaattaaaacctagttcagtgcctggtacacagtaggcactagatgaacagtccctgttgctattagaatacctggagtagggccaggcgtggtggctcacgcctctaatcccagccctttgggaggccgaggcaggaggatcacttgcggtcagcagttcaagaccagcctggccaacatggcgaaaccccgtctctattaaaaatacaaaaattagccaggcatggtggcatgtgcctgtaatcccagctactcgggaggatgaggcaggagaattgcttgaacccaggaggcggaggttgcagcgagccgagattgcaccattgcacggcagcctgggcaatagaacgagactccatctcttaaaaaaaaaaaaaaaaaaaaaagaataccctgagtaaagagcgatttcattcagaatccctaagactcttgggtaatgcattgaatgtctccaaaaccccacagcagacagcccttatgctgtactagtcatgcccaagctccctcaggtaactaagttctccagcactgacaatttcctgcttttatcatattctgaaggacctaaattccattctcccccaaagacatgatttcacatagttcttatatagacaagtgtttctcatgttttgctattcacttttctttcttcagtttggactttgccaaacttggaatctggaaatcataatttctcaataagatttcaaagcccaagtaggagaccacaatttctcattcaattcactccttcaacaatgaaagcacatacactcttttagttcttcaatgctgtttgagcaggatgctgtccacagagaatattctggccttttagtctgagaagaaaacataaggaaaactagaaaatgattctcaaactgttttgcctataaccacttcaagtgggcaaaagatcctgcaaaccaagtactctatctgcacattccatccttgcattatgggctaagcactagagagtaaagtcctctatcatgcatgctggaagaagccactcctgggcaattctgaaatgtcatgtattaaagtaactacagaccagggtcagaatccaaaagggtaatctaggacagaaagggcaaaaagccattcatatacaaagtacctaaacgagagtcaataaatactgaaataaacattctggatacttcaaatctaaaggatccacatagaatgaaagcagtgactgacaaggcaccaatcccagggccaggccaggtttcaaggcgagacagcacgtagtatctgcgaaaacttaagcataaaacatttctctccttcagatgctgatccgacacaagttaggaaagcgctcggtctcaaggagactccctttcttatttctgctcccacaagcctactgtctgccttttctggaatctaccttccctttaattcaaggctttgctttactccattatcccagggagacctcattagaaagcagccggccttcctgccctccctcttcagacttctcacaacctagtttagttatggagctcagcgatatatcgccttggctttccatcccccagccctcttccatcctccctcccttccttcagtcgctacagccgtgattcctatctccttgaattcctcactctaatctttttccatccaccccaccctatccagccatgcttcacttcctcatgggtagctttcctgcatccccgtccgatgtctccctcaggagttttctgcatcctccg

SEQ ID NO: 6604 - DNA, 2104 bp, artificial
  synthetic oligonucleotide
gcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaaggtaattatgaccctcttaccttcttcccaacaccatctaccccctggaccccctagcctcccttacttctactctggggccccttttactacctcccacccccaccccctttgggaagcccagagatccaccttcaatctccagttagacaaacatttacttagtacatagtatatgccacactcggtgcttgatgctgaaggatcacagatgaataagacactgtccctgccctggagaaaattgaattctctgctcactgctcaatattcgcagcactttggcttgggctgccccaaacacttattcccacagagaagtctttatcctatgtacagcaggaactgtgtggattccccacatgaacctacccttccctcctcccccacctcccaccccaacaccttttctcccattcctgtgggattacttggattccctgcttgcctcccagtacctcagtgtagtggtactgttctagcactgctctacccaggaggagggagtgcagtggcaaagggtaaaaacaataatattcatggggaaaggtagctgatctcatgcactaagaagaaaaagggctgtgagctgccacttggctcagcttaccctgtgctgccaagaaactctcccttgtaaggggctatccaagttttggggggaagtcatcctttactgttaaggaatattagtcatgaagaaggaggtagggctctgactttagagcacaaagttgggagttctcttggccttctgtgaagaaactgtgagagaatatctcaaaggatactctgaaaaacttgtcctgagaaaatatggggctgtaatcacaaaattggggagcctcaagccctattgctggcttgtacctctctaggtggtgaggtcagcatataaccaagtacagaaggttggatgagcagaggaacttcccctaggtataggagactgagggatcagatctgtgctatccctaggggctgggcagaacagaagataggacagctgactgagacccttggcactatttctgggtagactgccacgccacagtctcagctcataaaaagctcccctccttggacccagcctacacagctgtttttcttttcccttaggttcattttccagggtagaggaaataacaagttgttagttatattgtgggagtatagtccgtccttataatctacacttctgtggggctttagagtttacaaagtagtttttaaagtttttattttattaatctttacagcaattctgagattccacattttacacattaggaaactaggtaccaaaaggttaggaaattcacctaataacagcagggtgaggacttgaactcaggtctaactataaatcatattctctaaaaagagcctggcttgctctaattggaatgagggcaaagtcaaatcaggctgagcctgggacttcaaggcccccccacccctctctgaggggaagtctcatgcctgaactggcctccctgatgatatgccaaggttactcccacccc

SEQ ID NO: 6605 - DNA, 2889 bp, artificial
  synthetic oligonucleotide
ccctcccctctgctcctctagctaaacctcttccatcatatcccttcctaagatattcccaaaatcttgcttggtaccccttcactcatcttcctatctccccttcctgagtctttcatgccatttttccttccttcaaaaatgttgttgaggcttagaactcagttagcatcgggactaggaaggaatgagggttactggaagaactatgggatttagccaggcccagtggctcacggctgtaatcccagcactttgggaggcaaaggcaggcagatcacttgagcccaggagttcaagaccagccacggcaacatagaaagaccctgtctctaaaagaaaaagcattagccaggcatggtagtgcatgcctgtagtcccaggtatttgggaggctgaggtgggaggatcgcttgagccccggagggtgaggctacactgagctgtgatcacgccactgtactctagcctgggtgacagagcgaaaccttatcttaaacacacacacacacacacatatacacacacacactatgggattcaaggttagctggtcacaggctatgtgaaataggaatgcagtgcttcagaaagagccttcagggccaggcgcggaggcttatgcctgtaatcccagcactttgggaggccaaggcaggtggattgcctgagctcaggagttcgaaaccagcctggccaacatggtgaaacaccgtctctactataatacaaaaaatttgccaggcgtggtggcgggtgcctgtagtcccggctacctaggcaggagaattgcttgaacccaggaggcagaggttgcagtgagccgaggttgccccaccgcactccagcctgtgcgacagagcgagactctgtctcaaaaaaaaaaaaagaaaaaaaaagagagaaagaaagagagagagagaaagaaaaagggaagaaagaaagaaagagagagaaagaaagaaagagaaaaaaaaaagaaagaaagaaagaaagaaagaaagaaagaaagaaagaaagaaagagaaagaaaagaaagagaaagaaagaaagaaagaaaaagagacttcgggttcagcaacttctgcttgcttaataaaagaaagaggctttattagggggctcctggcaaaattgggcagctgaaaagattgataaatgctcagtagcatgtgcaaagaaaaagcatctatagccttaatcttaaaggatgagcgccgggaaggaggatataggagttcaagccctggggaagaagcaggtgtgggcagagcaggggaccctgaaaaagatggaaatggtgggaagttctaaactgggaaagaggtttggctgtcagaggaaaaatgctgggccttttcctcatccagatagagtggtgaccccagatttccatgtggtatttcagggatcccaacaagccggtcccccaggacaccaagttcattcacaccaaggccaaccgctttgaggaagtggcctggtccaaatacaatccccgagaccagctctaccttcacatcgggctgaaaccaagggtccgagatcattaccgggccactaaggtggccttttggaaacatctggtgccccacctatacaacctgcatgacatgttccactatacgtccaccaccaccaaagtgccgcctccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctccccaggacttggtcttttttctgggtcttgttttgttgatttttcttttttaattttggaacaaatgcttttccaacccatgagtgctaagagcctctggaagggagggcttcaggcccgaaggtctctctggctctaggacccccagtgctcacacaatcagaccaaggaacaagacccccaggaaggaaacagatttaag

SEQ ID NO: 6606 - DNA, 1175 bp, artificial
  synthetic oligonucleotide
cagtgggaccttgtagagttcatcagctgtgatatagtggccaagtgaacaagttctggaaccagactgcctgggttcaaatccagctttgttatttaccagtagccggctaacctcaattatgtcacttaacctctgtgtgccttaattcccctgtaacatgagaatattaatagtgcctactttgtagggttattttgaagatcaaacaaagtaatacaaaacaatttgaacattgcctttaatgcattaagtacacgggaaacggtagtcctctctatccattacaacttgtactctcagcgggaagaatggtgttcagcctgtcccccacccaccatgatgtccagctcagttttgccttttaccaagtttaccaggcacaactaaaggattccctatctggctttaaatgtcctccatactctaagcctcttaactgactgacagtttcctccacagcccctcaacacagtcctgcctccttactggctcccagatatgccttgctcgttcctactctgtgccttcactcacactgttcctcctccctggaatgctaacccggtccttccccttccagctcctacctgtcttttacttctccactcaaacctcacttcctctaggaagccttccctgattacttcagtttattctcatcattcccttctctggactctctcaggaatcaaagttagtgaatacgcactgatatttttcacaacaatttattgggtcttggtcccctctcctccagaagttcggcagggcatgatagctcacacctgtaatcccagtgctttgggaggctgaggcgggcagatcacttgaggtcaggagttcgagaccagcctggccaacgtggtgaaaccccatctctactaaaaatacaaaaattagctaggcgcctgtaatcccagctactcgtgaggctgaggcagaagaatcgcttgaacccgggaggcggaggttgcagtgagccaagattgcgccactgcactctagcctgggtgacagagtgagactgagtctcaaaaaaaagaagttgataaatctcttatgaacagttgggatgttttcacctcctttgccacctgcacccagcacgtagccctatgctgggttcctagtaggtgtccaatactcatggattgatgtatccatatgcccag

SEQ ID NO: 6607 - DNA, 2579 bp, artificial
  synthetic oligonucleotide
gcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaagagacaagaaatgattgggaaatttctcctgccccagagagtggcacaattccctgggtacctcggtgagagcccctcccccgcacatctggagacctatctccttactccctccaaactcagcatcccctacaagctgatgtcccacagtccacctgttgggttgcacgatgaccctgacccctttcagctggacagagcccctaatttcatcctctttcccagtttccttctctcaggaatcaatgcttcccactccagagatgcctccacacaggtcaaacatttcatagcagcagtttcctcaccagcatcaccctcccctgtcagctgtggtaggaaatgccccaggctgagacttggaaaagctgcgctggagtcctgatgctgtcacttagtagcggggcattcccttccccgaacctcagcttccttatgagcaaacgagaactggcccagcacatctctcagctcccttcaacactctgtgcttctgggattcctgaaagatttccccaagtaacagtgcattatcttcccccagcctcacaggggtttccttagagtcactgcccccacaaatagcctctcagagtaaaagtttcccccatggcaagtttgcctcctcagcttccttacctccgaacaggagaaattatttgccactccctctcagagtatgtggactccatgtaggaagtgctggatatcagaaagggagagaaaatcagacacaatctcatgtgaattgttctcccttgagacagtttttcctctttggagagaaagcatggaagttttctttatttgagatttctcctttagaaaaaaaaaaaaggaagactggatgtggtggctcatgcctgtagtcccagcactttggaaggccaaggggagagaatcacttgagcccatgagtttgagaccagtctgagcaacatagagagaccccatctctacaaaaaaaataaaataaaacaattagtcaggtgtggtggcatgtgcctgtagtcccaagctatttcggatgctgaggtgggaggataactcgagcccaggaggaggttgaggctgcagtcagctgtgatcacgccactgcactccagcccgggccagagagtgagaccttgtcaagaaagaaacaaagaaagaaaaggaaggaaggaaggaagggagggagggagagagggagggagggagggaaggaaatgagacctttagaggccgaagcaagaggattgcatgaggccaggagttcaagactagcctggacagcatagcaagatcctatctctattttttttttttttgagacggagtctcgctctgtcacccaggctggagtacagtggcgcgatctcggctcactgcaagctccacctcccgggttcacgctgttctcctgcctcagcctcccgagtagctgggacaataggcgcccgccaccacgcccggctaatttttttttgtatttttagtagagacggggtttcactgtgttagccaggatggtctcaatctcctgacctcgtgatctgcccgcctcggcctcccaaagagctgggattacaggtgtgagcaaccgcgcccggcctcccatctctatttttaaaaaattgaaagaaagaaaggagagagtaagtattcctttccaccacacttagtaatccctgagagagagcttcctctcccttaaaagaggaacattcctttcctacaagaaatttcctttccccttagaaactgacattatgttccatcagaggagaggtccccaccccctcacggtgagagagattccttttcttatcgaaatccatccttttcacccacaacaatacaacaaacacatcccctctccatacaacatgccatcaggagaaagattttctttttaaaattccatcctggtcctggtcggaagcagggaacctcatgccctctccacattgagaaatgctaacccccaccatcacatcagaaatgtagtttctcttcaaagattctaccaatcccccttggaaagaggctccaactctatatcaaggctttcctctccagggggcagtggtgggacaataaagctatcaggctgggtgttacagcccaagtgggggacacaggattcttgggtcccatgaaccaggtaggaacaggcccaaggaaccttgaggggagctggtggacacaatgtctcagggaggtaggaggcagagttagactgactccaagactgacttttcaaatcaggctctgtcacaagagtataagagagagacacagaggcaaatgaggcatgc

SEQ ID NO: 6608 - DNA, 1799 bp, artificial
  synthetic oligonucleotide
acacacatacacgcaccctgagctagggcctggccaccaccgcccaccccaatgcaaggtcagccccccacctcaccctagaccttcacagcagacagtgggcccagggaccccccaacctgcgccgcaggctgccgacttgatggtgaggtcctgggaggtaaggaaggccagctgtgcacatcctggagaagctctgtccttgaatacgctccctcatgatggccgcctttcctccccactcccctttccacagggcctggaccctgcagccccaggatgggaggggcaggtcagggctggccaggctctgtaaatcagcccccactgagtgtcctcacctctccagtcttctggcatatgctgcagcgagtagcgtcggcgggatccccagactgggggatcgggcgctgctgctgggcctcatacagggagagacagacggatgtgcagaactcatggaaggagcctccagaaccagtctgcgccacaaccgagtccttggtgttccagatctccctagaggtgggaacaggtttgaatattcactcaagaccaccctctcatttcctcagcttccgcccctcctccaggatcaatgaccacagagccaaatactctgactctctccctacatcactctctcgcccagctccatcctgctaggttcttaccaacagtctctgtcttactcatactcctgcccagatccctgccctctgcatagcccccaagaccctcacgcacttcttgcagaaggtacaggtctttttgcccgagggcttcttggagaaagtggtgaggcaggatgacgagcagaagagctgaggcagccccttgcgctgataggcagtctgccccttctgcagtggtgtccggcaatgtgcacaagtcatcttggtgcccactgcagagcgcccggccctttgtgacacacttgagcgtagggacatgcgaggagagcgccggggccggaatggcacaaagtcctcatcattggggtcatctaccatggcatcagaatcctcatctgacactggaactgagaaagtggggggatggacatgagaaaggccaccaaaccaggtctccaaccatcccctgaccaacagttcagtccctctcctgggatccctgttgttccggcctttacaccctggcccttgttacatcagtatcttaagaccttggtgtctctctcccttggttactctgtaacctcccagggagggaaagggagaggctctaaatgagaagattcggagacagagatggcatagctgaaacaggaaactcgccattctcactgctcttgttttcaatttcccccactgcccctggttcccatgccaacccatagcagagacaggcacttcatgcgcttcatggagcaggacggcaggagctagaagatccatgccctgccgcatgccactttcggaccttttccacacccagaactcccaggtcacacttcctcaaatcctacttactgctctcagtggaatctacaacctcaggttttggaggttctgctctcctaacgcgctcgcttctcttctgtacctcggaaagatgggaggggaggaaaactgacaccctggccaggctaacactagtacagggtttggggggggatagaagatgggagggggaagggagagtggggacccttggcccagcccttaggaggagggaagaaaaggaggttggactttctccccaacaagcagtagacactagtgctccctccctcctcctaactctccttacacacactctctacagaacaacatctg

SEQ ID NO: 6609 - DNA, 731 bp, artificial
  synthetic oligonucleotide
aacttggcaaaatttttgaacagaaggaaacgctagtcttgtgttctaggttccatgacaacttttatggcctacttgggcctaacaaatagcacaatggtagcaggtgacaggtagggcttttttctaaaggtttagttgtgagaggatgttaatacactattaaaaatgaccagtgtgctgatttatttatcaagttgtctccaggaattctgaaagagttactacaatttttcaaacttatcttgttgaccaaatgtctaggaaaactttgtaaagcttttctgttaagggccccatgtcttagtggattttgagtatgcctttttaaggttgatttcccaattttttacttttgcctgcaaccatatttctttagttctttctgcacattgctttttctctttttagggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactgggtgaggatcttggcttcacagacagataaaaaagagaagggttaaaaaaggagcctacgtaactgcagactgtaattgagggagatctggaggcagaagatgtaagggatgcatgtagaaaagtctgtgaatgaagtagaa

SEQ ID NO: 6610 - DNA, 8080 bp, artificial
  synthetic oligonucleotide
gcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctggtgactgagttgaaggaatgtatgagagagcaggtggttctggcccaccccagtaggcaagggagtggtgagggagttagctatcattcgttaagacctactgtatgccaggctcagtgcacgtgctttacatacattgtcagaattcttaatttctctaactgcttgatttcccaattttgaagaggatgcagttgagggtaagtgacttgaaactgagggtgagtgattacagaattaggcgacaaagttagtatgtaattgaagctaacgtttgaccaagctcactgactccaaagcccacgatctttggagctctgtgatgccttctctttccgacagggtcattgtgagttttttttttttttttttaacttttattttaggttcatgagtacatgcgcaggtttgttatataggtaaactgcatgtcacgggggcttggcgtacaggtaattttgtcacccaggtaataagcatagtacccgataggcgttttttctgattctctccctcctcccagcctccaccctcaagtagaccgcactgtctgttgttcctctcctagtgtccatctgttcttgttgtttagttcccacttatgagaacgtgcagtatttggttttcttttcctgtcttaatttgcttagaataatggcttccagctccagtcatgttgctgcaaaggacatgatctcattcttttttatggctgcatagtgttccatggtgtatatgtaccgcattttctttatccagcctcaatgtgggtttttttttaattattcatttatgagaataccaacatatttttattagatacacttacagcatagtccttctagactgattctggtttcctaatggaatttgcagtgaaatcttgactgtgggagaaagaattcctgttgtcttacttgctacaaaagggaatgtggtaggctctgtctgctcaatgttggctgcagaagtttgtatgaagtgggaaaactaggtggtgttataaatggaggcagattaaggttcatcctgaactttttcctttgtgtgaggacaactttaattccagcctttctcattcctcacttctaacaaatctctgctcagtaacacccaaagatacataggataaatcaattgaatagcatcagttgctttgtcttggataagccactgattttacccaaggtggcttgcatcagcaaaaccaacagctcttgtggctggaatccagggagaaaatgtcctataaacagtagaggaagtttgctagttttcaaaagtttgtatgtacactttgacttaatgcttagtcccatattagtgaggtcacaacacagaaaagtagtcacatttttgaagtttgaggtaaagagagaagtgagaaggaattagccataaattattaaggtatgctgtgtatagattgtgtgggggctagaaattaatatgtagaaaggttatatttgggtggtgggattataggtgattttgtttactttaaaacatttttatggtgttatatcatcttttcaataataaactttttaaaagccagaccagataatagatactcaagagaggtcatgtaaagaacaaaacaatcagttaacacttcctttctgttcctttaacaagttagataatctgaaagttgcattcctaaaacatacttttttactcaccatagaaacaccaaagtcaagtgctttttttagggtgcacaaaagaattggccaattagtgactctttgtattttttgtagattctccactgcagacactcatactcttcatgaggattacacaataaatttctctaaaaatttactagtaggaaacagtttaagggagcttatgtatattaaatgagagttgtatagctcagtaataaccaaaatgaggcctgctaaaagatgatccatttaagtaccaaaagaaaatattagaacttttttttttacagcagtaagcatttaatttctcacacatgtgcagagcatgtgatcaagaaataggcatgaggttagttatatttaatatatattttactcaatgtttttgtgggttttttgttcaggttctttttaaataaatttcattgtgtatatttgaggttcataacatgatgttatggcatacatatagtaaaatgattactatggtgaagcagattaatatatctgtcatctcacatacttttgtgtgtgtgtgaccagaggcagctaaaatcttatttacaaaagtccctaataccatgcaactttattgcctatagtcctcttgtacattagatatctcacttgttaatccatatatctactgctttgtgtcctttgatgtatatcttcctatttcctcccctccagcctcccacccccaccgccatggtaactactgttttattctctgtccctgtgtagttgaccgttgaccttttttttttttttttaaagattccacatataagtgagctcatgtagtattcgtctttctgcgtttggcttattttacttaacatgtcttccaggtccatccatgttgtggcaaatggcagatgtcctcttttaaggctgaataaaatattcccttgtatatatacactacggtttctttattttgtctgtctacatacacgtaggttgttttcaaatcttggctattgtgaataatgctgcaatgaacatggaagtgcagatatttttacgaggtagtgatttcatctcctttgcttatattccagaagagagattgctgggctgtgtggtagttctatttttaatttctttaggaactgttttccataatggctgtaccagtctacatttccagtcacaatgtagtagggtttctttttctccacacttttacaaacatttgttatcacttgcctttttgataatagctgtccttagaagtgtgaggttatatctcatagtggttttgatttgcatttccctgatgatttagtgatgttgagcacattttcatttatctcttggccatttttatgtctttggagaaatgtctgtccagctgttgtccatattttaatcaggtggtttttctgctgagttgtaagagttctttataaattttggggtattaaccccttacaagataggtggttcgcaaatatgttttcctagtctgtaagctgccttttcattttgttgattgtttcctttgcagtacagaagctttttagtttgatgcaagccgctttattttttcttttgtagcctgagcttttggtgtgatatccaaaaaatcattactgaggccaatgttaaggacctttccctctgtgttcttttatgtcttaaaactttatatctttatgttttagttattttatccattttgggttgatttttgtttatggtgtaagagtccagtttttttctttgcatgtagaaatcctgttttcccagtaccacttattgaagggactgtcctttccccattgtgttcctcttaacacccctgtcgaagattagttggccatatatgtttggatttatttctgggctctattctgtttcattgttatatgtttctgtttttatgccaataccatattgttttgattactataactgtaatattttaaatcagaaagtgtgatgcttacaactttttcaatgttgctttggctatttggggctttttgtggttctgtatgatgaattttaggattgtttttctattttaatgaagaatgctactgtaattttgatagagattgtgttatatctgtatgttgctttgggtgctgtagacatttcaacagtattaattcttccaatccatgaacacaggatatctttacatttatttgtgtcatcttcaatttctttcatcagtgttttatacttttcagtgtacaagtcactcatcgccttggttaaatttattcctaagtttctttttttttgaaatagagtcttgctctgtcacccaggccagagtaaagtgccccaatcactgctcactgcagccttgacctctggggctcaaacaatcctcccacttcagcctcttgagtagctgagattacaggcacgtgccaccatgcccagcgaattatcaaaatttttttttgtagaggtggggttttgctgtgttacctaggcttgcgtcaaactcccggcctcaagcctcagccttcccaaagtgctgggattacaggcatgagccactgagcctggcccctaagtatttttttttaatgctattataaatgagattgttttcttgatttctttttcagctcagtaaaggatgcggaagtttgtcaagtgctttttctgcatcaactgagatgatcctacttggtcataatatataatctttttgatgtattggttttgtttgtttgtgacagagtcttgctctgttgcccagactggagtgtgattttggctcattgcaacctctgcctcccaggatcaagggattcttgtgccttggcctcccaagtagctgggactataggcacacgccaccactctcagctaatttttgtatttttagtagagactgggttttgccatgttggccaggctgatctcgaactcctggcctcaagtgatccgcctgcctcggcctcccaaagtgctgggattacaggtgtgagccaccacacctggcctgattattgttgaatttggtttgaaaatatgttattgaggaattttgcaccagtgttcatcagtgatgttgtcctgtagttttcttgctgtgtctgtctggcttaggtatcaaggtgattggagcctcttaaaacgtgtttggaagtattccctctagctcgatttttcacccataacagaagttcctattccagctggggagggcgcactggtccgttcgccctgcctacctccttcagtggtctggtgtctggtgctggtggtcagggttgctgcacgggctcagggactggtgtggcagtggcttccctgggccaaagctctgatcccagtgggggagggcacgctggtgcgtcggctccacctggttagtttgctggtccactgtctggtgctggaggacaggaggctggcagctttcccagatgcaagctccgattccagcgggagagggcacactgctccacctgtggtgcctgccgagttccctggtctggtgtccggtgctggtggtcagggttgctgcgtgggctcagggaccagtgtgacagtggcttccctgggcaaaagctctgattccagtgtgggagggtgcacaggtgtgtctgcctcgttagttccctggtccactgtctcatgctggaggacagcaagctggtcgcttcccgtgacggaagctctgattccagcaaaagagggcgcgctgatccacccatggtgcctgctgcgttcccagctctggtgtctggtgctggtggacacggttgccgcatgggttgggcactggtgccgctgtccgccgtggcttccctgggtaaaagctccagttccagaggcaggggcactgagtttcttcacttagtttgttcacccagcttgttggcagttgatctgaggtgccctgacgcttcgtcttacactggatatgaatgacagtccctaaaggtggtgtataatcttcatgttccagctcaagaaattcccactacccacagctggttctctaggatcttcggattacgagtccctgcctgtgatcttcctcctgcatagcatctcatttgtggatgtttatagtttcagggacataagagcgtttggatatgactgtgcaggttctgattttctctttgtttactttattccagaaatgaaagctcattagcatctacactgaagacgctcctgttcttcacagctttaatgatcactgttcctattgggttatatttcacaactaaatcttacatatttgaaggtaatcttagacccattaaaacaagatgttttcccccaatttaagattctgtgcttttatgacctctttatatctttaaactgggtattcttatttttttcttgtttagcttttcaaaaaatcatattgctcataatgagtctttatgaaataacttattgtttcagcttgacagttttcctatggttttctgtgaaatagcttgcaaatcctttctcttagtaccttttaaagaataggggttggctgacatgggaggaggaattttgggggaatggactttagtgtcagataacggaaggaagagagaatgaagtcccctttttgatgttgaaattttttttttttttttgagacagtttcactcttgttgcacaggctggagtgcaatggcgcgatctcggctcaccgcaacccccgcctcccatgttcaagcgattctcctgtctcagcctcctgagtatctgggattacaggcacccgccactacacccgactgatttttggtatttttagtagagacggggtttcgccatgttggccaggctggtctcgaactcgtgacctcaggtgatccacccgcctcggcctcccagagtgctgggattacaagcgtgagccaccgcacccggcctgaagtctttataattatggttttgtttaaaacaatgtttgtttgtttgtttgtttgtttttgagacggagtctcgctcagtcacccaggctggagtgcagtggtgcgatctcggctcgcgtcaagctctgcctcccaggttcacgccattctgctgcctcagcctcccgagtagctgggactacaggcgcctgccactacgcctggctaattttttttgtatttttagtagagacggggtttcacggtgctagccaggatggtttccatctcctgacctcgtgatctgcccgtcttggcctcccaaagtgctgggattacaggcgtgagccactgcacccggccaacataatgttcttaatatatagaaggtactcatatcttttagtgaatactttattcattaccacccaaaatattactttttaattgcctgactagttaaataaatacatcataaaaattaggatgctttgttttttttttttgtactttggtaaattttgcaataaaatggaaactgttttttttctcttgataggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttagttacaaagaaatatgttaatttaattagacaatactctggaaggaattttatcttcttt

SEQ ID NO: 6611 - DNA, 1198 bp, artificial; identical to SEQ ID NO: 5960
  synthetic oligonucleotide

SEQ ID NO: 6612 - DNA, 1364 bp, artificial
  synthetic oligonucleotide
taatagaaaacacagtatgttgcaataataaatatgctgcccaattctgagcagaaaaaaggtagaatagatttgtatatatgctataatcacaattatgtaaaatatgtgtatgaaaggttcaaaacttaagaagtctacaaaatatctagagacacattgctgcagaacatgaatgcccaagcttggtatctggggaccagtggatctagtgactctgaaccttttctgggttataggacccgtattagtcagctcaggctgccataataaaataccacaggctgggtggcttgaacgaaggaaatttttctcacaattctggaggctagaagtccaagatcaaggtgccagcaattaggttcctggtgagggtcttctttctggcttgcagacagtcaccttctcactatgtccttaaaggggtggtggggagagagatagagagacagagagacagagagagagagagatagcactctggtgtctcttcttcttctaagggcaccagtcttattggattaggcctcaccctcatttaaccttagttacctccctaagggccctgtctccaaatacagtcacatcggaggttaatatttagacgtatgaattttggggaaacacagttcagtccataacaggaactctttgagaatgagatgaaagctctataccctctccctaggagactgcaaacaccacctcccacaactctgcacacaatttcagaaaagttcatggacctcaggttgagaagcactgtttcaggccacctttctgttttcacagatggagaaatggaggttttgtaaggggaagtgattttcagtaggttaggagagagccaggtcttttgattcctcgtctagcgcttgtcctaccttactctgccatctgttgtgcctgtacagaactgcacaatagccagagacaaccatcctgggtgaccccagcacaccacaggtcctctggatggagtaaagacaatagctgctccttcacccaagatgctctcatgggttaatctggctctagctgtaactgacagcaaatgggatgtattgtagtgcttagaactagtcaagaggttgggaagaagctgcaccaactttgatatcaatccacatgaggcctgcgtatgaggagatagagtggtttctgccctgctgaaggacaaaatggagactgcggaggtgcagccttgaactatctggtggccttgacgtggcactgcccctccagctcttagattcctcacttgcacactgaccatgagttggcctgttaaatttctccaagagttcttctagttccaatattctgtacttctatgatcttagagcaggaaccatggagaaaaa

SEQ ID NO: 6613 - DNA, 745 bp, artificial
  synthetic oligonucleotide
aagaaaaggcaggatgaagtttcaagaatgtgggtgtggtcatcattgtcaaatgctacggagacgtccagtataataaggatggagaagagtttattgagttggttgattggtgattgtttgagcctaggtcctctgagaagcagatatcaagacaggattagatgtgcaagaaatgtatcaggaaagttcccgagaaaatacgtggagggaactgggggaggctaagaggcccatcagtctatgattcaggtcagttatgaggaatacttgagctgtcagtttatcctcaagccaagaatgaccatcagaagggtctcatttctccctggaatagacctatcttagtatccttgctgcactcagtcattgggctttcctccttcctaacagaacctcacttttttacaggtatccactccacacctggctctatgtgtgtgctgattagaatgtgtcagtacattcccctgatgacacataatggtttgaagatgggcatctgtccagtgaaaatgggggggaaatatttattccatgtttgggagagtgctttttttattctcttcctctggatgtatataaagaagtatattgctccagcccctaaatggtatctagcctgggaataaacccaacatgccaatgatggcaaagcagaaagacagagaaaacctagctcctggatgatgttgtcaagcatctggattaaccaaacttagtgcctaccctttatttcttattt

SEQ ID NO: 6614 - DNA, 7716 bp, artificial
  synthetic oligonucleotide
taggctcagagtgcaactccaaaatctggtgtcaggatgaactgctgcaggcctggagcatgggagttggtgggtgcgtgggaagcatccagcactttcaggtctggcttggctgtgaagggcctccccttctcttctttgcaccttcattttctctctctccttctgaatgtgaaatgccaaggtttataggcaaatcaaagcaaatgttgaattcacagagcactttctggctacttggctctggagatgtgagcgcaggtggggcgtagcagccttggcctccacatgaaaagttcttaagcacttccttccttgtgtcaggcaatgttctactccagaatccacaacgactctctatagccccttcggctgagttgaatcctttagtaaggctcttcatatcttgctctgcctataatcctccatttattcattcattcattcagcaggcattttcagagtacctgtggtgtacccgtcactgggcttggcactgggcatacagcagtgaacaagacagaagtgattcctgctgccatgcagctaacaatcatgtgggggagacaatattattacaaaggaatattagtattactattaaacaaggatgttcatatcaccctccagtacactgtgccagatactgtgctagagggtgatgtgggagcacaggagaggacactttaccctagctgctttcctgcccagccagcttggctggagcacggtatttcaagaactctaactttccctccacataccagagcctggctccctacgctccttcctctgaggctttctgcatctctgctcacctcttgaacccaaggcagccccttattcgaggtctcacctttcctgttgggaagagactggataagaagcaaggtgacaacttatattcccttggcttcttccatcatacatgcagacccactctagtcctggcaagggaggagggactctgctgtgaagtgactccattgcaaatacttgatgtttccttgacgaaagccagggccatctcattgatgaggctggagtgagagcagactaggctgggggaaagggggtagggccaaagctggtttgcttggaattgggcttgttattatagatctctgaaagattcatcagcatcaggaatcagagtagtgagggaggctcagcgaccaggcccagtccaggcctgctgtgctcaggcagtgaagctctgaccacacagtctccttcaatctgctcgtacctcatttcttcttctccagagcagagatcagtctaaacagctcataggtcaaggaaaagtatccctggagagtccagccaagtccctgcttcctcccagttgctctcttggctcaggtttgagtttgccaaatcgagaatttggggtttttattctgcaactggattttacatttcagaaagggtacaagtcttttgcccatttgttgattcttattttaatcagaacccaacttttctaatatccatgttctaatttactaaacaagaaacaactatatgctgaaaagggaaatcggattacgcttttactttatttttaattgacaaacaattatatgtatttatggggcacgatgtggtttgatgtatatatattaatacattgtggaatgattaaatcaaactagttaacatatccattacctcacatatttaccatttttctgtggtgtgaacatttagaatctattagcaattttgaaatatactagttgtagaaccttcttgaactgcttcagggacaattaattatctgaaggaatgcatgaaaacaggccacgcttagaatcattaatgtagatgcaggtattctgttcaaagtattttactggccagtgtggtggctcatgcctgtaatcccagtgctttgggaggctgaggcaggaggattgcttggggccaaggagtttaaggccagcctgggcaacatagggagattccgtctcttcaaaaaataaaaactaaattagcaggagtggtggcacgtgcctatagccctagctactcaggaggctgagaccggaggatcccctgagcccagagtgaattcaaggctgcagtgagctgtgaccacaccactgcactccagccagggtgacagtggtagatcttgtctcttaaaaaaaaaagtgttttgctaatggattataaaggattataaggatgtgaacatttgtaagaggaaaaatgagaagagaatgaagagaaggaagaaaccgaagtacaccaaagtcaaagaagtgggttagaggagagtcagatgggagctcagtgtgttgaaaataagcgttctgagtggaaaggtcctaagtgcatgaggacatatgctcacgtactctggttttctgaggacaataatgtgccccctcttttctgccttctggaatggagagaaatcaggccgtgaccacagggttgcccgcactgaaagcacatctcggctcctgtaaccctcttcggagagcatcccagcagcccagcctggccagggatagagcctatcccagctggcggaccctaccagaaggaggcgtccctgggctctctttttgcataaactatggagtggcgtccctctatctgaattaagtctattgttccagaaaatgggtttgtttctattcatccactccaatggctttacaatgtccagccactgtgggactccctagagacattgtcttcttgaacagtcgaataagatatttggttttttggtccttatttccaagctcctgggtgctagaaggttgtattcacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgattttccattttctggtctaatgccctaccctagactccccttgaagttctcagtgcacacttttctcttcaggagctgtaattgggtagcactgaaattaggccttctcagcaatggtctgaacataagtgccaaatgcaaagagagttggggagcgtaatcagtgcaccatctggccactcccttgtcgctcaggcataagcttcaacagggtgtttagcaagccgaatattagattttgaccgtaagtaagtaaataaatgaacattgtcatgtcttgcccttttttcttccctatgcgttttcctcctaggattcccactcccttactgaccattttgctgggggtcagcattttaccctgcatatcctccatctgtctggattgccctcagattcttcctctagctatttattttgaccatggggcaggagaaacctgggaaggtgggaggaaggttggaaagcaacatggccagagtgaatgacagctgacaggccagcagtatatagcctccctgcagtgacaacttggctgccactgactgagtagtggcaagtcagactggcctatagcctgcaggctgggctggggccctgagaagcagcaggggaggacagagagaggaggagcgagatagaggaggagaaagtggatgctgaagaagttgaaggtgcttctctacacaatcacaatcatgggtcatgcccccaccatcttcaaggttacaggggtggactgggctaggctagttgcctcgcaacatcccacccactccactgaaggctgttctttggtaacatgaacccctttgagactgccctaaaagctcttgtaactggtatggtgtgggagatggggatggaaggaggagacggtagaccacaggactgccgaaggcccctgtggttgtggatctgtggcagttgccacaccctaggcatggccctgcctataagttgaggttttccccacatctggttttgaatgtgtcctgttttatggcatctgtggcctgtacactgggttcttcatctaaaaaatggtgtagtcaaagccattgggaaatagctccatgcctgccaccatatgctgagtcaatctaagctttccaacttctcccttggagatctatataatgtttgtaggtgcttagatgataattacaaaagcaatcaggccatccgcgtagggatataatatctcctttgccatcaaggaagtcactgaagggctagataattctaggtatgtttaataacactggaaaactatcatgttacactagctcatgaacttgctgtgggaaagatgttctgttgcttcttacaattattttggcttgaatacagccagttgggtccgtggtgaaaactccctcttcatctttatgtaaaattcctacttcttgattttccaactttatggcaactctggctccaaatcagaaaggacagctggtttatttgtgtttaaatcataattccagtgtgaggatagactgttgtaaatctatacggagatgaaaaaatgaaaaaagcacctccagactgcaatgagtttgccattagatgaggtgttgtggaccctgagtctgaccgtccttgctaatgaagagaagagatggcctcttgagtcagatggagtggggagggtggcaggaatttggggacttggaacaggcactcagccagggcttactttgtctctgtggtacgtttcatcccgaggctcttgggacagagggttgacagagtatggagggagaagcaaacccattttcttttctcttcccaccccaccctgctttccattttctttttaaataccatgaaattcctggtctgcttcatggtatttccatgtgttgaaaacatcttccctggagatttggataccaaaatgtccactagaatttcttccactttagaaacaagacatttaatcttctcttttttaagacacatgaatagctaaagtgataaaagtgtcaggatgttggaatagtagagtaataggagaagattcaagttatggctcttgggctcaaccttgacct

SEQ ID NO: 6615 - DNA, 1335 bp, artificial
  synthetic oligonucleotide
ttaagagcttaggtttcccaccagactcctcaagggttgtattttattcctgtctgttttcccccactgccctggtatgcagtaagtgctcaatacatattttctgagtgactaacagagagagggagtggcatgtttttgcacttttttttttttttttaagacggagtctcgctctgtgacccaggctggagtgctggagtgcagtggcgcgatctcagctcactgcaagctccgcctcctgggttatgtttttgcacttctatttggccagccaaataaactccagatagcagaaagtgacagatgtcacagctagatcaccctcatcttacttttatacttgagatgacactccttttctaatttaaaaaacctttggacaaaaacccatgtttttattgttatctttaagagctttctgtgtgcctgacaatatatacatcattaactcattttatcctcacaatgattgcatgaaatagttaccattattatctcaattttcttgataaggaaacaggctcagagaagagtaaacaatttagagttatggagtaagttgagcatccacaatttgaatgcccatccatgttctccatcacaatcaatggggaatagattttactgaaagcaaggatcagaaaagaaatgtgtttttaccactatcagggaggagattttgttcaatgcactgagttgggataggatctgatggagggctttctagtggattgcaagagattcagcaggaacatatccaatgagattaaaaaaagagttaaaatgtctgggggggcacagggagaaaaaacaggaaattgagttttctctgtgaaattaactagcatttttgcctttctttctaatttatgaagctcttttacatttgttatctcatgtgattcccatgacaaccctgtgagttattacttctatttgagaaatgaaaaaaatagactcagagatattaaaactgacctgcccacagtggcaagtgggaagtgaaaaccaagaaaccatttgcactgttttaggtggtggagatacaggagtgaacaagagaggccaaaatatttgtcctcgtggaacttactaggtagataaactatgacttatttcttttcaattaccctctgtcaagtaatagatactggttttggttttcaaccttaactgtattttagaatcaccgggcacactttgaacaaaacattgatgtgtgtgtgtgcacacacactcaaattttaaacctgctctcgggggttttagtgtgcaatcaagctcaagaaccgttggtttagagcagtggttttcaaccttggctgttcatta

SEQ ID NO: 6616 - DNA, 1562 bp, artificial
  synthetic oligonucleotide
gggaaatgtgaaaaccatagtagtagcacacttattaaaccaaatgtgctgctgcaccatcccaagtggcaatctgtggctgttaagtgcaattgctaactaaatgtgtagcctgttgcctaggcagctcatttgaaggagagggggttgtggaaaacgaaataaaatgaaagagtcttggccactgacctggttggttccaggcggagtcggttctgaggtacactctgtagctttagtgtttctagggcctcagggtgggagttcacattagtggtgtaaacaggtactaatgggttccattcagatgctggttgccaaactttctctcagaaaaggccagctgggcagcccttcaggctgtgtgcttgagaggggaagtggaacaaaaggagggccctgaggcagggaggggtgagccttagtacagccaggactgggaagctgcctgttggctaggaaaagcctaggggatttgtgagaggccagaggcttttcataaataggaattagggttctgtggaggggagtgaatctcactcctgcctggaaaaaggaaaaatgtgtgaggtgcctatcttccttcccaccaccattatctgtgtccctcctggaaagtctgaaagccaggtgttgcctatgagtgttttgcggaggtaaaggcacacacaggtaaagttacataaagcttctgtgagataggcatcataagcctatttgacagagggaagatggagctgcagagagagggagtgatttgcccgaggccacacagctaccaagtggctgtgttaggctttgagtcaacctcttgacacttgattaggggatactgcttcctaggcatggtgagaggcaggctgtgctcccgaagcctagagatgggagcaggaggctggttcccctgctctctcctgctctggggcccaccacctgtcagtcagcctgggggcctacgtgaccttcagggttctttccagcccttggagccaaaagctctctgaatctctaggcatgtttcccatccagaaatttaggcagtgggtcagtggatggcctctgaggggcctgccagctctgatgttctgaagacctggaaagagcaaagagcccaatagtttttaatgtgtgatccattgagccctagggaatcccacagaggtgtttcaggggctgccatgagcagttctgattctgtcttttatatattagagatctacagatgatttttgtttgcaagggagtgccacttctaaatacaaacaaagagaaacaaaacagaaactttaaagcccctgaactagatagtgaatgagagacaagtttgaacgaaggtgtctgctgtggtgagagtgatgatggtggtgtgtgtgtgtagtggggggagtttgaactggaaggaaaaagaggaaaatgaaaacaagaggaaagaatgaggttacagtttgggtcagtggtatgggtcagttgccattttgaaaagaggagaaagtagaaaagggaaagggaagcaacagctactgagtgcctacttgtgtgccagtttctctgcttgcatcctc

SEQ ID NO: 6617 - DNA, 712 bp, artificial
  synthetic oligonucleotide
cttttttttttttttagttttcattcaattctgaccacatgtttcccatgaatccttagggagaaggaagtcagaaagttagtccttcgcctctccctggctcgccctggagtaccacatggatgagccaaagagcaggacagcctgaggaacttgcctcgtgggcctcacgctctgtagcaactcagaggcagagagaagctcctgggaggccccatatgtgacagcttctaaggaagctgcttgtggtgcatccatgaaacagggtggaacaactgctgattttgaacaacaaagctacttggaggccacattagactcagaccctgctcaacatttgggttctccccaccccgctcttcttttacattattgaggtaaaattggcattcactaaatggcacatatttgaagtatacaggttgatgagtttgatcatatgtatgcacctgtgaaaccattactacaatcaagataatgaatatttccatcacccctaaaagtttccccttattgatcacctttaatctttcttcatagcctaagtaagggaagaacatggttttattgttgatgggttattcttatgttagaaaactatcaggagcagtggccttggggacctgagtccaacttaaccctctgtgagcctcagtttgtccatcaataaaatgggatagttggacaaaaaaattgctaaggtttcctgtca

SEQ ID NO: 6618 - DNA, 1268 bp, artificial
  synthetic oligonucleotide
ttctcatagacttttacattgccttcttctggaaatggccctggacttaactaaaatgtacttttcccacccctgccaatgaggtatatgtctgtctgtgtttactatttctctctgactggcttctcagaaacagactctctaagtaacagtttcccatcttcccttgtttcctccacactgagatccctaattcttgtcacgagaaacctcctccactgagaccaaccgaatggccagaagttgcccctccccccaggaagccttaacagccagacccatctcttcaccgcttgtgagctctgactacaacattcttgtctctaccttcagtcttgtcaacagctctttgctcctcctttctacctgtcagacttacacccatactttggggcccagtctgaatcctaccttaaggtaggctcaccttgaggaaaactttccagatcatcccagcccaagggactcatgtcctctgtatgtgtctaggacttattgtcagcagcacttattttgacaaatttatcatctaccattatggagaggttgcaaactgttggctggtgagccaaataataatgcccacaggtgtattttgtttagtctgcatgtggtttgtttctttttaaactatgtgctaacatgtagcaattagtaatctttccatacaatctggatttctagcttctttgaaaaacagaaaaatctggtaatactggatctgtatgcccccaagacagtagttagctagattggcatggccgggtggcagcttccactttagatggagtatgtgctctccagctagacacagtccccactactccgtattgtctcactccaacctcattcactcatttatagtaccttcctggctcctaaaggcatttgagttatctgacatatttcacacctgcctaagtttccagctatattacagtctcttagaggaaagaaactttattttgaatttattttgcttcttttatgctgctgtggacatagtagatgcttgatcaatattgagagaagaaataattttactctagataattctacagtgtgttagaatttacttttgctgcaagataaagctttataaatgtaacatctattaagagagtaccatgtacccgactcagtgtcagatgcctcggagcaactttgtgattagtgatattgttctcatatcacagataaggaaaccgaggctcagagagcctatccagtaggactggagctgtagatctggtagtctctgtggtaag

SEQ ID NO: 6619 - DNA, 1820 bp, artificial
  synthetic oligonucleotide
tgaggaatgaatgtttctgcagtgccagaggtggctctgtttttgatccagaaacgaaatggacttcaagattcagacactgggcagagtgatggggccgacacggcccctactggagagtgtccagtcttgatcgccccaagcttttgagcagggatgtcctgtccgaggctggtgtcgtccccactctcgccagagaggatctgtgataggatgagtctcgcctttccaaaatgaatctgcctaaggacccagtccttgatctcctctgtgacctctttcacctgaggtgatggaggttacgaagattggagctgtctgcagtggagcgcaggagaaagtgcacaagctttcgggtgaccagggtttcagtgccagctccatcatgagattgctgtgtgaccttggtcatttcattattcattcattcattcagaaaacactcactgtgtcacaaggcactcacggtgaagggaagagaaggaggccaagcctgtggagacaattgccctgaccataaaatagcttaggccaggtacagaaacccgacacgtaggtaaacactggctgaatgaacaaatgcgatgatttagtcaccacacactagggcagagatttttggtcacttatgctcccgagtacatggaacagtgcctgacacacagtgggtgctcagtaatttgtcgaatgaatgacagaggaatgtactgagtgttctgtgagcacagcagaggccacctaactcacaagattctgtgctgtttgaaccgagtcttgaaggaagggttgggattagttaggcagacaagggccagatggagggtgatacaggcagagaacagcctgtgcaaaagctaggagtcctcagagttctcacctctctgagcctcagtccctcctgtgagaaggaaaggatagggctggctctgtaatttctcagatttttctagatctaaggttctcagattcaacaaatgaatccagttaccctagtcagagcctgaccagtgctgggcagtccaagagactcaggttttgacttttgactcagcccatctgcagaataaaggcctggtgatctcaggcaccccttctccatctgcttcctctgtctttcaccttagaaatctcccctgaatcctatccccataggataaactatctgcagcacaaaagtcagcacttacttgtattctgccatgatttttcttcgtgttattttttgaaatagtctttatttacagatttttacactaacacaggctaattgtgaaaaaacaggaaagtacaaagaagaacataaaaactctccgtaatttcactacctggcatagttccttgatttttttatgccttcattaaaatacacacacacacacatacttcagctcacacagcagcactgacacagatcgctgtgagtcttgtgttcccagcaaaagcatgagctggggacagttctctctttctctccattagtttgtctctgatgggaagagatgttggctgggaccccaaaactctgactctttaaccagctgcagatcatcaggctaaatcctcaaagaacatactgctcagaggacgtttcagtctgaggcagggctctggacgcaaaccactatatggcctcttcttccttcctggagttgggctagggttaagctagattatgtgggggccactagccctgctttggtccagaccagagacagtgctgagcagctttctagggaggggggaagggagtgctctgggatttactgccccacctgtctgagagaagcccccaaaataaacccataaccctagctgacttg

SEQ ID NO: 6620 - DNA, 1781 bp, artificial
  synthetic oligonucleotide
gacaaattctgtaaaggttaagacagtaactattttaggctttgtgggctacatgtggtctctgtagcacattcttctttgttgttgctgtttgttcattcgtttgttttgcaacctttggataatgtaaaccactctctttttttttgacagagtctctctctgtagccaggctggagggcaattgtacaatctcggctcattacaacctccacctcccgggttcaggcaattctcctgcctcagcttcccgagtagctgggactataggtgcgtgccaccatgcccagctaatattttttttttttttgtatttttagtagaggcagagtttcaccatgttggccaggatgttctcgatctcctgaccttgtgatccgcccacctcggcctcccaaagtgctgggattacaggtgtgagctaccgcaccctgccaatataaactattcttagctcatgggctatgcaaagccttaggctgacccctgatccagactgtcttctgagacaagcatttctgtgagctgccccatgtgataactgagttgtgcagtagctgatgtggtttattgccttcccatctactgcattgtcagaccagactgactgcacaggagcaggtggaggggggctgcatatgccaaccattactcttcaatagagtgtccttcatgagctctctctctctctcattactgactacctcagtgtagaaaccctcatttttttccccagacctatccttgttacccaatgtgcctctgcttccctgggtttgggataaactggaaggagagaatttctgagttctcttacttattttgttccataacttctccctcatatctgtggttggagactcccacccttgtccaccctttcctgcctcatactagtatcatgagtttagggctgtcgttggaaagtctggcagcccaggccataggattccagttcagcctacgatttcctagggaaatcaccaggttccaaaggctggtttttaaacctagaatatccatgtatccatttcctaatgcagtttggacctgttctagacagagcactcagccttagcaagaaaaccaatgaggtgcagaagatattctgtgcccacagtttttccctgccttctggaccctcagcccctgggatgggctccttgggattgcccatgcaacaacacagccacaagacattcagcacaccacctcctcctgtgttttgaatctctaaatgaattctgttctaaagcttcttcacgtctctctccatcctgctcccatctccacctctaatgcttcttgggagtctgaagctcagattcacattttcacattttctcgtataaacgttgtgggataagaatggatgatatgtatgtgtctgtgtgagtttggtttctcaacctggactgtgagggctaattcacaaatcacaccatacatgcgtgtgtgcatgcgcgcgcgcacacacacacacacacacacacacacacacacagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatc

SEQ ID NO: 6621 - DNA, 1920 bp, artificial
  synthetic oligonucleotide
aaaatttaaaagtgaatcgaaatttagttttgaaaagcgtttcatgattatttgcatgttttttatttaagtaaaaaacagagggaaggtcaggctttgtttctgagacttgacagattacaaaggttagaaaaatgatcaagacagtatttggataccatagggctgccatcaatatgcgtctccagagtatttaaaacttcttacccatgaatccagcagggtaggttatatcagttcggaccttgccatcgattttaatgaaccgctgcatgcaaatcttctttacttcatctcctgtcagggcatacttaagtctgttcctcaggaaaatgatgagggggagacactctctcaacttgtggggaccggtggatggacgaggagcctgtaacgttaaaaatgataatcactgttgggattcactaaagcactcaaacctacctcctagtccaccagatccactaactgaacaccaagaccgtccatattacacccaacttggacttttacacaggaggtgtaaaaagcatccaaaactatttcataccttaaagttttatagcatcttccctgtcagaggaccaggatcattaagaacatgaatcctgagtccatgtaaatgtactatgtggtatgtggaataaatgaggcacaaaaatattaaatcgattggaagtggaggacagctagatagtatagctccttcaagggcagaggaagccaagaatagatattcctcccctagcctggtccccaaatgagtcctgggagacacttaaaaacagtggccacggaaatatttatataagatacttacaaacacaccggtcaatttatccagcatccaatgctttggagctgccacccgcttcagatgcttcttgggaccacgagcctgaaagttttagattgcaatgctgttaatcaggtttcagaacagcttataaaacctagtgtgaaactaaactcttagtttagtttcatcttcagcaaaatgtggacaatattaaagtatagtgttccgataaaacagaaacaaacacagttatttaacaaacaccgtgagatccataagctgcaacaagccttcttattgtaacagagaatattcttggttactatgtttcagaacgtttactgattactatctttcagaaccttgctaaagtgtttccatgttactgtttgaaactgtatctgcttagaggttagggtctttcaagaacaccatactagtgaaacgcacagcaacagaaatgagccaggagtctacctgtgtttctaaagttttcacaatttattaccgtctgtttttgacacgtatggaacaagattctgacatccgcacaaacacatgtgctgctccttcgtacactaaagccaaaagctgacaccaattttactttaaaaagagtaaggaagcctttttaatgctgtgtccagatgcttaccggccacgtatggtaaagtcaggccgtgccaaaaaggcaatgacaaagaaaacctttctccgccgggcacccccagcgcccaccaacctcgggctcgcagtctgagctcctggcccagccgcggctccggcccgggaggaaaagcagcttctcccgggatcaggacgtatggccgggtcagaaaccgaggccttcccaacagcagcaccagatctgcgcctccccaaccctaggccagcgttcgcccttcgccctggagcccgtcccggcctaccacggaggccgtgatcccttcgcctctgcccggccatccccagtaggaatcccgaaacctcgggcagccccggccgggggaggatggaggcggatacgtcctaagagctcgctaactaaacggcttaccatggctgcgttaggcaaggaaagaggacctccgtcttccggtgcgcgtagaaattggggctgg

SEQ ID NO: 6622 - DNA, 7352 bp, artificial
  synthetic oligonucleotide
taagggcaaaaggcttcactgaccaacaaagcactagcaaagcccaaagcagggcaatgccacgcagctatgaggcaaggatggtgactgagttagaatcaagaccagagatcacccgagcacagggaggagatcaagctggaacttttgcctgaggcaggaaaggtgcttgattcggccaggtactgcccaggcagccacctacccatatcaccaagatgggacatactgcttcctcatgcaagtgacttcacagtcccaaggtgtatgtgtgggggtgagggtggcactgttcctggttcagaggacaggaatgtccctgagtaagcaacatattgtctcaatgggctactagcatccaggctggagagttggggcctccactgggactgggagaatgtgagaagaagtcagggcaaggaagacctagaaagctagaggctgcagcacagggaaataacaagtctctagcgcaaatgtcatggagctccaaagcatgaccttgggcatgcctgtgagaagccaggctgattagggtggtctgggggctctgaggcagctggagccagagaagctaggaatgtgtcactttcctccatgtctcaagccccctccaagacagccccagcattgggctttcctaggatgcctaccccagaaacctgagtccagccattcccatctatagtgacaagtgaggcacagagattcaatgcctttttagtcaggtagcagcggttctgggagcagaatctagcacccctatggccacatgcctcacctgaccactggctaagtcatcatacctagctggattcaaaaggcttccaaagaagtgatttcctggctcaagtgccaaaggataagggaatgaaggcaaaagaatacctccaaaccagaaaataaacaaacctctgaaaatctcaacttattttcctggaggcctgtttacaaagaagaaaaaaatgtcccatagctaggcacagtagcaccctcctgtagtctcagctactcaggaagctgaggtgggaggatcacctgagccctggagtttgataccaggctgggcaacatagcgggaccctatctctttaaaaaaaaaaagccccatatattctagctttcatgatcaattagagatgtagaatttcatatttataaatacctcttggtccaaagaatcttgaggaccttaaaaagagtctctaatctttccaaggaggctagaattctccgtgacactctccactccgcagcggtcattaagaatctgctcagacacttctagaaagtggccacttactacctctctgtatcatctttgcattgcttacttgggtggatgggggtaggggagggaaaaaatagagaaaggggtaaacatttttttaaaaacatgaggaaaaaatatcagctgttgggtcccgcatcattgcttgattgaagccctgctccttctctgaggcaaccgtagaaaaatatttcaaaagcaagtgatcaccagacaagaagtctaacacatgtcgtcttcaagagccctagcacaatcagtatcagacaattttcctgtcctaagaaaaatgtctgggggccctgtccatcttttcctgttcctatccagccttccctctcctttttgccgcttggtacccgaatgtacaaaacgaagaaaaaacaacaggagcagcagcaacaacagcaaaaccaaaagagaaacattagaaaaatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccgttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcgggatctgtcggcaccctaaagccttactgcaaaccgcgtgtgaaatacactctcaagttctcttggtgtttgcctgggatgaaaaaaaatgtttctgcgaaaactaagtggtggagaatgagcgactctaggctttcgaattgcatgttactaatttgaacccctgacccaccctccccgtcagccccggcttggctcgggagcaggtctggcaacagcggcagcttctccgctgcaggctccggatccgggaggtgtggatccgccctccatctattggatggctcccaggccaattgttagaaagaggcatatgttcatctcggcttctggagtgtctccggagcagttgctcaacagccagccccctcccccatccggaccattgaagggcagaaaaaggagcgccctccaccacatttctctgtgcccacatgccagaaagggtctcccccctggtgacttcctgtcatctccactgcttacctcctggggagcaggaacgagaggggcttcaagcactcagctttgaagcacaaaagccacccctttcctttttggggagatgggagaggaggttagttgcagaggctgagagggagcaaaggagacatttgcatttctcggcaaaaatgctctgatcactgacttccccgttggctccagcagagctcagagctctccgctgaactcttatctccaacttggcaactagaccgcgagcttgcgaagcaaggagaggacagggatggtcacctaccgagaacctctgtgctccagcgctgggcctggcatgttccccatccatcatctcatttaattcccaggacagccctttgaggtagggtttaccaaaggtgaatgaaacagagcctcgggaaattgcccaagttcacatagccacgtggctgagtgtttgaatctggatcaggctgtctgcaaagtttttaccctcagccctaatccccgctgcctaggagggtaaggaggctgtctagagtgcaggttcaggggtcagtaggcctgggtttaaattcctactttgccatttgttagcggtgaagtcttaggccaatggcttcatgctttggtcttcaattttcccatctgttaaatggggataacaatggtacctaatctgtgggggttgcttagcctgattggtgcccgcagtgtagtaaatggccaataaatgctgttatcgtactggaccttctgattattttccttttgcctcccgtccctgcctcagctcacacacttcagattcagtaatacttgctgaatgattaattttaaaaccagactgagaggggatgaaggaggtctataaactcagggaggagagagagagagaaaaatgcagatttcttcttaaaatcccaccctccagaaccaaggactgcctgagccatatgacaggagtaaatttgggaccaaaaaaaggtgaccactttttacaggtcagcctataaacttacagagtggtctccagaaacatatactcaatacgtgtgtagaaaaaactttaaaagcacaagt

SEQ ID NO: 6623 - DNA, 1854 bp, artificial
  synthetic oligonucleotide
actttaatacctattttggcctcatctatcataagcagcaataataataataatagacaacttgcttattacattttaaagcatacgttaaaataaatatgactattaaaattaaaaatgtctttgtgtcacctcagattgtctctcatatagaggaacatgaggcacatcttgagaaaaatcattgtagggattacccttggccagccggtgtccaggctgtcctgctgctggcaggctctggtatctgagaatcttagatggtatgcacccccgctctcatccagctatccagctccctcagcccaatctggtccatttttctgtccatttattgcctaagcctttgctgatgtctacaatggcctaggccctgtgctgggtgctggggtcacagaggggatcaagacagttcttgccgtgaaggagttcttggcctcgtgaggaagacatatatggaggcaaacacattatagtccacagcagcaaggtgatacaattctagtatgtacagagtgctgtgggcagaaaaagagggcataagaggcttcacagagtaggtggtttattgaagggcaaaggagggaagaatgttccaggcagcaggaacagagcaggatatataaagccaactgcaaagtttttgaggtcaggatacaggatgaagttcagggaggggagcaatgcagctggagaggtggccagaggccatatcaaggccagggccttatctgagaggccatggggagcctctgagagattgtcagggagcaggggatcttgtgggatccagggctagagcaagatttccagctgctgccccatcatggccaggttcaaggacctcattttctacctgggaacaattgcagtaccaagggttcctatgaagccttgggcatgtgatgatatggatggctggtttaatttttagctcttaattgtcaactgcattgcttgccttggaatgtcgatccctcctgtcatcagagagcctttaattgacaattaagtaaaactgccaatcaccacttgtctgcctctgacctgaattagaacctgaggttgtggattaatcccaccaggcttctgacatttacaggacaccagcacttagaggatattaccctgatggttagggtgctctcgtcttagttctcaaggcactactgcagtctcaaacagaaccgaagcaatttctaaaatagcctatgattcattttttctcccctcctgtgcctaaatctgctggcttcatgtggaaggatgggcgcaagtaactgtagaggtgacatcacaggagtgggctgcttgcctgccagccagcttgtggagctgggccccggcagttgtctatctgctgggctgggcaatgcctcccagccgttttggagacagagctccgaggttctttggtcgatgtgccttctccacatttctttttctcagagaaaaattctgggctgggaaatccaggataatgggaatagcagtggtaggaggaataatacagccttacatctgtataatgctttagagtttgaaagctatttgctctattttgccccacccaaacaccagtgggaaatggaagctgggatttttgacttgaactggagaccaactctcgctctcttgcacaaaaaacctaaatgctaatatcccctattcacctcaaggcatatcatgattaggccttggacgccaccagaaggtcagagaggctcccttcagcttctaggtgcttcctggaagataaattctccaggacaaattgcctggcaggcacaatctattaactatgccatcctgactgagccaacaagtaatgccagtctcagcactgccaactcc

SEQ ID NO: 6624 - DNA, 2004 bp, artificial
  synthetic oligonucleotide
gaaagctttgtcttgccaaatatatttgatatggtttggctgtgtctccacccaaatttcatcttgaattgtagttcccataatccccacgtgtaatgggagggacctggtgggaggtaattgaatcatgggggcggttacctccatgctattcttctgatactcagttctcacgagatctgatggctttataaggggctttctcctacctttggtcattcttctccttcctgctgctgtgtgaagaaggatgtgtttgcttccccttccactatgactgtaagtttcctgaggcctcaccagccctgtggaactgagtcaatgaaacctctttcctttataaattacccagtctcaggtatgtccttatagcagtgggagaatggactaatacgatattgcttacgataaatcaccttcttgaggtctgctttataagtcagtctctgtgacattggaagcatggattcatcccccagagactcctcatctcatgatgggactgagaatgggagagaaatgtgtagtggcaaaactatagagtggactggcctgggttatctattggtaagtgctgctctcctatgaggtctggcctgaagcagccactggttttacccattaaattacagcaataataaccccttacatttgttcagtgcttttacctttcaaagcactttcatgtattttatgtaattttatcatttaatctattacatcttctttgggtcacactgcttgtaaaaatacatttgtagagcagtggcaaagagaccaagagaagcagtaatattgtcagtatgttgaaaaaaagtctgtctatgatggggccttgacaaaacaactcaaaggaaataagtgtagtcggagtctaggctgcagtacggtgaccccagaatttggagctaggcttagaatgattgttagagcgaaataactaatacaaaggcattattgtagatgtgttactgatagagacttaggaaatctcaaatgtaatcaagataatcagggtgtatctgtaggatcagaacgtacttgaagaaagttgcaatctaatcagctttactgtaaactgtgtgaagaataatgtgttaaagaaaggtggtgcatgagttatttgaaaaagaagaattaagaagtaaacatatgttactgtttgtccaacacctcccacccctaactgtgcagagaggtggggaggaatgggggagggaggtgtgtccacttgtgcagtggctggagagcagaaggagcccagtagaccatacacatgatggatgcaaatattgtggtccttaaggctgtaggctcaattatgaagcagatttctctatgcatgggcttcaccattgcacttccttcactctgactccatgtttatcaagtaactttctgattttctattttagtttcctaggttccttgatcctgggaaagaaatgcatttacatgagctcagactattgttcggttaccttacaggtatatcttccattgtaaattaatgtaactgcaatatagtttatatgtcttttcctcccaattgtttttattttgaaaactttcaaatctatagaaaagctacaaaaacaatataatgaatttctacttactcttaaactaaatttactaatttgctgatagatatcaaaatgcttcagtactatttattgaaaaggctgtctttcctccattgaattgcttttggaccttagtcaaaatttagttggccgtatttgtgtgggtctatttctgggatctctcttctgttcctttgatgtgtctgtttctttgccaataccacacagttttgattactgtagctacatagtcttaaaattggtagagtgagtcctcctgctttatcctttttttacaaaattgttttagctattctagtttctctgttttcccacatgaattttaccataatcttgtctatatcttcaaaaaatcatgttaggattctgatagcaattgtctcagacctgtataaat

SEQ ID NO: 6625 - DNA, 1486 bp, artificial
  synthetic oligonucleotide
aaaaaatctgggtggctctcaagggaattgtgctgggtcaagaaggccaatctcaaaagattatctgctgcatgagcccattcatattacatttgcaaaataataattacagaggtggagaatagattagttggttgccaggggttagggatggatgtagctataaaggcgtagcatgagggaaccttgtggtgatggtactgatctgtatcttgattgtggttgtagttatgcaaggctacatgtgtgataaaattgcatagagctacacacacacacacacacacacacacacacacacgtgcatatatagctggtgaaatctaaataagctctatggcttgtaccaatgtccaatatcaacttcttcattttgatgccgtaatataattgtataagatgtcaacattgggggaggctggaagaagggtacatgggacttccctgtacatttttttgcaaccttctgtgaatctgtgattattgtgcaataaaagtttttttaaaagtatagaaatttataggtatgtagggtgacgatagggaagttggaggcagagatgattgtggggttactggtaggggactaagtccggagaaggaagtatgcatgcagaaacatgaaggcttgacagcgggagtggtgggatgaggctagagaggtaaacgtgggctatatatgcccggcaggctaatgagtttggacttttgcttaaagggtacaaaatgtctcaaacattgtgtgggtgcatgtgtgcatctgtgtgtgtgtgctttgaaggcataattagatttccattttaaagatactcaagctctattgtaggataccctgaaggttgatgagggcttttgcaaccatccaggccagtgacagcaaggataaggaggaagagatagatttgggagaaatttatatggtagaattgatcgggtaatacagagtgacacacaagaaaagcatatacatataacatttatgagtgtttggtatttaggagagaggaaaggataaaggcaggcaggtgtttctggagtagttgttttgattatagccaggtagggaaaatgagtcctcaaggagttctgataaagagggctctggatgggtattgaaaaggttgataagaagctttcagaaaggtagggcatcttgtacatagtgcaaacttcaaagcaactgaagtaagggcagcttacagagggctggattgtgaacacttttaaattcaagactggaagttttcatttgatttgacagtcaaatggaaaccattggagaagtaagaggtaagtactaatgttgctgaaaaattatgcttaggaacttagctttttgctcttgcatgtagggtcaacgtgacgaagtcaaccccacaggggttggcaaaaagggtattgaagcattctagtcatgatggcagcaggaagcaaggtaaggtaaatttggaaaaacattgggagggctaattgacagagtaggagt

SEQ ID NO: 6626 - DNA, 1938 bp, artificial
  synthetic oligonucleotide
agacagatataaaattttaagcattctttctagactttttctgtaaacaagtagctaaattctgaaagattgttcataataataatatgcacatattctactcaatatctttcatctgtaggctgcgacttcttagcaaaatggtgattatactttatagaaagggaaattctatgaatttacctcttgtatttacagaggagtgtcatgctaaaggcaggaagtaaaggggccttgcctggtcctcataggcctggtcaaacaaagcatggaatatttttggccactcctagataatgaaccttgaaatataacattgccactagtcccaaataatactgtggccttcctgtgatgcttcagtctcaggtggtctgcctgagaggggacactctatgcaattaaccttctgataggtgctgaggactcattcagtgctctccctttgtgctaggggttgtggtcaacacaagatttctggatcctgcccttgagttcacaactgagttgaatcaagctataagactaatacacatttttaaaaatgcataaaatgtgcacgagtatgagttcaattatatcgtgcagcctgtgcttgtctccaccttcaaccatctagtccaaacctcgaagctgtcttctaagaggctcagaggacttatgatctcatgtagtctcattagctctatgtgaagtaggggaagaaaaggctattcctcttttacaattgagaaacaaataggaaatctaccccagagcacttaaggagttggccaaacgttgcagagcgttgcagagcctctggcagtcccgtactcctcctgctgtctgtcccctcctgggtcgcacactttacactgctaattagaccttcctaaagcacaaccctgacaatatcactaccctgcttgaaagcctctcagtaggtccccatgcccacaggaagaaagatcctttcttttgcgtagtatgcaaggcccttcataattttgtccctgcctacttctcagtcctcttatctcactattgccctcaagtactcaaagcttaaccacaccaaacttttctctcactttctaaacataaaatgttcttcaagcctctgggcctttgtacatgcatagttttggacttgtagaatgacttccatctcctctgatgaactcctactcatcctttaagatacagctgtgaagacatctctgaagttccagcttcctttcccaggcaaagaaagttgatccctctttttgtgctccagcagtttattcaaacctctaccatagtacttctcaaactagtttgcaatgattacttcttgtacttgtcttctccactagactacatactcttggagagcaaagactgtatattattcacctttggtacctagcacagtgcttagcacatgctatgctttaaactttttctaattactttttttttttttttgagactgagtctctctctgtcatccaggctggagtgcagtggcatgatctcagctcactgcaacctctgcctcctgggttcaagtgattcttctgcctcagccacctgagtagctggaaccacaggcgtgtaccaccacacctaactaatttttttgtatttttagcagagccagggttctgccatgttggccaggctggtctcaaactcctgatttcaggtgatctgcctgccttagcctcccaaaatgctgggattacagacatgagccactgcgcctggccaagtttttttttaattttaaagattttataggaattgtaaaatgcctagagaatgaagaagaatatttgtattatttatcttgaataaaagagaaaaataacctccagattatacatttacaaattaaaatgtaataaactagagaaacactggaacagattattttaaaaatgtactggtcagtaccaaaatcaggaagct

SEQ ID NO: 6627 - DNA, 520 bp, artificial
  synthetic oligonucleotide
ctatgatctattttatagcccatgctatatttggcttatctcagtatagtatgcttgttaaatatatttttggtacatggtaattaatcagatgatgcactgtctctcattcagctatccttaatctaaagctcatgcttaaatctgagtctgggcaagaataaaatttgctatttccattttccataatattttacctggcagtgctgtacttcatcagccaggacatggataactgattgaggcccacctttcacaccaaacagatccagttcatctaatgcttccagggctgcctgtgaggaacaagaaagaaatggacaagtttagcattagaaagatatatatttcttctccctatatcccagtatcttatcaacacacatgatgtcacttttgaatatgtctgacagaatatataatacaaaaacattatttattcccagggcattctgagtttttctttgtctcccatattgtctcagagaaagttaaaaaggagtctgtagcactatcaagt

SEQ ID NO: 6628 - DNA, 1969 bp, artificial
  synthetic oligonucleotide
tatcatctctccctgcccaaatgcatatacccttcataactgacaatgtttattggcttcaaatggagagcaggcggctcgggattttgaggaaaggcctcagattgaggtacacataatcagctccaactatccccaccccaaactaagacagagcccttccaaaaccctttccccattcacctcagattgcatgttttcacattatgatacccccacccccactgcaccaccccaccaccaccaccacctccagcctttccttgacgccagcagaggaatgcaagtgaggggttacagtgtaatattctctggatcctacatatcctagggtaggccctgagagaactggtgccaggatcccacagtgtttgtgacgaagggcacaaaaaggctttgcaaggccaacgggcagggatgtaaaacatgcatgtcaatctctaagaactgaagataattttaggctagttattatgatcactatacccaccaggaccattctaaggcatggagaatactggtcctttgaaaaccacgctggtgctggccactgtaattttggtagggtttggccttcatcagatccttccctgctcaggaaacctccatagcttcctgggccagccaaatcaggtttgagccatcaaggctcttcctggcttcgctccaggctagtctagacttatctctcacccctacaaacagttttccctctgtataaacaggataacttatccattctaacatctaggcctttgtttcttaaaacaacaacaacaactaaccgtagtcatataacccactgagctctgtctctcccaggcttcaggggcgaacatctgctcagtagcttctgggaatcagctccggtgagtgcaacacttacccccttgcccatcactccttacggatgctgaatgtaaagcacctgctgtgtgcactgtagaaactgcacagggacaggagtccaggacagcttctaggcatgccacaggtggagtcttttctctggctcatccaagagccaagagcagctgctttccaaagagtcactttccactacacgtttactttattactattattttttaatctctcagctgtgaagtccaccaactgaggatcctggctcctgtacaggtccccacccccagatcatctctccccagtctccccaaattctaaccttccagttccactgaagaacatggaatgctcccgatgcccacaataccctgcctcggggacacactgcacttactactccttcagtgcttcagatctcagatggcatctcactacaaggaagccttccttgttcccagacatccaccacccagggttaagtgtctctcctccgggctcccataccacctggtccttatcctcatcccggcaattaatacatcaaactgccacatctggctgatttacttacatgacagccccatctagactctcagatgtggggcagaggctgagtctggtgcattcctctatctccagcgcccggcacagtgcctcacatatagtaggtagtcagtaaatgtatgttgaataaatgagtcgatgagcaaggtgtctaattcattgaatttttatttttccctacattctggagaactaggcaaatacaagcagagagcggttgtaattttgtgcaacagacactgaccggctttttattttatctttttatatttgggggagggggggaatgattgtactggtaaagtctctcaaacctccaaagaacagcttattccaatgctataataagttacaggcataaaatgatatactctcccaatttcttttatgaaacagcaaatctctcctgctaaaaccgaaacagagaacaataaaacatttgaccaacgtcattcatagacctagatgttcaacttaagtactcaatcaagtgtctatggaacaaaggattttgaaaaaatgcttaggtatggcgttt

SEQ ID NO: 6629 - DNA, 1787 bp, artificial
  synthetic oligonucleotide
tcatgacacatttcctcatcatcacagtcctcagagtctgatttatattcacattcctcttctgtaggttcatagattgcattgatgatctgacgtcttttttccagtaagggttggtacatttcagcaaactttctttcaatgtcatgaaattccctcaggaatttggattctaaattggccgctctagtttgaagctttttaagggctaacacacggtacttaactttcacaggtagactttcaacaaagtctgtatctaaaacataaccgataagtccttttggacggtctgcctctgagtcctcatcagtatcgccaccttttttcccatcttccccggacccagcagcagtatcttcaccgttttccccttcttccccaagcccagcggcagcttcttcaccgcacttcccatcgtctccaagcccagcagcggcatcttcaccgcgctccagatgttccccgagcccttccaccattatctgattaccagcctcttcttgactggattctgacagctccttgcggttctctgactcggccatttttcaaaggaccgtacacgcctaaggtggctaccacagagatcgggagaccaaacctccacaggaaaagactcaccgaaatatcagaagcggcggtggtcggacctagcagtggcgtccggactgagggaacgacgatccaggctgctcggggataaaagatggtgctgaggctttgagaaccggactgaagcagtggcgacctgggctgggtgcagagggcggcgacggctgcgttgaccgatcctgcaggagagagccggagactgcagagagctgcagtgggcagacctcctccgcaagcagctactgctgcaagaaaaaaacggtgccgcagtatgattacgcagctatcacttgcctaaaatttctaggtgcaaatagattgctgcgtcacctccttccctcccacaactatgctctaatctcatttgctgcaatgtagtgactgacaaacccagagccagtaaattattagatctatcaagttttcaactctgctcaccttcccaggctctctaacatggctgattcatccacctcctcctcgtcctctagcccatctcccgcagagttttctggaatcccattgcgttcattagttcattcatccaacttttaacagatattatacttttatgctttccagagagctcagagaaaacgtaactaaaatgtcgaacaatgagagaagacaaggcacccacccatcctaaatcaatctctttgattttagatcggggacctggggaggggagaggtggatggtggaagagctgataaacaaacgcttcaaagattaaaaacaccaggaattagcactgatggtctttaggtggcgtgtcagttatttaaatattctatattatgtttgtcggtatttttcacaagctatatgattttaggttgaaaaattctcgaaacatttcctgtgaggggaggaggaggaagtccgatggcagtgggggcgaatgagggcctgtgatgaaaaactagtatggtgtatacaactacgtgactagtaaacataccagacaattaaccacaattaaccagttgcctggcttataaataaccccagtcccaatactgactttctgcttctccttcttaatgctggctttaacagccgttagaaatatacatatatacaaaagccaaaatggaaagttatgtttattcttagaaatcataacatttgcttgatgcttttgagttaattggaaataatctaaatct

SEQ ID NO: 6630 - DNA, 1847 bp, artificial
  synthetic oligonucleotide
agatggacagaatcaagaaagatgagacagaaaggcctgggagcttggggagtgggtgaacaagttcctgtgaaagtgaaatggcccttcatttgaatgcaaatgctatgtaaaagcctgaagccccttgacgtcagcccagccattggtggcctatctatacagggctgctagtcacctggataccctcgtaagaaacgtgggatggagtagcctgaggggtgcaaaagagcttgcggcacaactacgtactgataagtttattctctgctgcttctcaaagtcgagttggggccttacagggacttcaggatggcttagggagcgccttctacccaagacacgatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctccagcactaataaatggctaaagccctcataactatcaaagcaggcgtctctcaggcgtgggggctgaatgcaggtctgcggcagcgcgagagaagtcaaagcgatcgcgatcacagcctaaccagcaagccagtgggcgactgctgggagccagggcgagggaagtggccgttccactttaatcttaaccggggctgggggaggaatgtttgttttcaactgttgttcttttattacattct

SEQ ID NO: 6631 - DNA, 1050 bp, artificial
  synthetic oligonucleotide
tgaatcggggaaagaaggcgttgcaggtgatcagagtgaatcccagatctagatggaatcggtcccaactccaagggagggggctagagtaccccaggattcacataagaccggtcaacctgaacaaaggcaaggaaaactttcacaaaccatcggatgaacataatcctaaggcctcgccctttaaatacatctgctacaaatgacgaaccacaaatgttttaaacagggaacattatggaaaacaccgatgctcaggtgccttgactctagttagaggaaaggaacccgcattcctttcacaatgggaagcaaatgctcaacatccttttggaaaactggggcctgtaacgtattccattttttcctcccgtgaactggaaaaatgcacaaattaaggatcttcctggcccaagttccctccgccgccctccatgttctgttcttcccctacatcgttcctttacctcctggttgaattcagtgtcgtagcaggaattcttagagctggccgtcccaagatggggtggagagagcggcatgaaagagagagagagagagagacacgcctgaatggcagcagcaggccttagcggcaatggacagcaggcacaggaccagctttgcctcgagccgcaacgctgatgccagaaaaggacaacctctccagaatcgccgcagtgtgcttccagcgcatgcgctgctaacgccccttaaccccccctccgcgccccgcctcccccacgcgccgctctccagcctctaggagtctaacccttagcggtccaccgacctccttcacttctttcccaggacgctatcccactctgcttcttccacctttcccctcccctcggtcacactggcctccaccatcatccctccctcagcccatacttctttcgtcaatccctctcccattattcttagcccaccatctacctttatttcctctgctatcgttagtggtctacccttcaattcttcactttccctgccagtctgcagccctcttgggcctcttactcctctcctcctatgcctgatgtt

SEQ ID NO: 6632 - DNA, 1120 bp, artificial
  synthetic oligonucleotide
gcaaggaacactaggtcagttctccagaaatcaagttgctatgataggcaaaatgctttatggtgcataggtttgcttctgaggcagggagggcagaaatacaacagagctaaagagtaagcaaccagacaagataggcagttcaagggagggaaatgacagaggaggaggtagggggaactagatgataatatgagagaaaagtgaggtagaaagctctagagatcaaccagagcattctaaaagcaccaagttaaaaaccagttgactcatttggaggtcagccaaaccaggtagggtagctgcatattgtattgatgtagctaggagagtgaagaggcagtgacttgagctttcctgatcatttctgcaagaccacactcctgctcccacacccttatcaacattatttggatgagctcatttctcattgccactgtagccccttcaacctacatcaaatgatcctgcattctatcagaggtctccacttcccttcatccctgtttccaggcagaatattgagagaaacatcttaattgttcttgcaactaatatccattattacttgatgcaagttttcatgtaattgaaatccatatttaatttggtcattttatccagggcaaaatgttctatatattccatgagaaatacaagaaagagcagagggtctattcaggctaaattgtttgcaagaaacccatttaagctaactaaaataaagtgaagtttattctaagactatgagtggactaataggatggaaggaatggtgcagaaatctaagaataaaagctataacagaagccaggtgtggtgttgcacacctgtagttccagctacttgggaggctgaggccagaggatcacttgagcccagaatttccaggctgcagtacgttatgactgtgccactgcactccagcctgggccacagagcgagaccctggctggaataattcattcattcattcattaaaaaataacaggaatagaccacaccaagattggagtaagggatattttgggcttcaaggtggccctagagacttataacaggagtttaaggtcttcattatagtgacttggctaggtttttaatgcatgcttctttccat

SEQ ID NO: 6633 - DNA, 3754 bp, artificial
  synthetic oligonucleotide
tggggaacctaaagggacttatatggctggctgacacagcctggcagtgacagagcctggaattaaggatgatgcaggagacagacctataagaatgacaaagctgagagtaaccttagagtctcccttgtccatcctgtgcattgaatttaagtggagagactgaggcctagaggtaggaagagactgcagtaggttcacacagttcatcagtgacagagcaagatgagacttgaactcatgtcattgacttccagtacagtttacacccctggttttacagatgaagaaactggccctaggagggataaatgacttgcccacttcattcaacaactgtgtaccaaacccatttccataagtgtgtcagcaggaccagctctgagcaaaaatgaaagtttagcaaagtttaacttttagcataccccatgtcttcatgattactctcacccgcaactgacacatacttttggtattctgtctcccagtcactccagaccatgcaatcttggcttggagacctggtttcacctactgtccctccacccccagcaactcaagaggtacaaaaaaaatccatctccaaatggccacatactgggcagggcaggggcaaagagaagtgactggtttccggttggaagaaggtggtttaccacccagctcttggctattgtttctcctcagactcagtgtagacaccctcaggctggcttcctcatctcctcccactgaggctaattactctgtcccattgcagggccccaggctctcccacctaaggtctgccccgctcccctagccccttccccagcagccccaagggtccagtctgtgtttgatcacccaggattattagatttcaaagctgtggaatcccataatttttacgagcatatgctctcctctagggtcttttcacgtctgaaaaggcggccagcagctccctgccacttctccacagtagcagtgcaggccagctgacaaggattacaaatccctagtgtctcatagctggcgcctagatagtgtgggtgacgggtagaataagagcccttgaagcaagttcagaaattctaataagctgaaatgcagcagagactgcagaggcacaaggaaagggattagatacccaaatcctgcaggggttcaggaggctatgcttcaaagcccctttgattcctgcctttcagctctctctagcggtcaccaagcgcaaagttctatgcctggttttcaagtcatttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaacaagtgtcagagtccgcgtccagctgagtgggtggggagagcagtactgggccgggccgcattcccgcccgggcctgtcagagcagcggacagacagcacctgtcgtgggcctcctcgttccctcactcctgccagagcctgtggcccccccgcggagaccggggactacacttgggagcatctttccccaactctcgtcaccgcagagaccgcgccgagcccacctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttcccccagtctccataaaaactctttcagaactccggggaatcaaccatgctggtgggagctcccagctcaggcctactcccccatctcacagttcccgatcacacaggggagcacgcgggatttcctaggcttgagaaccctcctccaagcctggacggagcctcaagagtggtgagaaggaccagattgactcgaagagccgccctcctcagtttgctcctctcctacactcctctaccctagtctccaccgacctgcttccttctgcgcttgcctagtggggggtgaaggagaggacaactaccttcacttctccccccaactttcacatacaccctccgtcccttaaggtggagtctcctgggaggcgggcagcctcgcagatccttctgccttaaggccttgcaaaggcagagtttcctcctgtcagtctggggtcttccagctccctgccgcatttgccacctcctcccacactcctttcatccttccccgcagcatatctggacatagaccacccctcgaccccgcaaaaaacaaaacaaaacaaaacaaaacaaagccttgagaaatctccaaacacctgtgcgtggacgaattacagttcacagttgctcctatatccctcatcacaattggccctccccccaaccgtgggaggcaactgctcttaagccgggttatagttgggggaattgaggaccggggggaactgaatgtgggttttgaacgcttctgcaaggccctttccaccccacttcacagaaagtagggaagtgagcaaatctctcattttccctgacttcagaaagcctgcttgctgctcctggagtcagcacctgctcctcccttgtccactctatcccccaatgaaggcactatttgggagtggcactacagccccaagatggaggcatggagggcagcagaagccgagccacagtccttgt

SEQ ID NO: 6634 - DNA, 2495 bp, artificial
  synthetic oligonucleotide
gggaacgaggaacagaaaaccaatgacaagagaactccaatttcttttcttttctcttttttttttttttttttttgagacagagtcttgctctgtcaccaggctggagtgcagtggtgcaatcttggctatctcagctcattgcaacctctgcctgctgggttcaaacgattctcctgcctcagtctcccgagtagctgggagtacaggtgcgtgccaccacacccagctaattttttgtatttttagtagagacggggtttcactgtgttagtcaggatggtctcgatctcctgacttcgtgatccacctgcctcagcctcccaaagtgctgggattacaggcgtgagccaccacacccggcaactccatttcttttctgtaggatttattgtaaacattgattcacgcattagcttctcctaggctggtcaaatgagttaattcaacaaatattcttcgaacacaaattatgtgcaaggtgatatgagggcactgtgtgacagtggcaaaagctttcactcaggcttctgggcaacagccacactacccattgggggaagggggcctctactcaccccctgatccaaacagtgccccagaatccacatttctttccaatttgcttaactcctgagtaagcaaaaggccaagggcctttttgccttttctgaatactgtttctgggctctgaggtactacgaggtaccacatattagcttctggaagtgagtagggaaggccttgcatcccatgtcaaacatatccttggtttggcagcttggagaaacccagaggggacaaccatatatgtaactgaaaggaacacgtatagcctcttgctaggacaaatggaacttcagagaagggtcacttcagagaaaaggaaaataaaaactcatctgaaatgtaccacaggaaccatttgtgggggcagggggcgggggtaggaggctgggaaatatcactgtggaccaagacaacacttggccatcttctgtggatttcttttaaactaggtttcctcctaactccgtaactaggtgtgactagatcttagattgatgaaagtcataaatggagaaactttaagagaagcttcattagcttctttcataatgagcattcgctcaagggcctgcagccccaatgccttgaagttgagggagctcctgagttaaggcaatacacgccaagattatctggataggcactgtgatggcccctagaacgggctgagagtacctttggacagtagggcaaagctgagcttgacttgtctctcttgactgtttcaggcctactccgcaactgttttggggactaccatgtggccttctactttgccggtgtgccccccatcatcggggctgtaatcctcttcttcgtccctctgatgcatcaaaggatgttcaagaaagagcagagagattccagcaaggataagatgttggcccctgacccagaccccaatggggagctactgccgggctcccccaaccctgaggaaccaatctaatgcctttcttgccattgtgtgccctttcccagctcttccccttcatcccaccctgctcagcatttacatttttgccaccagcacacttgttcccagacctgcgcacacagcatttcagccacctgacaatctccttggagtcaaagctccaggtgttccaaactcattaactaaattctccccagaatgcttttaaattttccagggcctttctcctcccaggatctgggaaagcttgggaaccacccctggcctttggaacctctccatatactttctaagctctgggggaggaggaggatgggacctcctggacccagcttgttagtcacccactataatcaactgccaaaggtgctactgtgtccccaggagcctaatagggtaggcccaaatctctgtttgctgaggaggtcattgccatccatatttgggagccactgggtggaggggcagggaggcaaaatgagacaagtagccttggttagtcttagagttgctgatgactgtggcttcccaagaactgggtacaagcagtgcccttattgtatggttggttaacagtctgctcccctcttcccttccttctttttttcctctactgacttctctccatactctttcccctctatttctttgtatgactgtcatagacacatgggtgcttgaagaaaggagggacccggaacttgggccaatcagcctcaccttgtcccagtccactcctaacactagcatcagtcccactcatctcaggctgagccacatctcactttttcgctcaagctatataatcctagactggaagagtagaatatcatatagggaagaaaccttaaacaccacagtgttccatgttccagtcactgatttttacaaatcttacagtccaaggcattaacctcaaggccctcccagcaccccattcttgtatacacatggcaaaatgtgaagaaactcctttcatctcagcagg

SEQ ID NO: 6635 - DNA, 617 bp, artificial
  synthetic oligonucleotide
gctcagcacttatgcactgtggattgaaaataatgctttctccctgatggaatgttacaaggttccacctctgatttttccaagtctgtttagaaagataggtctgtacattgcctgttaaaatccacccaactctcccacgaatctcagctgcttcactgaaatctctttctttgtcttccccatataagagcaggggtaattatggggaatgaaagaaactcctagctttgagtccaagaattgttagaattctagaaaacctctacctactctttgcattttccaaaatgggaaactgaatataagaaaggtaaaggataaccagtaacacccaataacacctatctattatcaataaggttataattgtcaccataattgttatcatgactattatttcttcttttttaatacagtcattgcttgattatttttctcttactaaaattttttgataacctatcccactaacagtcccttaagtcacttctcttatataacgctattcttcttcagtcacaatctagctattagattacctttctctccctttatagaaaattttctctcacttggagtttctgacttctctgaaaatctttaaatagaaaatt

SEQ ID NO: 6636 - DNA, 1709 bp, artificial
  synthetic oligonucleotide
agtaacagaagcacctgctcctagcaaccaggagccacaaagatgctgcagaaagagggggctgtctgggccctgctcttgctcagctatagacagctggcctccccgatgtttttctcatccagcacagacactctgtctcagatgtctgttcttgaaaagctgatctctggggcagcttctgacctcaacccccaacctgcctgcctggagcccctctgaatcccacctcccaggccaccaggaggcagtcatgttcacaatagtgtggctctgggaagtgccctcactgaagagggacagaggtaagtaaccagctgtgttggttacttcagtctagcctggtgggtgggagtagggtgtgccacacaggctcctataaccctgggtgagagcaattcctgctcggggtggaggttggggagcgtgttgtaatccagtccatttgagcgtgaagagaggcaagagaccatataagataattccctcctagagatcaggaaactgacagtcaggacaggcttgggcccacacagccctttggtgacagccaggtctgaaggaatgccagaacgtggggctccccaacacagtcagcacccatgagactgccaggccactgtgcagtgccagaggcttctgcttcccgtccccgaaggacagcaagaacacacttctccaccacctaagaagaaccctgccctcttgccttctgggatggcccgagctcagggtgatcgccaatgcagattttttcatttgacgagctgctttcctagaattgttgaaataacaagagtttagaagtacccaggagaggtctgtccagagctctaactctgtggactggtgctaattggcatcttccttagtcacagatttctctgaccttcacaggaggtgcaggtgcgtgcattccctctctgtctctctggggcttcaagctctgaaagtagggctgtccaccaggagtaaaccacggaaagtgggggttgtgaggaccttacccccattcccatccccccagccctgggccagactctcaggcgggaacaagccttccagctgtgagcttctttcttgcttctcccctccctctcccctttcttcctcccaagaaaagagcttctggtctctgccttccattgcctggcaaccaaaccagctgccacaggctgagaggagcaacacagatgcttctcaatgaggggctgaaatgagggggtgcagttgctgtctccagtcacaagcacccatcggcaatactgctggtgctcacactttggatacaaggcttttcttacatttgccagtgttatgtgtatttgaaaagtcttccaaaggacagatatgccacaattgggtaaactgctccacgcttctctatttcatatttaaagcatgtcgttatggaaaatttcaagcctatacacaagtggaagggcgtagtgacccctcctgtacacagcatccagcttcaacaattatcagcgcctggccagtcacacgtcattggatccgtaagtatttcaatatggagctctgaaagacaagaacccctttcagcataactacagtgtcgttataacacctaaagtaattagtaatcattccataatatcgtcaaatacccagggaatgtccaaactttaaatgtctcatgtctcatcaatgttatggagggttcatgttatggtgttttttccact

SEQ ID NO: 6637 - DNA, 1990 bp, artificial
  synthetic oligonucleotide
aatgttttgcttttttgttgcaaacaacaaaacaaaattcctaaacccttctttaagactaagatttcaaatatactagggctcaccatattgattttcagtaatttaaatgccttctgatctggaaggcattttggaaatcacacagtcttactccctctggttcccatcttaaggtgaaaaactgagacctggaaagatgtgactttaatcagcattgtgagtagatgcttatagtagagcttggtttgtcagaggactggggaataagcggtaggctgctgtcgcattaggtgttccccagctcaatcactggcattcttctcccctttctctctccctgaacttttcaaagtcaatccccaggccctactttgtgaaaagagatggagacaaaattcaaaaggtatgatggtgaaaagtctctttcccactcctatctcccagccaccctgtttccctccctaaaggccaccagtgttatctggtgtgtcccttcagagatactctgtatatgtacaagcaattgtgtgtgtgcacatgtgtgtgtgtataccctacccttaacactttcaacttttactgtagattaaagagcacacaggccaggcatggtggctcacacctgtaatcccagcactttgagaggccgaagtgggtggatcacttgaggtcaggagttcaagaccagcctggccaaaatggtgaaatcccgtctctaccaaaaatataaaaattagctgggcgcagtggtgtgcacctgtaatcctagctacttgggaggctgaggcaggagaattgcttgaacccaggaagcagaggctgcagtgagccaagattgtgccactgcactccagccttggcaacacagtgagactctgtctcaaaaaaaaaaaaaaaagtacccgtgcagatttcttacgtgggtaaattatgtggcgctgaggcttggggtcttaatgatcctatcacccaagccataagcatagtacccaacaagtggtccttcagcccatgcacccctccctcccctgtctagtgatccccaatgtcgattgttcccatctttatgatcatgtgtattcaatgtttagctcccacttataggaacatgtggtatgccctacttgtaaagtacaaattgtaggctaccatccaccttatcctccactttgcttttcatacttcgaactatatcttggtacattaagttcataaagtcttcattttttttaaatgattgcaccatattccattttatggccatatcacaatctatttaatcaacaccttacattcatactgctactaacctttgactatggggctttagtgtcaaacagtgctagattcagattactttccacatgacttgccttgacaaagttttaaaacttcttggagtctgagttttctcatacataaaataagtataataataccatctgttattgctggtgtggagattaaatgagatgaggcatgtaaaacatctagcatacagcctggcacgtactaagtgttcactaagtgtttgtgctctccctgctcaccagccctccctataccttccacctccaattcaattaatattggttgaattcaagtcaataggtctttgacctatgttagactggaccttggatgcaccagagaaggaaaagggtccctcaagaagtgtatgattcccttgagaagacataacacaccaaacaactacagttgtgctaagtagttaaaaaaaaagtgtgtatattacattgaatgcaattttcatgtggtgatgtagaaaaagagaaatgattgtgagggcaggaggaatcaaggccctgatagaattggaatttgaaatagggtttagctaagtggagaattgggcagtggcagagtgggggcagagaaatggacagttgggctgttgcttggattctgggtctttgccctctggcagcctagtgagtcactgttccccattaggccttacccagca

SEQ ID NO: 6638 - DNA, 3183 bp, artificial
  synthetic oligonucleotide
gggacagattgtcgggaggagcttgaactgagcttcggctcccgactgggcctgggcccggcccccactggtgccacctccctcccttcctggcccggctcctggcccacactcggccctggcccggccctggcccggcccagacccggcccggccctggcccggcccagacccggccctctgaggctcctccgggctccaggttggcgcaaacaaagccctgattgactgcccggaggggcgggcctcgctgcatggccgcctcctcccctcccaggccgccagggatttgccgggaagagcgggggcagggggagactcccgggggtgcgcaggaccgcggggggccgagtcctcgggctcgagaagattgtgtccacccgctgtccgaggcccaggctgtcccctcaggtcgtcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaa

SEQ ID NO: 6639 - DNA, 3467 bp, artificial
  synthetic oligonucleotide
agcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaacaagtgtcagagtccgcgtccagctgagtgggtggggagagcagtactgggccgggccgcattcccgcccgggcctgtcagagcagcggacagacagcacctgtcgtgggcctcctcgttccctcactcctgccagagcctgtggcccccccgcggagaccggggactacacttgggagcatctttccccaactctcgtcaccgcagagaccgcgccgagcccacctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttcccccagtctccataaaaactctttcagaactccggggaatcaaccatgctggtgggagctcccagctcaggcctactcccccatctcacagttcccgatcacacaggggagcacgcgggatttcctaggcttgagaaccctcctccaagcctggacggagcctcaagagtggtgagaaggaccagattgactcgaagagccgccctcctcagtttgctcctctcctacactcctctaccctagtctccaccgacctgcttccttctgcgcttgcctagtggggggtgaaggagaggacaactaccttcacttctccccccaactttcacatacaccctccgtcccttaaggtggagtctcctgggaggcgggcagcctcgcagatccttctgccttaaggccttgcaaaggcagagtttcctcctgtcagtctggggtcttccagctccctgccgcatttgccacctcctcccacactcctttcatccttccccgcagcatatctggacatagaccacccctcgaccccgcaaaaaacaaaacaaaacaaaacaaaacaaagccttgagaaatctccaaacacctgtgcgtggacgaattacagttcacagttgctcctatatccctcatcacaattggccctccccccaaccgtgggaggcaactgctcttaagccgggttatagttgggggaattgaggaccggggggaactgaatgtgggttttgaacgcttctgcaaggccctttccaccccacttcacagaaagtagggaagtgagcaaatctctcattttccctgacttcagaaagcctgcttgctgctcctggagtcagcacctgctcctcccttgtccactctatcccccaatgaaggcactatttgggagtggcactacagccccaagatggaggcatggagggcagcagaagccgagccacagtccttgtgcaccccctggacttccccaaggagggcatgtggaagagaaagtctgcctttctctgggagtatgggtcattgtcttctaggttcctctcccccttaacatggaggaaaaactccaaaataagcttgcgtgtgctccactccctcagtccttctctcatgattcaataaaattatcatcactgagggctaatttccagggctttgcttgatgcccacaggccacaaaaggaagaattctttgggctggttatttggggacgggagggtgaggagcagctcatgggaggctctgctttcgtgagaaaggatttgcatgtctaagaggtcaacacagctagtccagggcttcctctcttccagacttccagccctgcatcaggctacagagaggaaatggcaaagagcagcaaatattatgcaaaagggtaaaggagctcccaagctaggagctgggagctcctgggaaaagaaaagggaagaacatgtctaaacccctgcccacagctgggcgtggtggctcacgcctgaaatcccagcactttgggaggccgaggcaggcagatcacctgaggtcgagagttcgagaccagcctgaccaacaaggagaaaccccatctctactaaaaatacaaaaaataaattagccgggcgtggtggcacatgcctgtaattcaagctactcaggaagctgaggcaggagaatcgcttgaacctgggaggtggaggttgtggtgagccgagatcacaccattgcactctagcctgggcaacaagagcgaaactccatctcaaaaaataaataaataaataaacccctgcccacacacctcagtgaggtggacttgttctgtatgtgcctcccaactgtggcctttaccctccacctcaacttgcctgatcccagttgagagactcctcatatccacaggggagtttggtgttttctagcagcccctacccctcagtaccacatttttggtagtctctaactctccagatcccaataagttctagcctaagcctttccttcaggctgaatagcttcaagcatccaagcctggtccctccaagatgaagactcacctgtcatccacaaatggctgggcctagaaaacaggaggagctgtttcagggaa

SEQ ID NO: 6640 - DNA, 1032 bp, artificial
  synthetic oligonucleotide
atgggcagtataatggtatattaggaacagagagatcaacctggaagacccatttgtgtgtggaagatggcgagtcctctgaagaaccacaccactatagcctggccctttctgagaatgcatttatataaggactatatcctaatcaaagagtgcttttgttgccaggcagcactgagttacatttaatgcttgagcgcaataactttaggctaaattatcttttgactttctccatatggtttctaatctattttcttattactaatttatcctgttaactgcattttaaaaaatgttattacattcttttcagaaatgtaatcactaaaccacagggctggaaggatcttggaagatagtctcatcccaaactccccattttacaagtggggtaaccaagtcccagaaaggggaaactacttgccagtgttacatagtgatttggtaacacatacacattcttggatgtgggatgtatgttgccttctagtccagaaatatccccatagcaccaagttacttaccaagtggaatgtaagttatcaataaaaataaccactaatcagagggctactaactttttgtttgtctttattggaggaaatgctgtcagaaataagaaagctgttcttacttatcccaagaggagaagtgaaaagtagagataaagccaaaatccatctgagaagtaggcactgctcttccagcctctggttctagagctctgtattgtcaccccaaggcatacccacccaagcaacacatttcctccttacacacacacacgcacacacacacacacacacacacaggacattcatgtacactcaaaaaaattatggtgactttcttcttccatcatggaagcaggatgcaatataaaggactggaagttggaagatgaaaaaagctgggaattctttggaagtgctaaaataaattcagctatttaataatgaccagttaagataccatttgaaattttggggggagaatagagggactagggataccatgacaagtacaaaa

SEQ ID NO: 6641 - DNA, 32598 bp, artificial
  synthetic oligonucleotide
actcaacaaagttgtacttcttcttgaaaatctaaaagtcccagtaagaaagaccaatagggttactaggaggatacagtataacttttccagtggttttctcctattcttaaaagaagtagggggacactctatatcttaagataaaagcctagaattagccttaaattaccaaaaacttctttattatgaataaatctttcctgctactgtaattgaagcacgtttactctttttctatattaatataaggaggctgtgtaagagtatgagaatacaggactcagaatacggagtcctcatttctccaagctctgtcatagatttattgattcactcactcactcatttagatatgcacacctcaaataggtattgagtgtctacatagtgttagttactgtggatgcagtgaacaatattattcaggaatcaacctaaatgcccattaacaatagactttagataaatcatctctcttcttgagcctgaaatttctcatctataacaaaaagtatgggtctttatctttttttattttattttattattattatactttaagttttagggtacatgtgcacaatgtgcaggttagttacatatgtatacatctgccaagctggtgcgctgcacccattaactcgtcatttagcattaggtatatctcctaaagctatccctcccccctacccccaccccacaacagtccccagagtgtgatgttccccttcctgtgtccatgtgttcttattgttcaattcccacctatgagtgagaacatgcggtgtttggttttttgtccttgtgatagtttactgagaatgatgatttccaatttcatccatgtccctacaaaggacatgaactcttcattttttatggctgcgtagtattccatggtgtatatgtgccacattttcttaatccagtctatcattgttggacatttgggttgcttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaagggttgaactagtttaaagtcccaccaacagtgtaaaagtgctcctagttctccacaacctctccagcacctgttgtttcctgactttttaatgattgccattctaactggtgtgagatggtatctcattgtggttttgatttgcatttctctgatggccagtgatggtgaccattttttcatgtgttttttagctgcatacatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttcttttgttgtgcagaagctctttagttgaattagatcccatttgtcaattttggcttttgttgccattgcttttggtgttttagacatgaagtcattgcccatgcctatgtcctgaatggtaatgcctaggttgtcttctagggtttttatggctttaggtctaacgtttaagtctttaatccatcttgaattaatttttgtatatggtgtaaggaagggatccagtttcagctttctacatctggctagccaattttcccagcaccatttattaaatagggaatcctttccccattgcttgtttttgtcaggtttgtcaaagatcaggtagttgtagatatgcagcgttatttctgaggggtctgttctgttccattgatctatatctctgttttggtaccagtaccatgctgttttggttactgtagccttgtagtacagtttgaagtcaggtagcgtgatacctccagctttggtcttttggcttaggattgacttggtgatgtgggctcttttatggttccatatgaactttaaagtagttttttccaattctgtgaagaaagtcattggtagcttgatggggatggcattgaatctataaattaccttgggcagtatggccattttcacgatattgattcttcctacccatgagcatggaatggtcttccatttgtttgtatcctcttctatttcattgagcagtggtttgtagttctccttgaagagttccttcacatcccttgtaagttggattcctaggtattttgttctctttgaagcaattgtgaatgggagttcactcatgatttggctctctgtttgtctgttattggtgtataagaatgtttgtgatttttgcacattgattttgtatcctgagactttgctgaagttgcttatcagcttaaggagattttgggctgagacaatggggttttctagatatacaatcatgtcatctgcaaacggggacaatttgacttcctcttttcctaattgaataccctttatttccttctcctgcctagtttccctggccagaacttccaacactatgttgaataggagtggtgagagagggcatccctgtcttgtgccagttttcaaagggaatgcttccagtttttgcctattcagtatgatattggctgtgggtttgttatagatagctcttattattttgagatatgtcccatcaatacctaatttattgagagtttttagcgtgaatggttgttgaattttgtcaaaggccttttctgcatctattgagataatcatgtggtttttgtctttcgttctgttcatatgctggattacatttattgatttgcacatattgaaccagccttgcatcccagggatgaagcccacttgatcatgctggataagctttttgatgtgctgctggattcggtttgccagtattttattgaggatttttgcatcaatgttcatcaaggatattggtcgaaaattctcttttttggttgtgtctctgccaggctttggtatcaggatgatgctggcctcataaaatgagttcgggaggattccctctttttctattgattggaatagtttcagaagggatagtaccagttcctccttttacctctggtacaatttggctgtgaatccatctggtcctggactctttttgattcgtaagctattgattattgccacaatttcagatcctgtttttggtctattcaaagagtcaacttcttcctggtttaggcttgggagggtgtatgtgtcgaggaattcatccatttcttctagattttctagtttatttgcatagaggtgtttgtagtattctctgatggtagtttatatttctgtggaatcggttgtgatatcccctttatcatttttattgtgtctttttgattcttctctcttttctttattactcttgctagcggtctatcaattttgttgatcgtttcaaaaaaccagctcctggattcactaattctttgaagggttttttgtgtctctatttccttcagttctgctctgattttagttatttcttgccttctgttagcttttgaatgtgcttgctcttgcttttccagttcttttaattgtgattttatctgaaaaacatttcttatctttttaattttctaaaatttttgtggacgcacaataggtgtatatatttatggggcacagagatattctgatacagacatgcaatgcataatagtcacatcagggtaaatggggtatccatcccctcaagcatttgtcctttttgttacgaacaatctaattatacatagttattttaaaattacaattaaattattttttactatactcaccctgttgtgtagcaagtactaggtcttattcatttttctaagtatgttttgtacccagtaaccattcccacttccacccctacccctaccataccctttacatcctatggtagccatccttctactctctatctccatgattgaatcattttaatttttagctcccacgaataagggggaacatgtgaagtttgtcattctgtgtctggcttatttcacttaatataatgacctccagttccatctatgttgttgcaaatgacaggatctcattatttctatggctcaacagtactacattatgtacatgtactacattttctttatccaataatctgttgatggatgcttaggttgcttccaaatcttggctattgtgaatagtactgcaatacctattcacaatagcaaaaacatggaatcaacctaaatgcctattaacagtagaatggataaagaaaatgttgtgcatatacgtcatagaacactatgtggccataaaaaagaatcagatcttgtcttttgcagcaacatggatgaagctgggggccgttatcctaagtgaactaatgcaaaaacataaaaccaagtaccacatgttctcacttataagtgggagctaaacaatgaaagcacacagacataaggaggggaacaacagccaccagggtctaattgagggtggagagtggcagaagggagaggataaaagactacctatcaggaactatgcttattacctgggtgttgaaaaaaatctctacaccaaacccccattacatgcactttacctttataaaaaacctgcacgtgtactcctaaacctaaaataaaagttgaaaaaagaaaataaattacagagtaatgctgctttaaaaaaatgtgctataacaaacatgggagtgtagacgtgtttttgatatattgatttcctttcttttggatatatacttagtagtaggattgctgtattatataatagatccctttttcgttctctgaggaacttccaaactgttctccatattggttgtaataatttacattcccatccacagtatacaagggttcccttttctccatatacttgctagcatttgttattgcatgtctttcaggtaaaagctactttaactggggagagatgatgtctcactgtagaactgatttgcagttctctgatgaccagtgatgttgaacaccttttcacatacctgtttgccatttccatgtcttcttttgagaaatgtatattcggatttttgctctttttaaaaaattgaatcattagttgtttttttccagtggagttgattgagcttcttatatattctggttattaattccttgctagatgggtagtttgaaatatttacttgcattctgtcagttgtgtcttcattttgtttattgtttcctttgctgtgcagaaggtttttaacttgatgtgatcccatttgtccatttttgctttggttgtctttacttgtggggtattgctcaagaaatatttgcccaatccaaagtcctggagagttttcctaatgttttcttttagtagtttcatagattgaggtcttagagttaagtctttaatttattttgtgtgtttttaaaatatttttttattttaaagcatctacagggactttttttttcagtaggattttggggaaaaggtggtgtttggttacaggaataagttctttagtggtgatttttgtgattttggtgcatctatcatccaagcagtgtacagtttacccaatgtatcgtcttttatcccttactcccttcccaccctttctcctgagtctccaaagtccattttatcattcttatgcctttgtgtcctcatagcttagctcccactttgttttgttttgaaacagaggcttgctctgttgcccaggctggagtgcattggcatgatctcagctcaccacaacctctgcctgtcaggttcaagcgattctcctgcctcagcctcccgagtagctgagaatacaggtgcccaccaccatgcccagctaatttttggatttttagtagagatggggtcttgccatgttggccaggctgatcttgaactcctgatctcaagtgatccacccgcctcagcctcccaaagtactaagattacagtcatgaggcgccacatccagccttagttcccacttataagtgagaacatatgacgtttggttttccattcctgagttacttcacttagaataatggtctccaattctatacaggttgctgcaaatgccattattttgttgtttttttatggctgagtagtattccatggtgtgtgtgtgtgtatatatatatacacacacatatatttcacattttctttatccattcgttgattgatgggcatttgggccgtttccatatttttgcaattgcaaatcgtgctgctataaaaatgcctgtgcaagtatcctttatgtataatgacttcttttcctctgggtagatacctagtaatgggattgctggattgaatggtagatctacttttagttccttgaggaatttccacactgttttccatagtggttgtactagtttacgttcccaccaacggtgtaaaattgtccccttttcaccacatccttgccaacatctattatttttttattttttgattatggccattcttgcaggagtaaggtagtattgccttgtagttttgatttgcatttccctgataattagtgatgttgagcatttttccatatgcttgctggccatttgtctatcttcttttaataattgtctatgccatgtccttagcccactttttgatgggattgcttgtcttattcttgctaatttgtttaagttctttgtagattctgggtattagtcctttgttagatgtatagattgtgaagattttcttccactctctgggttgtctgttaactctgctgattatttctttggctgtgcagaagctttttagtttaactaattctcatatatttatctttgtttttgttgcatttgctttgggttcttggaagttttgttcatttttaaaaattcttctttcattgtctttgatgaatttgattaattcaaaattcttgtcttcaagctctgaagttctttcttctgtgcgtttgattctattgttgagaatttccagtgcattttgtatttctctaagtgtgtccttgatttccagaagttgtggttgttttttatttatgctacctattacattgaagattttgcctttcatatcttgtatcatttttaaaatttcgttaagttggacttcacctttctctggtgcctccatgattagcttaataatcaacttgaattcttttttggcatttcagagatttcatcttggtttagatccattactggtgagctggtgtaatcttttgggaatgttaaagaaccttgttttgtcatatctccataattttttttttctggttccttctcatttgggtaaactatgtcagagggaagatctgggactcaaggggtgttgttcagattcttttgtcccaaaaggtgctcccttgatgtggtgttctcccccttcccctagggatggggcttcctaagagccgaatcacaatgattatttttgctcttctgggtctagccacaagcagagctactgagctcccaggctggtactggaaagggtctgcaaagagtcctgcaatgtgattcatctttaggcctttcagctgtggataccagtacctgctccagtggagcaggggagtgaagtagactctgagaaggtccttggttgtatttctgtttagtgtgctgtttttgtgttgcttggcctccagccaggaggtggcactttcaagagcacatcagctgtggtactatatggaggatgcaaacttgccctagtgttgcctggttaagtattcaggtttctcaggtggtgaacagggccataaaacttctaagagattatgtactttgtctttggcaaccagggcaggtagagaaagaccaccaggtgggggcaggtataggcgtgtctgagctcagactctccttgagtggggcttgctatggctgctgtggggtatgggggtgtggttcccaggccaatggagttatgttctcagagggattatggctacctctgctgagtcatacaggtctccagggaagtgggtgaaagacagcagtcacaggcctcacccgactcccatgcagcaccgagtctatttccaggcagcaagtgaccagggatgagaacttgtcccagaccaccagcctctctgctgagaaagggagctgacttacagctttctggcaactcagggaacctgcagcggcaatccagtttctcaaagcgtctgtgaattctctcaggtttccttatgtgttcctccggtagttcttggaacaaaagtttatgatgtgagtctccacatgctgctctctctgtccaggagctgcgagctagtcctgcctcctatctgccatcttaatgtatcagctttaagtcattttgattttatttttgtatatgatgagagataagggtctagattcattctttttcatttacatatctagttttctgagcacaatttattgaaaagactgtcctttccccattgtatgttcttggcacctttgtcaaaaaagagtttactgtagatgcgtatagttatttctggattatttattctgttccactggtctatgtatcagtttttatgccagtaccatgttgtattggttactatagctctatagtataacttgaagtcaggtaatgtgattcctccagttttgttcattttgcttaggatagcgttggctaatctgggtcttttgtggtttcatataagttttaggactttttttttctattgctgtgaataatgtcattggcattttgataaggattgcattaaactggtagattgctttgggtagcatagacattttaacaatattgattcttccaatccataaacatggaatacctttccattttttggtgtctttgtcaagttgtttctttggtgttttatacttttcattacagagatcttttacttctttggttgggttaatttctgggtatttaatttcatgcgtagctattgtaaatgggattacttttacaatttctttttcagttgttcattgttggcatatagaaatgctactgatttttgtatgttgaatttgtatcctgaaactttagtgaatttgtttatcggttacaatagttttcttgtggagtcttatgtttttccaagcataagattataccatcagcaaaccaggataatttgacttctttcttcctaatttgaatgccctttatatctttctcttgtctgattgctttagctaggacttccagtactatgctgaataacagtgatgacagtgggcatccttttcatgttccagatcttagagaaaaggctttcagtttttctccatttactatgatactagctgtgggtctgtcatatatagctattattatgttaagatatgtttctcttatctcaagatttttgtggattttattatgaagcaatgttgaattttatcaaatgctgtttcagcatcaattaaaatgatcatatggtttttgtccttcattttgttgatgagatgtatcacattggttgatttgcgtatgttgaaccatccatacatccctatgattaatcctacttgatcatgatgataatctttttaatgtattgtttgaatttgctttgctattactttgtttaggagttttgcatttatattcatcagttatgttttcctatagtttttttttgttttttgttctgttttttttttttttttttttttttggtatgtctttgtctcattttggtatcagggttatactgctcttgtagaatgagtttgaaagtatttcctcctatattttggggaatagttggagtaggattaatattagttcttctttaaatgtttggtagaattcaggacatggagcaaaatgttagaagagaaaggtccactgattgacccccaacaaggacaccaagttaacaaatatctacacagaagaaaatactttcaaaagaacaaaaaaattaggtgagcactcatagtacctggatttaacttcacatcactgttagaggcactgaagagatttaaataaaccgtacggaatcagcaatgccatccctctcccacccccagcagcagcttggtgcagagagcttctgtgggcactgcgggagggagaacacagcacttgtgagacattgaactcagtgctgtcctgttagagcagaaaagtaaaactggaccaaactcagctgacacctgcctatggagggaacatttaaaccagccagagaaaaatggtcagtttcagtggtctgaacttgagtgcttgaaaaccttaccactgagggccacagcactctgtgtctccaagtaaacttgaaatatggtctaggccataatgactgcaacttctaggtgagtcctagtgctgaactagaccaagagacagtgaacttgggtgggggtcattggaacgcaacatactgagacatcagctggggcagccaaggaagtgctagcatcactcctccctcaaccccaggccacacagtggctccaaaacagaccttttcttccacttgagggaaggagatggaagagtagggaagattttgtcttgcatgtaggataccagctcggtcacagcaggacagggaactagtcagtcatgaggccctagttccgggccctaaatcctggatgacatttctagacaaccatatgccagaaaggaacccactgccttgaagaaaaggactcagtcctggcaacattcatcacctgctaactgaagagcccttgggccctgaataatgaacagtgatagctgggtaccacatctagggacttgggtaagcatctgagacttgctggcttcagatgagactcagtacattaccagctgtggtggctatggggaaaaatcccttctccttcagaaaagcagagagcaaagtaaaggggagtatgtcttgcaccataggtaccagcatggccccagggatataaaacaccaagtaggctcttgaggtcctcaaatctaggacttgacacttggatggcatttttagtcctgacctgggccagagaggaaatcctgctgccctgaagggtaagtcacaggtcaggcagcattcatgacaagctgacttaaaagactttggggccacagggtgaaagaagctcgtagctgaactttgtaatgatttcaactgagcttgaactttcctgagtagaatctggggagggggcaaatgacaaatgcagacacaagcacagaactgcagctgaaggtgcagacaggtggggaggcaaggcctgagaaccctgcttgctttctcagccaggaggcttgtagcctggggcgagatctcagccctgctcactagctgcctggatataaactcagtgcagttggggaggcacagctggagtgagattggctttgctggctgtgtgggagctgggtgaagcatgtcattgctggctttcccctacttccctgacgaagtgtacgacacagcagaggtggccataatcctcctgggaacataactccattggcctcacaaccatccccccatccgccagtgtccacagtaagccctgcatccatcacctaagaaacccgagtactcatcttggccaatgtagggcaagattatattccccttgtattactgcagctggcactctcttgaaagcatcacctcctggctggaggccaacaaactcacgccattacagcaactttgaagcagaacaaccctgcttcaaagaaggagaaaatgaaagctaattcaacggcctgcaacaccctggctaaccagaggtcctgagtctgtccacatggcaacttcactcctagcataacgagtatttgagaaaaccaggacactaaagaaagcaacaaccaaggatttccacagagtccacttcactcccttgtcacctccaagcaggtgctggtatccacaactgggagacctaaagatgggatcacatcacaggactctgcagatattccccagcaccagcctgaagcctggtagtcccactgagtggctagaccaagaagggcaataacaatcactgccatccagctctcaggaaacattatcccttgaggaagagggagagcaccacattaagggatcaccctgtgggacaaaagaatctgaacagcagcccttgagttccagatctttccactgaagcagtctattcaaatgagaaggaaccagaaaagtaattctggtaatatgacaaaacaaggttctataacacccccaaaatatcacactagctctctggcaatggattcacaccaagaagaaatcactgaattgccagaaaaagaattcagagggttattaagctactcaagggggcaccagaaaaaggcaaaaaccaacttaaagaaattctaaaaaatatagaatttggatgacaaagtctccagagaaatagacatcataaagaaaagacaattacaactagtggaaattaaagacacacttagataaatgcaaaatacactggaaaatttcaacaacagactcaaacaaatagaaggaagaacagagctcaaagacaaggctttcaaattaacccactaaaacaaagacaaagaatatgtaactaacctgcacaatgtgcacatgtaccctaaaacttaaagtataataaaaaaaaaaaaagaaaacactcggtagatgaagaaaaaaaaaagaaaaaagaataaaaaaagaacaaagcctccaaaaaatttgagattatgtcaagtgaccaggcacttgtgttcctgaagaagaagataaatctaaaagttttaaaaactgatttgagggaataatcaaggagaacttccctggtcttgctagagatctagacatccaaatacaagaagcttaaacagaaagagggagataatctgtatgtttagaagaaagtaaggaaagagaaccacagtttctgcctggtaattcagagtattctcctggaacttgtcaaagaccatcaaggcagtccctctaagagtctgcaagaaccacagtgtgataggtctttgggtgccccctaaagcagatacagcttatatcaaacacccaagtccttgcaaatatctggaaagccttcccaagaaagatgactacaaataagcccagatagtgaagaatataacagacacctaactcttcaattcccagacactgaagaacatctagtatcattaacaccattcaggaaaacatgacctcataaaatgaactaaataaggcattagggaccaatcctggagcaacagagatgtgtggccttttagacagagattcaaattagctgtattgaggatactcaaagaaatttgtggtaacacagagaagtaattcagaattttatcaaataaatttaacaaagacattgacataatgaaaagaaatcaagcagagattctggagctgaaaaatgcagttggcatactgaagaatgtgtcagcatctttaatagcagaattgatgaagcagaagaaggaaagagtgagcttgaagacacgctatttgaaaatacacaggagacaaaagaaaaatgaataaaaaacaatgaagcatgcctacagaatctagaaaatagccttgaagggggcaaatttaaagttattaggcttaagaaagaggtagaggaagtaagaggggtagaaagtttattcaaagagataatgacagagaatgcctcaaacctaaaagaacaatatcaatattcatgtataagaaagttacagaacatcaagaagattcatcccaaagaagactacctctaaacatttaataatcaaattcccaaaggtcaagaataaagaagggatcctaaaagcagcaaaataagagaaacaaaaaacacaataaagctccaattcttctggtagcagaactttcagtggaaatcttataggctagaagagaggggcatgacatatttaaagtgctgaaggaaaaaaaggaacacaaaatgttgaccctagaacagtgtatctggtgaaaatattcttcaaatgtgaaggagactttcccagacaaagaaaagctgaggaattttatgaatatcagaactatcctgcaaaaaatgctaaagggagcacttcaatcagagacaaaaggatattaatgagaaatagttacctaaatgaaaaaaactcactggtcatagtaagtacacagaaaagcacagaatattatatcactaactgtggtgtgtaaaatattattatcctaagtagaaaggctaaaaatatacctataaaaataataactacaaaatatcttccagacatagtcaatgcaataatatataaatggaaaccataaaaagttaaaaagcaggggaatggagttaaggtatagagtttccattagttcttttatgcaaatagtattaacttgctatcaggttaaaataatgggttataaaatagtatttgcaagcctcatggtggccttaagccaaaaaacatataatgggtacacaaaaaatataaagcaagaaacgaaattgtgtcaccaaagaaaaccactctcactagaagaagacagaaagaaaagaaagaaggaaaggaggccacaagacaaccagaaaacaaataataaaatatcaggagcgagtacttacgtatcaataacattgaatgtaaatggactaaactcttcatcaaaagtcaaatactggctgaataaataaaaaagcaagacccattgatctgttgcctacaggaaacacacttcacccagaaaaacacacatagactgaaaataaagagatagaaaaagatattccatgccaatggaagccaaaaaaaaagcagaagttactatacttatatcagaaaaaatagatgtcaagacaaaaactatcagaagagacaaagaaggtcactacataatgataaaggtgtcaattcagcaagaggatataacaattattaatatatatgcacccaacactggagcacccagatatataaatcaaatattcgagctaaagagataaatatgcactcataaaataatagctggagacttcaacaccctactttctttttttttattattatactttaagttctagggtacatgtgcacaacatgcaggtttgttacatatgtatacatgtgtcgtattggtttgctgcacgcattaacttgtcatttatataaggtgtttctcctaatgctatccctcccccatccccccaccccacgacatgccccagtgtgtgatgttcctcaccctgtgtccaagtgttctcattgtttgattcccacctatgagtgagaacatgtggtgtttggttttctgcccttgtgatagtttgctcagaatgatggtttccagcttcatccatgtccctaaaaaggacatgaactcatcctgtttttatggctgcatagtattccatggtgtatatgtgccatattttcttaatccagtctatcattgttggatattttggttggttccaagtctttgctattgtgaatagtgccacaaaaaacatacgtgtgcatgtgtctttatagtagcatgatttataatcctttgggtatatacccagtaatggggtcgctgggtcaaatggtatttctagttctagatccttgaggaatcaccacactgtcttcgacaatggttgaaatagtttacagtcccaccaatggtgtaaaagcattgttatttctccacatcctctccagcacctcttgtttcccgactttttaatgatcgccattctaactggtgtgagatggtatctcactgtggttttgatttgcatttctctgatgaccagtgatgatgagcattttttcatgtgtttcttggctgcataaatgtcttcttttgaaaagtgtctgttcatatcctttgctcactttttgatggggttgtttgattttttcttgtaaatttgtttgagttctttgtagattctggatattagcccttgtcagatgggtagattgcaaaaatttttctcccattctgtaggttgcctgttcattctgatggtagtttcttttgctgtgcagaagctctttagttgaattagatcccgtttgtcaattttggcttttgttgccattgcttttggtgttttagtcatgaagtccttgcccatgcctatgtcctgaatggtattgcctaggttttcttttagggtttttatggttttaggtctaacatttaagtctttaatccatcttgaattaatttttgtataaggtgtaaggaaggaatccagtttcagctttctacatctggctagccggttttcccagcaccatttattaaatagggaatcctttccccattgcttgtttttgtcaggtttgtcaaagatcagatggttgtagatgtgtggtgttatttctgaggcctctgttctgttccattggtctatatctctgttttggtaccagtaccatgctgttttggttactatagccttgtagtgtagtttgaagtcaggtagcatgatgcctccaactttgttcttttggcttaggattgtcttggcaatataggctctttttggttccatatgaactttaaagtagttttttccaattctgtgaagaaagtcattggtagcttgatggggatggcattgaatctacaaattaccttgggcaatatggccattttcatgatattgattcttcctatccatgagcatggaatgttcttccatttgtttgtgtcctcttttatttcattgagcaatggtttgcagttctccttgaaggggtccttcacatcccttgcaaattgtattcctaggtattttattctctttgtagcaattgtgaatgggagttcactcatgatttggctctctgtttgtctgttattggtgtataagaatgtttgtgatttttgcacattgattttgtatcctgagactttgctgaagttgcttatcagcttaaggagattttgggctgagacaatggggttttctaaatatagaattatgtcatctgcaaacagggacaatttgacttcctcttttcctaattgaatatgctttatttctttctcttgcctgattgcactggccagaacttccaacattatgttgaataggagtggtgagagagcgtatccctgtcttgtgccagttttcaaagggaatgcttccagtttttgcccattcagtattgttaccgggggttccttgctccaagagctcccaagatggtggcaggcagcttccaagatggcggcaggccacttccaagatggtagcaagcctcgtgttctctgacctggtgttcttggcctcatggattccaaggaatggaatcttgggccatgcggtgagtgttatagctctattagaagccgtgaatcatggaaaagaatcgtggaacccagtgactagtgttcagcttgattaggacaaacccaggcacttagcagggtaggaacaatggcaggcctttagcccatttgggagtggcaatgagcgcctcactggatcaggagcagcaggtctacaacagcagcaaacagcagtggtggacggcgagcaaaagctccgctgaagccataacaaacacggaccagaagagtgtgcagttgcaagatttaacagagtgaaaacagagctcccatacaaagggaggggacccaaagatggtagccattgctggctcgaatgcctgggtttttatcccaatcattttcactcccgctgtgctctcaggcgatagatgattggctatttctttacctcctgtttttgcctaattagcatttcagtgagttctctttactacctgattggtcgggtgtgagttaagttgcaagccccgtgtttaaaggtggatgcagtcaccttcccagctaggcttagggattcttagtcggcctaggaaatccagctagtcctctctctcagtatgatactgtctttgggtttgtcataaatagctcttattattttgagatacattccatcaatacctagtttattgagagtttttagcatgaagggctgttgaattttgtcaaaggctttttctgcatctactgagataatcatgtggtttttgtcttcagttctatttatgtgatgtattatgtatattgatttgcatatgttgaaccagccttgcatctcagggatgaagtcaacttgatcttgggggataagctttttgttgtgctgctagattcggtttgcaagtattttattgaggattattgcatcaaagttcatcagggatattggtctaaaattctatttttttgttgtgtctctgccaggctttggtatcaggatgatgctggcctcataaaatgagttagggaggattccttctttttctattgattggaatagtttcagaaggaatggtaccagttcctccttgtacctctggtagaattcagctgtgaatccatctggtcctggactttttatggttggactttttttggttggtaggctattaattattgcctcaatttcaaagcctattattggtctattcagtggttcaacttcttcctggtttagtcttgggagggtgtatgttcaacaccctactttcagcattgcacagatcttccacacagactcaacaaagaaacattagatttaatctgcactacaggccaaatggatctaatggatatttacagaacatttcatgcaagacctacagaatacactatcttttcctcagcacatggatcattctcaaggatagaccacatgttaggtcacaaaacaactcttaaagatttccaaaaatagaaataatattaagcatcttctctgactggaatgaaataaaactagaaattaataagaagaggaatttagaaaactaaacacatacataaaaattaaacaatatgctcctgaattattagtgggtctatgaagaaattaacaaaaaaattgaaagaaagatttccttacacaaataataattcaagtataacatacaaaacctatgtgatacagaaaaatagtattcagagtgaagtttatagctatcagtgactacatcaaaagaggaaaagctttacatgaacaacttaatgatgcatcttaaagcactagaaaagcaagagcaaaccaaacccgacattagtagaaaaaaaaagaaataataaagatcagagcagaaataaatgaaattgaaataattaaaacaatacaaaagatgaatgaaaccaaaccttggttttttgaaaagttaacaaaattgacaaatctttagccagcctaactatgaaaaagagagaacatccaaataaataaaatcagaaccaaaaaaggagacactataactgatattgtagataatcaaagaatcatttgtggctactgtgagcaactatataccaatacattagaaaatctagaagaaatggacaaatccctatacagactgtcaagattgaaccatgaagatatccaaaacctgaatagaccaataacaaataacaaaatcaaagctgtaataaaaactctcccaataaggaaaagcccaggacctaatggcttcattgcggaattctgcaaacatttactgaagagttagtaccaatattactcagatgattctaagaaatagaggaggaggaaatacttacacattcattctatgaggctagtattatcctgatatcaaaactaggcaaagacacattaaaaaaccctacaggacaatatctctgatgaatattgatgcaaaaatactcaacaaatgactagcaaactgaattcaacagtatattagaaagattgtttatcatgacaaagtgggatttatctccatgatgcaaggatagttcaatatacacaaatcaagcaatgcaaaatatcatatcaacacgatgaaggattaaaaaccatttgatcattcaattaatgttgaaaaagcatttgataaaattcaacatcccttcatgataaaagccctcaaaaaacagaggatagaagaaacacaccttaacataataaaagccatctacaacagacctacagctagtatcatactaaatgagaaaaaactgaaaggcttttctctaagatctgaaaaacaataaggatgcccactgccacctctgttattaaacatagtgcaagaagtcctagctagagcaatcagacaaacgaaagatataaagggcaaccaaatttgaaataaagaagtcaaagtatccttgtttgcagctgatataatcttatactgcaaaaagcctaaagactccaccagaaaactattacaactgataagcaaattcagtaaagttgcagcatacaaaatcaacatacaaaaatcaggaccatttccatatgtcaacactgaacaaagtgaaaaaaatcaaaatagtaatcccatttacaatagccacacataaaattaaatacctaggaattaacttaaagaaattaaaagatctctataataaaaattataaaacagtaaggaaattaactaaagaaaacatcaaaaatggaaagatattccatattcatggatttgaagaatcaatattttttaaatgtttatattacccaaagcaatatacagattcagtgcaatccctatcaaaataccaaagacatttttcacagaaatagaaaaaaatgtaaaatgtatatggaaccacaaagactcagaatagcaaaagcaaccctaagcaaaaagaacaaaactggaggaatcacgttacatgacttcaaactatactacagagctatagtaagcaaaagagcacagcactggcataaaaacagaaacatagatcaattgaacagaagagagaaccaagaaacaagtttacacacctacagtgaactcattttttacagaggcaccgagaacatacacagcagaaaagagagtctgttcaataatggtgctgggaaaactggatatccatactcagaatgaaactagaaccccatctcttgccatattcaaaaatcaaatcaaaatgaattaaggagttaaatctaagacctcaaactatggaactattacaagaaaagttggggaatatctccaggacattggtctgggcaaaaaaattcttcagcaacctcacaagcacaggcaaccaaagaaaacatggacaaatgagatcacaagtttaaaagcttctgcacagcaaagaatacaatcaccaaagtgaagagacaacccatagaatgagagaaaatatttgcaaactacccatctgacaagggattcataaccagaatatataagaaagctcaagcaactctataggaaaaaaatctaataatctgataaaaaaatgggcaaaagtagttttttgtactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgtcgcatatctacaactatctgatctttgacaaacctgagaaaaacaagcaatggggaaaggattccctatttaataaatggtgctgggaaaactggctagccagatgtagaaagctgaaactggatcccttccttacaccttatacaaaaatcaattcaagatggattaaagatttaaacgttagacctaaaaccataaaaaccctagaagaaaacctaggcattaccattcaggacataggtgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatgtatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcacgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcagatgtaccctaaaacttagagtataataaaaaaaaaacattaaaaataaaaaataaaaataaaaaaataaaaataaatgggcaaaagatttgtatagatatttcttaaaaagcatatgaaaggcaaacaggcatatgaaaaggtgctcaacatcagtgattatcagagaaatgcaaatcaaaactacaatgaaatatcatctcaccttagttacaatggcttacatccaaaagacaggcaataacaaatgctggcgaggatgtggagaaaagataacccctgtacactgttggtgggaatgtaaattcacacaaccactaaggagaaaagtttagaggttcctcaaaaagctaaaaattgagcaattaccatattattcagcaatcccactgctgagtgtgtacccaatagaaaagaaatcaatatatcaaagagatatctgtactcctatgtttgttgcagcactgtttacaatagtgaagaattggaagcaacctaagtgtccatcaacaaatgaataaagaaagtgtggtatatatacacaatggagtactagtcagccatgaacaaaaagggatcctgttatttgcagcaacatggatggaactggagatcattatgctatgtgtaaaaagccaggcacagaaagacaaacatcacgtcttctcacttatttgtgggatctaaaaattaagacaattgtattcatgcagatagagagtagaaagattgttagtagagactgggaagaaaagtgggggactcagggaggatgtggagatggttaatggatacaatgaaaatagtttaaaagaatgaatacaacctactatttgatagtgcattaggttgtctgtagtcaataataactgaacattttaaaatgaagagtatatttggattgtttgtaactcaaaagataaatgcttgaagagatagataccccattctctatgatgtgcttatttcacattgcatgcctatatcaaaatatccatatatctcctaaatatatacatttactatgtacacacaaaaattgaaactaaaactaaaaattaaatgtttgttagaattcagcagtgaaaccattgagttctgggcttttctttactggaagaatttttattacagttttaatcacattacttgttaatgatttgttcagtaggttgtatgtgtctaagaatttttccatttttttttgattttccaatttattggcatagttgctgttagtagccactaatgatccttcaaatttcagtatcagttgtaatgtctcctttttcatctccagttttacttatttggatttctctttctctctctctctctccatctcgctctctctctccctctcgctcacttcctgttttaattaatctgcctaaatgtcaattttatcttctcaaaaatcaaggttcagtttcattcatcttttgtatttttttatctcaatttcctttatttctgttctgttcattattatttctttccttctacgaatcttgagtttggtttgctcttgcttttctaattctttaagatgcatcatttggttatttggagttgttcttcgttttttttaaattttattattattatactttaaggtttagggtacatgtgcacaatgtgcaggttagttacatatgtatacatgtgccatgttggtgtgctgcacccattaactcgtcatttagcattaagtatatttcctaatgctatcccttcccgcctctccccacgacacaacagtaactggagtgtgatgttccccttcctgtgtccatgtgttctcattgttcaattcccacctatgagtgagaatatgcggtgtttggttttttgtccttgcaatagtttgctgagaatgatggtttccagtttcatccatgtccctacaaaggacatgaactcatcgtttttttatgtcggcatagcataccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggaaggctggttcaaatggtatttctagttctacatccatgaggaatcgccacaccgactcccacaatggttgaactagtttacagtcccaccaacagtgtaaaagtgttcctatttctccacatcctctccaacacctgttgtttcctgacattttaatgatcgccattctaactggtgtgagatggtatcccattgtggttttgatttgcatttctcttacagacagtgaggatgagcattttttcatgtgtttttcggctgcataaatgtcttcttttgagaagtgtctgttcatatacttcatctactttttgatggggttgtttgtttttttcttgtaaatttgtttgagttcattgtagattctgaatattagccctttgtcaggtgagtaggttgcgaaaattttttcccatttcataggttgcctgttcactctgatggtagcttcttttgctgtgcagaagctctttagttgaattagatcccatttgtcaattttggcttttgatgccattgcttttggtgttttagacatgaagtccttgtccatgcctatgtcctgaatggtattgcctaggttttcttctagggtttttatggtttaggtctaacctgtaagtctttaatccatcttgaattaatttttgtataaggtgtaagggagtgatccagtttcagctttctacatctggctagccagttttcccagcaccatttattaaatagggaatcttttctccattgcttgtttttgtcaggtttgtcaaagatcagatggttgtagatatgcggcattatttctgagggttctgttctgttccattgatctatatctctgttttggtaccagtaccatgctgttttggttactgtagccttgtagtatagtttgaagacaggtagcatgatgcctccagctttgttcttttggcttaggattgactttgtgatgcgggctcttttttgattccatatgaactttaaagtagttttttccaattctgtgaagaaagtcattggtagcttgatggggatggcattgaatctgtaaattaccttgggcagtatggccattttcacgatattgattcttcctacccatgagcatggaatggtcttgcatttgtttgtatcctcttctatttcattgagcagtggtttgtagttctccttgaagaggtccttcacatcccttgtaagttggattcctaggtattttattctctttgaagcaattgtgaatgggagttcactcctgatttggctctctgtttgtctcttattggtgtataagaaagcttgtgacttttgtacaatgattttgtatcctgagactttgctctatttgcttatcagtttaaggagattttgggctgagacgaaggggttttctagatatacaatcatgtcatctgcaaacagggacaatttgacttcctcttttcctaattgaatgccatttatttccttctcctgcctcattgccctggccagaacttccaacactacgttgaataggagtggtgagagaggacatccctgtcttgtgccagttttcaaaaggaatgcttccagtttttgcccattcagtatgatattggctgtgggtttgtcatagctagctcttattattttgagatacatcccatcaatacctaatttattgagagtttttagcatgaaggggtgttgaattgtgtcaaaggccttttctgcatctattgagataatcatgtggtttttgtctttggttctgtttatatgttggattacatttattgatttgcatatgttggaccagccttgcatcccagggatgaagcccacttgatcatggtggataagctttttgatgtgctgctggattcggtttgccagtattttattgaggatttttgcatcagtgttcattaaggatattggtctaaaattctcttttttggtttgtctccgccaggctttggtatcaggatgacgctggcctcataaaatgagttagggaggattccctctttttctattgattggaatagtttcagaaggaatggtaccagctcctccttgtacctctggtagaattcggctgtgaatccgtctggtcccggactctttttggttggtaggctattgattattgccacaatttcagcgcttgttattggtcaactcagagattcaacttcttcctggtttagtcttgcgagggtgtatgtgtcgaggaatttatccatttcgtctagattttctagtttatttgcatagaggtgtttgcagtattctctgatggtagtttgtatttctgtgggattggtggttatgtctcctttatcattttttattgcatctatttgattcttctctctttttctttattagtcttgctggcggtctatcaattttgtcgatcttttcaaaaagcagctcctggattcattaattttttgaagggttttttgtgtctctatttccttcagttctactctgattttagttatttcttcccttctgctagcttttgaatgtgtttgctcttgcttttctagttcttttaattgtgatgttagggtgtcaattttggatctttcctgctttctcttgtgggcatttagtgctataaatttccctctacacgctgctttgaatgtgtcccagagattctggtatgttgtgtctttgttctcgttggtttcaaacaacatgtttattcctgccttcattttgttatgtacccagtagtcattcaggagcaggttgttcagtttccatgtagttgagcgcttttgagtgagtttcttaatcctgagttctagtttgtttgcactgtggtctgagagacagtttgttataatttctgttcttttacatttgctgaggagtgctttacttccaactatgtggtcagttttggaataggtgtggtgtggtgctgaaaaaatgtatattctgttgatttggggtggagagttctgtagatgtctattaggtctgcttggtacagagctgagttcaattcctgggtatccttgttaactttctgtctcgttgatctgtctaatgttgatagtggggtgttacagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaaccccttcctttttttgttttccatttgcttggtaggtcttcttccatccctttattttgagcccatgggtttcctgaatacagcacactgatgggtcttgactctttatccaatttgccagtctgtgtcttttagttggagcattcagcccatttacatttaaagtttatattgttatgtgtgaatctgatcctgtcattatgatgttagctggttattttgctcattagttgatgctgtttcttcctagccttgaaggtctatacaatttggcatgtctttgcagtggctggtactggttgttcctttccatgtttagtgcttccttcaggagctcttttagggtaggcctggtggtgacaaaatccctcatcatttgcttgtctgtaaagtattttatttctccttctcttatgaagtttagtttggctggatatgaaattctgggttaaaaattcttttctttaagaatgttgaatattggtccccactctcttctggcttgtagagtttctgccgagagatccactgttagtctgatgggcttccatttgtgggtaacccgacctttctctctggctgcccttaacattttttcctttatttcaactttggtgaatctgacaattatatgtctttgagttgctcttttcgaggagtatctttgtggagttctctgtatttcctgaatctgaatgttggcctgccttcctagattggggaagttctcctggagaatatcctgcagagtgttttccaacgtggttccattctccccatcactttcaggtacaccaatcagatgtagatttgatcttttcacatagtcccatatttcttggaggctttgttcatttcttttattcttttttctctaaactttccttcttgcttcatttcattcatttcatcttccgtcactgataacctttcttccagttgattgcagcagctcctgaggcttctgcattcttcacatagttctcgagccttggctttcagctccatcagctcctttaaggacttctctgcattggttattctagttatccattcgtctaattttttttcagtttttaacttctttgccattggtttgaatttcttcctgtagctcggatattttgatcacctgaagccttcttctctcaactcgtcaaagtcattctccatccagctttgttccattgctggtgaggaactgtgttcctttggaggaggagaggtgctctgatttttagagtttccagtttttctgctctgttttttccccatctttgtggttttatctacttttggtctttcatgatggtgacgtacagatgggtttttgtgtggatatcctttctctttgttagttttccttctagcagacaggaccctcagctgcaggtctgttggagtttgctagaggtccactccagaccctgtttgcctgggtatccacagcggtggctgcagaacagcagtagctgtagaactgcagattttggtaaactgcaaatgctgctgcctgattgttcctgtggaagttttgtctcagaggagtacccggccgtgtgaggtgtcagtctgcccctacttgggagtgcctcccagttagggtgctcaggcatcagggacccacttgagaaggcagtctgcccattctcagatctccagctgcatgctgggagaaccactactctcttcaaagctgtcagacagggacatttaagtctgtagaggttattgctgtctttttttttgtctgtgccctgcccccaaagatggagcctacagaggcaggaaggcctccttgagctgtggtgggctcacccagttcgagcttcccggctgctttgtttacctaagcaagcctgggcaatggcaggcgcccatcccccagcctcgctaccaccttgcagtttgatctcagactgttgtgctagcaatcggtgagactccatgggggtaggaccctccgagccaggagcaggatataatctcctggtgtgccgttttttaagcccgttggaaaagtgcagtattagggtgggagtgacccgattttccaggtgctgtctgtcacccctttctttgactaggaaagggaactccctgatcccttgtgcttcccaagtgaggcaatgcctctccctgcttcggctcgtgcacggtgcgcacagtgcactgcacccactgtcctgcacccactgtctggcactccctagtgagatgaacccggtacctcagatggaaatgtagaaatcacccatcttctgctttgctcacgctgggagctgtagactggagctcttcctattcggccatctttcttcatttttttatgtaggcacttatagttataaatttccctgttagtaatgctttcactgtatcccaaaggttttgctttgttgtattttcattatcatttttaatacaattgtcaatttttttttcaattttttctttgacccactggtcattcagcagcatatcatttaatttttatgtatttttatagtttccaaaattcctcttgttattgatttctagtattattccattgtggtcagcaaagatgctgtgccacctggagtttgggaaggcgtggtgcaagcactctgttagctgccctggcttgtgtctcagtgtgtctcgtgccccacatgtccactggctctgagcccccctgagtattagggcttgcctaggagttgcaattcttgtggtttagtctgcctttcaggtttatttagggacccataggactttagcctgtggtggagaggcttgctggaactcaaattccaaccactgtgatgaatgattcccttatagcaagggcaggcctatatgctccctcttttgtgggtgttagctgaattcagtctggttttgctttctgctgtcacagccagcatcgtgttcaatggaaattctcacaattttttatctctctctcccccaacaacagaggttctctctccgtgacacacagctgctgctgtgggatgtgggagtggtggcatcagcaatttaagattgactttcctaccctcttcagtgcctgctttaatgacattcggttgaaaccaggtactgagtgctcacctgatttggggttcttatgaaagtgcttttctgtatagacagttgttaaatttggtgatcctttcagggcagggtgggtggtgtgatgatttgtgaagcctactattcagccatctttctcttcctatcaaaaactcttaatcttgaagaaaagagataataggtgtgagaaatgtagaatataatgctaggttgtccaaagataacacataccataatatgtttttccacacttattttcaaggattagttcacttaatttgcacagagtttatatagctcactagaagtcacagtggagacaatgacttcctcactgctcagaaaccactttccttgtttgacaagatgctacatttccaacaaggcttggaacttcaagtcatggatccatgtcctacatatagaacatttctcaaaggttttggtcccaggaacatttctcaaatgtctggtctccttttatactcttaagaattattaaagaccttaaatagcttttattaaatatatgggttatatttatcaatatttactgtattgaaaattacatttgagaaaatatatgtttactttaaaatagtaaacatattacaaaacataaatatgatgttttttatgaagaataatattttataaagaattagtgagaaaagaggcactgtcttatgatttgcaaatctctttaatgtctgacttaatagaagatagctggattctcatatctgcttcttcattcaattttctgtgatatgctgttttagttgaagaaaatttggccttaaattgatatatagttgagaagagaggaatattttaatagctttttccaattactgtggatttttttttgactctacaacaagcttgacaagtgtagtttcttagtttgcaatgtggaatctgacagtatatcagtgaatttttcagactttgttgcattaaaatctactggtctatcttgcactttgaatggatctgctacccaaacatgattttgtaacatcatgcgttggttatatgaaaaatactggtttactgatttatgcaggtcttccaaatgttgacatattcttataaaatatctaaactattatatttattaatatcaccactgatctcttaagaaaagtcataagtattggaaagctgtcaggctcacagtagtggacataagttttgcaaaattctaatttattttctgagagttcaaattttaccattggccacaaatactgtctattgttttgcttgaagtgacatgctcactttattaatttttgagaaaatgt

SEQ ID NO: 6642 - DNA, 13505 bp, artificial
  synthetic oligonucleotide
agacattgtactttcaagtaaactaacttcaaaaagttggcaatatgtatttgaaaatgattttaaaattttgaaatcctgccatttgtgaaaaatagatgaatctggagaacattatgctaaatgaaataagccagacacagaaaaaagatactgtgtcatatcacttatttgtggaatccaaaaaagtcaaactcatagaagctgagagtagaatgttggttgccagaggctgcataggaaggtggattggagatatgttggtaaaagcgtgcaaactttcagttctgaaatgaatacgttctgagggtctaatgtaccatatggttgactatagttaataatactgcgctgtagacttgaaatttgtgaattgagtagaccttaagtgttatcaccacacccaaacaaaatggtaactatatgcagtgatggatgtattaattagctttattgtggtaatcatatcatattggatatgtatgtcaaatcatcgtgtataccttgaatatatataactttatttgtcattatgcctcaggaaacctggaaaaaagcaaataaacaaacagtaacaggatcaggcattaaagaaaaaattttgaaagccaggaaagtaaatagtaaagaagatgagatatacatttaaaaaatacccaattcttgctccaagaactaccacaggaacataccaggaaaactgagagaattcgcagaccctttcaaagaagcagcttgccattgcaaacgctggtgagacagctgaaaaactgagttcccaaagtgtgagaggggaaaaagtcagcctctgaacatccatccctactggggaacctgaaaatccagatcatgggagaaggatttaaccttacctagagctgaaacagatttagggagctgagtgaaatataaaagtagaagaagcagtttgaagagccttgtaggcactcccagtcctcagcttgagccccagggaagccattcctggtcttatctcacagaagtcctgggggaagggatggcagccagcagaattggggaggggccacagggtgaaagaaggtcctagctgaacttctgtaataattttgactgagcacaaactttcctgagaagaatccagggttagggagaggtgaacaggaagtgcagatatgagtgcagaagccacagcagaagttgcaggcaggtggtgaggtgaagcctgaaagccctgcttgctttctcagcaaggaggcttgtggcctggggcaagatcacagccctcctctccagctgcctggatataaactctgctattggtggggcacagtgggagtgagactggccttgcaggctgcatgagagctaggtgaggtctgtcactgccggctttcctccactttcctggtgacctgtatgacacagcagaggcaaccatagtgcccctgggaacataactccattggcctgagaaccctctcacccccaacactcaaagtggccagagcaagctccactcagggagagtctgatctcagacctgcctaccctacagccacctgatgatttttctctacctgccctggtagcctaagacaaaagacataagctattgggagctgtatggccccacccatcaacaaaaaaccctagtactcatcctggccaacatagggcaagattatatcccccttctactactgcagctggtgccctcttgaaagcatcacctgctggctggatgccaaccaagccattacatcaactaataacagaaaaatcctgctccaaagaaggagaaaacaacagctctttttaccacttgcaacaccctggctagtcagagatcctgagtctgtccacatgacaacttgactgctagcataactagcatttgtggaaaccagtgcactaaacaaaactacaaccagggactcccacagagctcacttcaccccctgccacttccactggagcaggtcctagtatctgtggctgggagacctgaagatgaatcacatcccaggactctttgcagacataccccatcaccagcctaaatcccagtagccacactgggtggctagaccaaagaaggcaataacaatcagtgcagtctgactcttaggaagccctatccttagaggaagagggagagaaccacatcaatgaatcaccctatgggacaaaataatctgaacggcagcccttgagttccagaacattccactgaaacagtctacccaaataagaagaaaccagacaagtaattctggtaatatgacaaaacaaggatctataaaaccccaaaagatcacactagctctccagcagtggatccaaaccaagaagaactctctgaattgcagatacagaattcagaaggttgattattaagctactcaaggggcaccagacaaaggtgaaaaacaacttaaagaaatttttagaaaataacaaaatatggatgaaaaagtctccagagtaatagatatcataaagaaaagacaatcacagcttctggaagtgaaagcacacatagagaaatgcaaaatacattggaaactttcaacaataaaataaaacaattagaagaaaaaacttccacactcaaagaaaaggcttttgaattaacccaatccaacaaaagcaaaggaaaaagaattaaaaaatgaacaaagcttccaagaaatttgggattatgttagatgaccaaacataagaataattgttgttcctgaggaaaagagaaatctaaaagtttggaaaacttatttgagagaataatcaagaaaaatcttccctggtcttgctagagatataggcatccaaatataagaaactcaaagagcacccaggaaattcattgcaaaaagatcatcacctaggaacacagtcatcaggttatctaaagtcaagacaaagaaaagaatcttaagagctatgaagcaaaaggatcaggtaacatatgaagaaaaacctgtaagattaactgcagatttctcagcagaaaacctgcaagccagaagggatccaggtcttattgataaactccttaaacaaattatcagtaattttgtatccagtgaaattaagtttcataaatgaaggagagataaagtctttctcagacacacaaatgctaagagaatttgccacaaccaagccagcactaaaagaaatgctagaaagatggctgaataggaacagctctggtctacagctaccagcatgagcgacgcagaagccgggtgatttctgcatttccatctgaggtaccgggttcatctcactagggagtgccagacagtgggcgcaggtcagtgggtgaactcaccatgcatgagccgaagcagggcgaggcattgcctcacttgggaagggcaaggggtcagggagttccccttcctagtcaaagaaaggggtgacagacggcacctggaaaattgggtcactcccacccgaatactgcgcttttccgatgggcttaaaaaacggcgcacagggagattatatcccgcacatggctcggagggtcctatgcccacggagtcttgctgattgctagcacagcagtctgagatcaaactgcaaggcagcagcgaggctgggggaggggcgcctgccattgcccaggcttgcttaggtaaacaaagcagcctggaagctcgaactgggtggagcccaccacagctcaaggaggcctccctgcctctgtaggctccacctctgggggcagggcacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgatccccaagcagcctaactgggagacactcgccagcaggggcagactgacacctcacacggccgggtactccaacagacctgcagctgagagtcctgtctgttagaaagaaaactaacaaacagaaaggaaatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacagaacaaagctggacggagaatgattttgacgagctgagagaagaaggcttcagaagatcaaattactccgagctacgggaggacattcaaaccaaaggtaaagaagttgaaaactttgaaaaaaattaagaagaatgtataactagaataaccaatacagagaaatgcttaaaggagctgatggagctgagaaccaaggctggacaactacgtgaagaatgcagaagccccaggagccgatgcgatcaactggaagaaagggtatcagcaatggaagatgaaatgaatgaaatgaagcgagaagggaagtttagagaaaaaagaataaaaagaaatgagcaaagcctccaagaaatatgagactatgtgaaaagaccaaatctacgtctgattggtgtacctgaaagtgacggggagaatggaaccaagttggaaaacactctgcaggatattctccatgagaacttccccaatctcgcaaggcaggccaacattcagattcaggaaatacagagaatgccacagagatactccacgagaagagtaacaccaagacatataattgtcagattcaccaaagttgaaatgaaggaaaaaatgtgaagggcagccagagagaaaggtcgggttaccctcaaagggaagaccatcagactaacagcggatctctcagcagaaactctacaagccagaagagagtgggggccaatattcaacattcttaaagaaaagaattttaaacccagaatttcatatccagccaaacaaacttcataagagacggagaaataaaatcctttacagacaagcaaatgctgagagattttgtcaccaccaggcctgccctaaaagagctcctgaaggaagcactaaacatggaaaggaacaaccaataccagctgctgcaaaatcatgccaaaatgtaaagaccatcgagactaggaagaaactgcatcaactaatgagcaaaataaccagctaacatcataaagacaggatcaaattcacacataacaatattaactttaaatgtaagtggactaaatgctccaattaaaaggcacagactggcaaattggataaagaggcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattactcaatggtaaagggatcgattcaacaagaagagctaactatcctaaatatatatgcacccaatacaggagcacccagattcataaagcaagtcctgagtgacctacaaaaaggcttagactcccacacattaataatgggagactttaacaccccactgtcaacattagacagatcaatgagacagaaagtcaacaaggatacccaggaattgaactcagctctgtaccaagcagacctaagagacatctacagaacactctaccccaaatcaacagaatatacatttttttcagcaccacaccacacctattccaaaattgaccacatacttggaagtaaagctgtcctcagcaaatgtaaaagaacagaaattataacaaactatctctcagaccacattgcaatcaaactggaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaactgacaccttaacatcacaattaaaagaactaggaaagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagactgctagcaagactaatacagaagaaaagagagaagaatcaaatagatgcaaaaaaaatgataaaggatatatcaccaccaatcccacagaaatacagactaccatcagagaatactataaacacatctatgcaaataaactagaaaaatctagaagaaatggataaattcctggacacatacaccctcccaagactaaaccaggaagaagttgaatccctgaatagagcaataacaggctctgacattgaggcaataatcaatagcttaccaaccaaaaagagtccaggaccagatggattcacagccgaattctaccagaggtagaaggaggaactggtaccattccttctgaaactattccaatcaatagaaaaagagggaatcctccctaactcattttatgaggccagcatcatactgataccaaagccgggcagggacacaaccaataaagagaattttagaccaatatccttgaatatccttgatgaacattgatgcaaaaatcctcaataaaatactggcaaaccgaatccagcagcacatcaaaaagcttatccaccatgatcaagtgggcttcatctctgggatgcaaggctggttcaatatacgcaaatcaataaatgtaatccagcatataaacagaaccaaagaccaaaaccacatgattatctcaatagatgcagaaaaggcctttgacaaaattcaacaacgcttcatcctaaaaactctcaataaattaggtattgctgggatgtatctcaaaataataagagctatctatgacaaactcacagccaatatcatactgaatgggcaaaaactggaagcattccctttgaaaactgccacaagacagggatgccctctctcaccactcctattcaacattgtgttggaagttctggccagggcaatgaggcaggagaaggaaataaagggtattcaattaggaaaagaggaagtcaaattgtccctgtttgcagaagacatgattgtatatctagtaaaccccattgtctgagcccaaaatctccttaagctgataagcaacttcagcaatgtctcgggatacaaaatcaatgtacaaaaatcacaagcattcttatacatcaacagcagagaaacagagagccaaatcatgattgaactcccattcacaattgcttcaaagagaataaaataccgaggaatccaacttacaagggatgtgaaggacctcttcaaggataactacaaaccactgctcaaggaaataaaagaggatacaaacaaatggaagaacattccatgctcatgggtaggaagaatgaatattgtgaaaatggccatactgcccaaggtaatttacagattcaatgccatccccatcaagctaccaatgactttcttcacagaattggaaaaaactactttaaagttcatatggaaccaaaaaggagcccgcattgccaagtcaatcctgagccaaaagaacaaagctggaggtatcgcactacctgacttcaaactatactacaaggctacagtaaccaaaacagtatgatactggtaccaaaaaaaagatatagatcaatggaacagaaccgagccctctgaaataatgctgcatatctacaactatctgatctttgacaaacctgagaaaaacaagcaatggggtaaggattccctatttaataaatggtgctgggaaaactggctagccagatgtagaaagctgaaactggatcccttccttacaccttatacaaaaatcaattcaagatggattaaagacttaaacgtttgacctaaaaccatagaaaccctagaagaaaacctaggcattaccattcaggacataggcatggcaaggacttcatgtctaaaacaccaaaagcaatggcaacaaaagccaaagttgacaaatgggatctaattcaactaaagagcttctgcacagcaaaagaaactaccatcagcgtgaacaggcaacctacaaaatgggagaaaattttctcaacctactcatctgacaaagggctaatattcagaatctacaatgaactcaaacaaatttacaaggaaaaaacaaacaaacccatcaaacagtgagtaaaggacatgaacagatacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgttggagaggatgtggagaaacaggaacacttttacactgttggtgggactgtaaactagttcaaccattgtggaagtcagtgtggggattcctcatggatctagaactagaaataccatttgacccagccatcccattactgggtatatacccaaaggactataaatcatgctgctataaaacacatgcacatgtatgtttattgcggcattattcacaatagcaaagacttggaaccaacccaaatgtccaacaatgatagactggattaagaaaatgtggcacatatacaccatggaatactatgcagccataaaaaatgatgaattcatgtcctttttagggacatggatgaaattggaaatcatccttctcagtaaactatcgcaagaacaaaaaaccaaacactgcatgttctcactcataggtgagaattgaacaatgagaacacatggacacaggaaggggaacatcacactctggggactgttgtggggtggggggaggggggagggatagcattgggagatatacctaatgctagatgacgagttagtgggtgcagcgcactagcatggcacatgtatacatatgtaactaacctgcacattgtgcacatgtaccctaaaagttaaagtataacaataataaaaaaaggaatgttaaaaagaatcctagatcttgaaacgaaaccttgaaatacaccaaaatagaaactccttaaagaataaatctcacagaacctataaaacaataatacaataagaaaaacaaggtatttgggtaacaactagcatgatgaatagagcagtacctcacatttcaatactaacattgaatgcaaatggccctaaatgctctgcttaaaagatgcagaatggcagagtggataaaaatccaccaaccaagtacctgctgtcttcaacagactcacctatcacataaggactcacataaacttaaggtaaagaggtagaaaaagatattccatacaaatagacacccacagcaagcaggagtagctattcttatatcagacaaaacagacattaaagcaacaacagttaaaacagataaagaggggcattatataatgacaaaagaattagaccaacaggaaaatatcacaatcataaatacatatgcacctaacactggagcttccaaatttataaaatatttactaccagacctaagaaatgaaataaatggcaatagtgggaaacttcagtactctactgacagcactagacaggtcatcaagacagaaagtcaacagagaaacaatggacttaaaagaagaaatggacttaacagatatatacagaacattctacccaacaactgcagaatatacattcttttcatcagcacatggaacattctccaagatagaccatatgataggccacaagaagtgactcaagaaatttaagaaaatcaaaattatatcaagtactcttgcagaccacagtggaataaaattagaaatcaacttcaataggaacccttaaaagtatacaaatacatgaaaattaaataatcttctgaatgatcctttggtcaacaacgaaatcaagatggaaattaaaaaatcatttgaactgaacaataatagtgacacagacagtcaaaacctctgggatacagcaaaagcagtgctacaagaaaagttcatagtattaaatgcctacatcaaaaagtctgaaagagcacaaacagacagctaagctcacacttcaatgaactagagaaacaagaacaaatcaaacccaaacccagcagaagaaaagcagtaacaaagatcagagcagaattaaataatattgaaagaaaaaaatacaaaagataaatgaaacaaaaagatggttcttttgaaagataaacaaaagtgatagaccattagcaagattaaccagaaaaaaaggaagaagaccctaataagctgaattagaaataaaatgggagatattacatcccatagcacagaaatacaaaggatctttcaaggttgctgtgaacaactttatgtgcgaaaattagaaaactagagaaggatacattccttgaaatatacaacccccctaaactatgaggaaatataacttttgaatataccaataataagtagcaagattgaaacagtaataaaaaaaattgccaacaacaaaaagtccaggagcagatgcattcacagctgaattctagcaagccttgaaagaagaattggtaccaatcctattataactattccaaaggatagagaaagagggaatcctccctaaatcattttatgaagccatgatcaccctaataccaaaaccaggaaaggatataacaaaaaaagaatactacagaccaatatcctgatgaacatagatgtaaatatccttgacaaaataccagctaaatgaattcaacacgataccacaaagataatacatcatgattaagtgggtttcataccagggatgcagagttggtttaacatatgcaagtcaataaatgagatacactacataaacataagtaaaagcaaaaatcataccatctcgatagatgcagaaaatcatttgacaaaatttagcatccctttatgattaaaactctcagcaaaactggcataaaagggacataccttaaggtaatagaagttatctatgataaatccacagacaacattatattaaatgggggaaaagttgaaagcatttcccttgagaactgaaacaagacaaagatgcctactttcaccacttctattcaacatagtaccagaagtcctagccagagcaatcagacaagtgaaagaaataaagggtatccacattggtaatgagaaaatcaaactattgctgtttggtgatgacatgatcatatatctgaaaaccctgaagactcacccaaaaagctcagagacccgataactgaattcagtaatgcttcaggatacaaaattaatgcactcaaatcagtagcactgctatacaccagcagtgcccaagcagagaatcaaatcaggaactcaaccccttatacaacagctgcaaaaaacaaaaacaaagcccttaggaatatacctaaccaaagaggtaaaatatctgtataagaaaaactacaaaacactgctgaaagaaattattgatgatacaaacaaatggaaacacatcccatgctcatggatggggagcacactgctgaaagcaaactataaattcaatgcaattcccatcaaaatgccaccatcattcttcacagagctagcaacaacaattctaaaatttatatggaacaaagaaagagcccgcataatcaaagcaagactaagcaaaaagaacaaatctggaggtatcacattacttgacttcaaagtatactacaaggctgtagttgccaaaacaacatggtatttgtttaaaaataggcacatagactaatgcagcataatagggaacccagaaataaagccaaatacttaacatcaactcatatttaacaaagcaaacaaaaactaaagtggggaaaggacaccctattcaacaaatggtgctggcataattggcaatccaaaactagaagaatgaaactgaattttcatctctcacctaatacaaaaatcaactcaagatagatcaaaaacttaaatctaagacctgacaccaaaaaattctagaagataacatcagaaaaactcttctaaacattggcctaggcaaaaaatttatgaccaagaacccaaaagcaaatggaacaaaaataaagatagatggaacttaattaaagtaaaaagcttctgcacagaaaaaaaaaaaatcagcagagttaacagacaacccacagagtgggagaaaatcttcacaagctatgcatccaacaaaggactaatatccagaatctccaaggagctcaaacaaatcagcaagaataaaatgaacaactccatcaaaaagtgggctaagaacatgactagacaattcccaaaagaagatatacaaatgtctagcaaacaggaaaaaaaatgctcaacatcactaatgatcagggaaatgcaaatctaaaccacaatgcaataccaccttactcctggaagaatggccataattaaaataaataaataatacatgttggcatggatgtggtgaaaagggaacacttttacactgctgttgggaatgtaaactagtataaccactatggaaaacagtatggagattccctaaagaactaaaagtagatctcccatttgatccagtaatctcactattgggtatctacccagagaaaaagaagtcattatataaaaaagacacttacacaggcatgtttatagcagcacaatttacaattgcaaaaatgtgaaaccagaataaatgcccatcaaccaacgagtggataaagaaaacgtgcatatatatcatggaattgttcctagccatgtaacggaatgaatcaatggcattcacagcaacctagatggagttggagaccattattctaagtgaagtaactcaggaatggaaatccaaacatcatatattctcacttataattgggaactacactatgaggatacaaaggcataagaatgatacaatggactctggggacttgagaggaagggtgggaaggggctgagggatttaagactacacactgggtacagtgtgcactgcttgggtgatggatgcaccaaaatctcagaaatcatacctaaagaatttatccatgtaaccaaacactacctgtttcccaaaaaggaatgaaataataataataaaaagcacaacaacaacataaaagaaaatatacccagtagacattttgagatctaagaaataaggtaagatagacatatgcaaggtgatacaaataatcatttggaataaatgtgaatcaacagtatttgttcagaacattggctatccttttagttaatagatttttgttcataagaaatttaaaatta

SEQ ID NO: 6643 - DNA, 972 bp, artificial
  synthetic oligonucleotide
agatgatataggtttgattaccttagagccacatagttcattttttttttctttaaatgtgctgaatgctactcctgtgttaattttctttgtgcttgtctctgaaccatgtgaaactgcttttcctggattttccatcttgcactatcattgctctctgttacaagatgctgcaaaaggttttgctaacaaattacttcttgtgttctatacagagatagtcctgggttcatgagtgctactcacacacccaacttctctctaatgatgcccactgatgccctattaacccacagaagatgctttttttatatgaagtgtgatggcaaattaatagatggcaaattgatttgcaaaagtttctccaggtgacaagggagaagcttgttttcttacaagatgatctcacacctgcccctgtgtggtcttccaactctacaccctgcatgagagaaaaccttccattggcctcactcttgaaatagatagggcagataccccactggggatgcctgcaggagagtttcctccatgccttcctaggaaccagaataaggagattaaggtccagattgtgagagcaaaccgtccttcatgaatgaacactcagtgcaccaaaacctcactgacttttctaagggtagccgatgttctccgaaattctgatttacagacaactgaaggcccccaagggcctcccaagagaaaggtagactatcacatgtgaacacagaggcctatgggacaactttttgtcagaattttaaaggcaatgtgggactgtttctcataagttctcacttaaacatattgtcctgcctcatatggactatgtctatctcttccctatttgcaagttagagagaaagaggatctcctgtcaccatggtcttggctgttttcttatcatacctcccaaaagaaaggcctgaaatggacaatttgtttctggttttgaagagtgaggctatt

SEQ ID NO: 6644 - DNA, 1226 bp, artificial
  synthetic oligonucleotide
tttattttcccaggtaagctccctctacctttgtcctggggcatgtatttatggatattttagttagaaaaagctatcaattagtgtaattagcttattgtcaccttcaatcttgaccctctccctgcactgtcccctacccacctcaggttctctcttattttaacttagtgagcagagctcctggctgcatcaccatagcaaccagcagctaggacctattaagccatgatgagtcattagacatctaagctgattatagagtccagaatgttaactgcagaagagatgctgaaagaaggaaaatgaggcagatcttaacctacaaacaagtagacaacagagtagctgagtgcttcaaactatccccgacctggatgccatgggcgctatgggcctgggtgtcaacaccttggcatgtaccctcagccaccagaccagagggaggggcaccaggcccattctcttcccagggaagtaattctggacaccttcctgccaacatgctccaagtagatggatttgagtctggatttttcaatgggcagtaccaattactgagttcatcctgagtcctactcctaatctagtgacacatttccttatctttcaactttccatagaagtttcttaaatgaaaaagggcatttttttttttacttgtttgaaactctcttttcccagtcagttcccctgctgccttggcctgtatttgtggcctgttaaatttaaaagtctatcagttagtctaattaggatattcaaattttaattattttcccttctccacatgggcagccacccacccttcttttattctctctttttatttcatttagggaaaaaagctcttggcaggattgctatagaaaccagccaccaggcagactaggccattgtgcttctggacactgatactcaaagctgattatgggtctggaagcttgcatggctgagcaagactgatggagttaagacaaagagggtctcagctacagagaaggggaaaataagcacctcagaactttagacaaacctcagccctacctttatctttgcccctgtatgcttcatggaagaaaaaagttagaatgaggaaggctgtcccctattaaagatgaatgtctgggttgacatcagaacttgtgcccttaggctaaccctgccatgacgacaaacccacacctgtgaacatgtcattttcactgagtatccctagttcctat

SEQ ID NO: 6645 - DNA, 1539 bp, artificial
  synthetic oligonucleotide
ttataccagggctccgtctcagaaattgttacctgctggctctctagggaaggcttatggggagctatgagacaggttagaagctgtaagggggatcagaatgaagacagcctaaatgcaaacactcaccttaacagcttgggtgctgaaataaactgcattggcagaggatcccctgcagagttcctccaggtagatttttcagtctgactgaaggtgcaaggccattgttggctctcaagagtcactctgaggatatgggcccttgttacctctgccacagagttatttctcccactcctcctttaaagtcattgtctttctgagctatttcaaattcttcacaggtgctttacacgctgcttctgtcttcactagcagtccttcccttcctctccccaacctcagatcttacaatagatgtcactaaagcacatcttgtccccagccctccataccacttcatccttcccaccactattcctgactactttcccactcatccaggcttgacacccctgcaccttccccagactatcttagatgccatcaccttcccactatccttcccagcacttaaaatcgggagttattcttgtggactctcatagaactctgagcttatgcctattatgccactttccatagcataatataattgcttgtttacttccatgagccctcccccttaagctctggagcccagctgggtcttcttcactcttttattcccagcacacagcactgttctcagagcatggcaggtgcttaatgcctatagaataaatgaatgcacaagcatagggtctaattcattatgcttttattgcaaatacaggtaaatgacagttttgtgtatatatatatttgtgtatatatagttgtatatatgtatacggcagtagacacaaagggagagcaatcacagatcagtggttttgtgtttgttttgttgtgtgtgtgtcattgttatttaactcctgtaccagaccattttactgattatttcaaagatgtaaatattatcaatacattttacagagctgtctgaacttttatgctgaaacaagaccgggatggcaaatgaaaaattccatttataaatattggtcattaacctaatccaagagtatattaaaaggaaggaaatactactagaattggaacacagacagcaagcacaatttgtacttcccacacaagccctacctggattctaatttagagccccaatgcctattttaccaaggcatctttaacttatgccactcagctgaagtgatacatattccctagacttcacgtggggtcaaggaaaaacatgatagttgcctcagatttggctctggcctcctcatcttccacagcctccctatattgttctggccagttctgtggtcgctttctgtagagcctggccatgtactccaagactttcattttgatggtttcatggtgagctcgaggaccccatagaagctcatattcaactggattagagtaggacagtggcctgcattccagatagcgctgtctcat

SEQ ID NO: 6646 - DNA, 750 bp, artificial
  synthetic oligonucleotide
tggccttttccaggtagctcaccagtaagaaaatgtgcttaatgacttctctctgattggttttagagaataagaaacatgcagttgaaagtcagagtactttaaagcaagaggcatctgtccaaagactggttgatgaaatctggggaaagggagggaaatacaaagaatactgtggctgccctataagggaacaggaattcaaggcagtatccaaagttagaggtaaaggagcgggcagaatggtgctctggtgcggtaagcaattcttaagatggacttaaggtaaccaccacttggcatacatgtcctttataattcccatctgtttcagtgtgggcatgacttgtgaatatgaagaaattttattcctgtgattaagttactgatcattttattttgagttaatcaaaggggagattatcctgagtggatcttgcctaatcaagtgagctcttagacaagtggccacagcagatgttctcatgttggccttgaggaagcaaacagccatgttgtgagaggagggtactttgtggtaaggacatgagagtggctttctaggacctgagattgttccctgtccgacagcaagaaaacaggatttcactcttaagttgcaagtaattgaattctgccaacaaccagtgagcttgtagaagacctcaagcctcagatgagattgataccatgacttcagccctgtgagatcctgaacagaggactcagttaaactgtacctggactcct

SEQ ID NO: 6647 - DNA, 1086 bp, artificial
  synthetic oligonucleotide
tgtctctggtaagccagaattcgcgccgccgccgccgccgcgttgcaaaggctactgcgcacaacagcagctggggcgaaatgcaggcccctaatgcccccggtctccccgctgatgtgccaggctcagacgtcccccagggtcccagcgattcccagatcctccagggcctctgcgcctctgagggcccaagcacctccgttctgcccacctccgctgagggcccaagcacctttgtgccgcccaccatctctgaggcctcaagcgcctccgggcagcccaccatctctgagggacctggcacctccgtgctgcccacccccagtgagggcctaagcacctccgggcctcccaccatctctaaggggctgtgcacctctgtgacgcttgccgcctctgagggccggaacacctccaggccgcccacttcctctgaggaacctagcacctccgtgccgcccaccgcctctgaggtaccgagcacctccctgccgcccacccctggtgagggaacgagcacctccgtgccgcccacagcctatgagggaccaagcacctccgtggtgcccacccctgatgagggaccaagcacctccgtgctgcctacacctggtgagggaccaggcacctccgtgccgctcgccgccactgagggcctgagcacctccgtgcaggccactcctgatgagggaccgagcacctccgtgccgcccaccgccactgagggcctaagcacccccgtgccacccacccgtgatgagggaccgagcacctccgtgccggccactcctggtgagggaccgagcacctccgtgctgcccgccgcctctgacggacaaagcatctccttggtgcccacccgcggtaagggatcaagcacctccgtgccccccaccgccaccgagggcctgagcacctccgtgcagcccactgctggtgagggatcgagcacctccgtgccgcccacccctggtgggggactgagcacctccgtgccgcccaccgccactgaggagttgagcacctccgtgccgcccactcccggtgagggaccaagcacttccgtactgccaatccccggtgagg

SEQ ID NO: 6648 - DNA, 1363 bp, artificial
  synthetic oligonucleotide
ctgatattccttcatttcctctagcacattcatcaatgtccctcacactctgttcttactccatatatgtgaacggcaggtattagtagttccactttaaagggaagaagctgaaatacagagaggtgatggctgacttgcctaaagccaaaatgcaagttgatggcagatccaggacctaaacccacttctcctgcaacctagccagctagagtctctgtccaaggaaatctgcttcttcatcagaagatgacttcttcctattggaagccaatcaattaaagaaatacaaccagctgcaagcagggatccacccagcagggtcctgttccatgagcccctcttccctacctccgaccccaaccacagagatccaattcaaggccagaaaaatgtaagcaccacccaggcttggagagggtggcagtacagaatctggtcctctcctcctttttccctccaaatccctggagcttgagccttggaagaaccatgcactgcagggagggggccgccccatgacagctgcaagcaggttattccagagaatgttgagatggcaggaatattttccagttgaaatcaactcaattccctttgcatttgagtcttgggaacattcatgatgaaaatctagacagcatgacattgtatgaactctgaaaggcaggctgatgctactctggttggtgttgcctttggctcacactgaagacacagtcagagtcctagaaaagatcagccaaagcagcttaagccaaagaccctgtgccatccatattttaaaagctatctgtgtgtagtgctgacctggtctctgagttaatgactgactttttatactgcccaaggaagatctgggattgtgagcctcaccacttagagtagcccaggaaggggggccccttggttgcacccttgctccagagacccaacacaaaggggaaaattgtaaaaaggaaactgcagactaaggtgacacattctcacctagagtatcactggcatcagacagggggagggcacaaggatgtgggcaggcagggccaagggttttttcaccaaggtcaagggaggcaatatgatattgaggcaaaggacctggactggaaataaagagaaatcttgcctcctgactttttccttccatgccctgtcagaaatctgagacaacttttggtatgctcataaaaatgaccaccacaaccccaacaacacaaaagggtgcatggaatattgcctggaaggcagaagaagtgagctgtgccactcactgggctgcatgacagtttacttagctgaccctggtattcagtttcattccattaaattatgagtataagtcttgcccacctcacaatgc

SEQ ID NO: 6649 - DNA, 2853 bp, artificial
  synthetic oligonucleotide
gagcaagggggtagttctgggagctggactctaagccttgaatgaaagcaggtggagctgagacaggggtgggagctctcgcctaggaggccgggaccgtggctgcagcgcgggccgagcctcgaaggcagcagggctgtggcagctgatttcctggaacaggatcctgcatgggccgtgggcatgtgaggcggtcggccggcacacaaatcgcttttggcccgtgggtaccaggcagctgtggcctccgcctgccttggggtcgctctgtccagggtaggagacaatccaggcagcctggcacgaattgggaatctaggaaaacctcgcggtgtccaccgtgtaagggcacaagtcctggggcagcttttgccggaaactacctctggactccttgcctcagtgaggaaaccgtcctgggcccactcccagtcccagaaacagttgtctcttgggcccaaagcaggaaacgttcaacctccatccaggattgtctgtttgcctgccactatacaaactgttcaacacagctgcctgtctcacatatagaactaattacacaattaatataagccttgatctgagacaaagatcattaggtttctaagcaaatgtgttcgctcctcggtaatttgccatttttattttcaatttccaattctatactaagacatcatggggggttctgtgacagctacctttgcccctccgcatcctccaatgtcctctgcttcctcccaaggaccctataatccaagaaagacaccttttccccaagccagtaagatgttctgcctacactcagacatgacacccttcccttctttttcccaccctccttcttgccaacatctgccccaaaccccccaaacctctccatcctcctattctccatgccttgctagagctgcatctggagtgcacagcaaaaaggggaacataggggccagtgcggggtaaggccaagcctagcaaacaacttaggggcagggttggtcttccttgctgggaacaggcagaaaccctaatgaggtctatggtatcttggaaaaatgcactcaaacatagctagagtacagtaggttgggaggggtaatggaggggtgcaggtgtctgtataaacttgcagcaggtcctcaaaagggtgataaggtggagtgggaggagagggagtgttaacttggctcctttccctttcattgcttgtgattttgcagtccccttttgttcctcttcttaaggaataggactcccacactggcctcagaggcttcctgaaatggcataaagataccagagtaactcattgccgatatgtaaccaaaaaaaaagatcatgaaatgatggagagatgtggggtgggggtagcgaaagtggaaaaattatgagcacacctcccagcagctccaaatatttttctgattttgtgcctaagctgagcccagtaacctacaaggtcaacataaatcagtaataggctcttgggataagtggtctttaattacctccctaaagacacatcttgatttcttttcatttcccaggtctgctaagggtgttaagtttaaggagaaaccaaaggaaataagattggcaggaggaagggacattttcactgctgcttaactgactgcttcatttttggttttgcctttgaaaaagaaaacaacactggctaagagcacctctgcatcaccttttccttttcctccttccctgacttcctgtcactttcctgcacttcctgtaaagaaaatgataactggccaaagctgtctctttgtaaccttccctgccaactttaaaacacatactctttctcagtttagcttttggcacagaaagaggtggcgttcaagtttgctaactctttcctccctccacatttgagttaatcagccagggtattcaataaattgaaactttaacattccataagtgctttagcagtcaacattccagcagggtaaagtaggccagacttaagatataaaatattatagatttctgctaggggggaagaggtagtctccaaaagccatgtgaagtaaatagctatttgttgtaattggagagcagggcccccaaggattaccctggaatccatgtgttcagaacaagtcaggctaagcccaagagcagtcccgactccaaataataacctgttggcacagcatatgctctccgctctccatctgcaatcagtagccaggagtatttcaatcaccgcctggctggtagcatttatatgaagttcacaaggatactgacattccgaggggcacctgtggactggcagagcagagcttgggagccaaactgaaggagagtcctcccaccaggtgggatggagtgggctcatgcagctgccttggttcttgagtgatctggttctcatttggcaagatgccaaagcagcactgtctcggccccaaaggtctgacaggatggctgaaggattcaggcaagttatggaactagattaaatgacacattagacagtcatctagctaggttctgaagcagtggggcccagaacagatcagttttgactgagggcctggggagagaggtataagaagtgtctggaaattgtcaagaaaagggcagagcctgatgtgggcaggtcaagatgaggcagagtagagagaggtcctgggccttgaaggggtaagagtactgaggacaaactttgtctacttaatacttcacctcaacactttgctgttaacacccctgtccagctgtagctgggaaaatatgaaaatggcttattttctctcccccttcatgctggctgggattcaggagaaggtttaggaatatctcttccatcatcatgtgccactgggt

SEQ ID NO: 6650 - DNA, 1877 bp, artificial
  synthetic oligonucleotide
acttatttcttcatacagacaagtatacagatgaaaacaaatgaactataatcctatcacacagataactcctgttgacataaaaaattaaaatagaagttatacatatttgtggtaggacaattcagatagttcagagaattacataatgaaaattgtaaacctcattccctgcccccttccataattcctctctccaaagtttaacaactgttaacctattaacagtcttttaaaatgacagctttattgagatataattcatatactataaagttcacctttttaaagtgtacaattcaataattttagtatagtcataaaggtgtgcatctgttaaccgtttttaatgcatatagccacatatacgtatttatcatcttttaaactttatacagaaaggtcatacaatgatcaatctttgttaccttgcttttttattttattaagtgaattttcctgtcaggaaatgcagatctgcctcattgtttttaatggctgtattatactctatagtgtgagtgtttgtttttttttgacttttgcagtatatactcaacatccttatcagtttttgcaagtctgtctctacattaaatgcctatcaatgcaattgctaagtcaaaggatgcatgcagttaaattttgatgaatgctaccaatacccatatgatgaatattaccaatatacatgaggggttataccaatttatacctgcaccaaaagttatgagtgctcatttccccacattcttaccaacgctttatttttattttctcaatttaataggtgaaaaaatatttacttgatggtttgctttgcatttccttaattatgaataaggttgagcatctttttatatatgtattgaccatttgaatttcttttcctctaacctgtttgtatctatgacctatttttccacagagttgtttgtctttttcttattcatttgcatgagttctttatgaattgtctcacattaattttacacttaaaacgtggcagtttctaccattggtgttgccatttatttatttgttctttctcttttacctattacctattactgacctggcttccttacacccaaatcaaacagcagagaggatgaagctataaaaagctaggaaacaatgagggcccccagaacttttcggcttgctaaagatgtagactatagagcagatggagagcctccggtaactaaaggccctatactttgttactctttgccctgtactgagtagaaaacctgacttgactatggagttaaaaatttaatttgtaattatctactggaaagagcagagaatactgataagctttccatgttttctataaattttagagagtgggattaaaacaaagatttttttttattattgtttttgagacagagtctcactctgtcacccaggctggagtgcaatagcgcaatctcaactcactgcaacttccgtctcctgagttcaagtgattctcctacctcagcctccctagtagctgagattacaggtgtgcaccaccacacctggctaaatttttttgcacttttagtagagacagggtttcaccattttggccagcctggtccctctgcccacctcggcttcccagccggcttcttcagctgggattacaggcatgagccactgtgcctggtcaaaacaaagactttgaggctcttctgtaactttgaatgttatgtttgatgctctattcctttgtccttatcaaaatccactgtcaagtaggcaatatgtgacaattttattataaacatttagaattaactaggggtttttatcttgctaatgaatgaccttgcattatcagaacagtagaggaaatccttttgtttctgtttgttagg

SEQ ID NO: 6651 - DNA, 2937 bp, artificial
  synthetic oligonucleotide
aatttttgcatcatccagaattgtagtcacataacctataagaacaaaacaatcttttcttaaacatatgaagacagcttaatatttatggctacttgtcttaataaaactttccactaatttgtagacggtttataaattttgtgggtttttgtagagacagggtctcgctatgttgcccaggaaactcctggcctccccgcgacagcctcccgaagtgctgagattacaggtgtaagctactgtgctcagcctaaatgctgattttaataagtaattgtcctgtctatatgatcagttttaaacagatatcacagtgtgaatactactgtcccctagcttgagctcctttcgttctttaggctgaattctatgatactgttaacataatttggttgaaaatgttcttacaaggctgggtgcggtggctcacgcctgtaatcccaacactttgggaggccgagatggggggatcacttgagtcagtagttcgaggccagcctgggcaatatggcgaaactccctttctactaataatacaacacttagccgggcgtggtggcaagtgcctgtagtcccagctcgggaggctgaggcacaagaatcgcttgaacccaggaggcggaggccgcagtgagccaagatcgcgccactgccttctagcctgggcaacagcgagtccctgtctcaaaaaagaaaataaaagaaaatgttcttacaataaaaatatcttttcaagttcacaagttaggcaagtttttggtgtttcattaacttacggaaagcaaattccaacatttgatttataacccttggttcatactctgtgattcccatatccttcaggatctgtgccatcacctgtggattcaaataaaaacaccagatgcagaatttggtactggaaatcaaggctgcactgaagggtagtatttatatttatgatacaaggttccccttctttgggctccaaagtcctactcacccttgccctcccaagtgagtcagtgatcacacgaaatcgcatagtacgcttttgcagaaaacttttatttttattttttggcggggttgggggcggggtgtggggcaaagagaagacagaatttggcttctccagcagaggtaagtagctccagctggttgtcatttttggctgtggcggcgggttaaggtagcatcagaaccctggacgcggagtcagggctggcagatagctagagacgagggggaggcaggggcccgaagcccaggacacaaagctgggcagccgttccgcaagctccactggaccgcgaccctctggcaagacttggcccaagcggcgagataggggcccgggggccagggcgcatccccatcaccctctcctcctgacggccctgactagactgaaacgagcgtgcgagccgaccctcaggccctcagcgtggccccgcctcgcaggtccctggctgcacctggcttcgcgatccgcggcttatccttcgcacttaccaaggcatctctcggagcgttcttgggaggcgccatcttgcccgactccatgttatccagccactcgtcatccgcggagacagaggagagaggagagctcgcgggctcctcgctcaggctccacccctgcggggagcgggaggagggaaacggaaggcggggttacgtgccagccgccgggggcgggagtttcagcaagccgctggccaggggaagagacgcgctggggtgcccgagttcagtattggaagaggcaggtaatccttccccatggagcctgctggggcctgaaagaagtagaggggccgagaagctcgacttcccagagttgtttcccggcaaagggcaccaagtgggccaacctcacctttgcgggggtccctcctcacacctccacggctaccacctttgcccctttcggcctcccggaattccagacccagtcggtgttagggctgcttggtccaacacagttggacccgttacgtttgaatgtcacatcaacaaggaatacatttttagtataagtatatcccagatttgcacaggccatacttatgctacgaaataattgttctgatattcatatttaaccgggtgtcctggatttttattagctaaatctgacaatcctacccaatagcttgctctccccacagcaagactttggtcagcccttgtcacactcaaagccctaccgtggctgcccatttcacactgatgaaaaactaaagccttcactcggcccgttagagaccctctagcctctcttggccctggagcagcttcctgtctccccgctgaggccaacacaggacccttccttgcctcccagttacacccttcccagcccctcacccacagaacagcccgaatgacttttcgtgagaacctaccatccagccccagtgactttcaaaaaatgtgcatcagttaactatctctggcttaaaatgtcgcagataactcattcttaccctccacatccaccaacgccctaggattctccctcaggaacaggaaccgtgactcacccaggccagaaacggagcaggcagccatgttggcgctttccctcacaatccacactcaacctagcaacaagtcttgtccgggtgacctcccaaagttctatccatgtctccacatctccatccagtgctactatgctaacgagtccaagccaacatccttaccaagattacagaaatatgctccccaaatagtgtccccccacattccttacacagctagacggacctttcagtcataaatccaatcattattttccttaaaaccctccagtggctctcctcacaaacacttacacaaatacatactaatttcccaggcttagcgggtccttcagttttgtggcgcagctcacctcatcagactcatcagaatcagcagtccacctggccgccatcttgaagtttg

SEQ ID NO: 6652 - DNA, 759 bp, artificial
  synthetic oligonucleotide
gttggcaccgaaatagctgtggcagagagggtgtttcctgtggttcttctttgtgctcccctacctgtttctttcattagctaattttctgttcttgagcaatggggaaggcagtgattcacccattcccaaatgggtctttgccttgtacagctggatcaatttacaccacatttgctataaatgacatcagactccttgtctccttgcttcatctctttatcttttctcttcccatccatccatcttcattacatatctactctcacattctctttcactttaggaaaggttgaagtgcccagaatgatacctgtctgctgctgtctctctactcttgctcattttcccagactccttcagttcttactttcttattgaggtaaggaagaccaaatagggagtggtgagggagaggggggataacatgtagttggatgggaaatctgtctcaatgaagtaagacttgggtagcaagataaagaattttcagtcacaacagcgttcacacgtaagtgacaggattcatagcttatgtggactcagagctgaaagaggtaatgaaaaatcatcatctggttcagactttatattaaattgaatttgtgagggtatgacatgtctgattcatcattgtgtcctcagctgttagctcattgccttgtttggtttgttgaataaataaatctagtccaaccctttcatattatagatgaaaaagcaggctagaaagaggctctctcaagatgccattatttt

SEQ ID NO: 6653 - DNA, 1076 bp, artificial
  synthetic oligonucleotide
tggaactttgtaatccctatacgagataaacaaggaaattgagaaaggaaaagtcacagtctggaaatattttgcaggcctgtctatgaggcctaatgcaaaggttaattcaagagcattcttttcttttcttttcagtttgttacctttccatagaaatgagagccccctgctgttctctgccatcagctgctttgttctgctaatcagggaatgaagctgagaatgccccttggctctgggagagggagaaaagaacaggtgccagagctcatgtattgaaatagatcaagggtctgttcatcactcaatcattctccagtgtaagatactcaagaacaaacaagtccactgtgagtcagaatctgccaacagtctttttcctagtagtttgaggatactaagtagtttggctaagtatgagttgctgtaccctaggtattatactgttagggaaattccccactgtctgccaaacatttcaactcagcaaaaattagatctgaaaaatgttgatgagccataataagttgtacatagtgccttttaagaaatgaactactaaatatattctaagcaaagaagcagttctggaagaataatggctgaacttcaaattttagggttctcacctgcttgttgcctcaggcctagccccttttcctcaactcattgcaaattcatacttaatcttctcttctgccctagtgaaaatatattttaaccgggagtccataaatgtgggtgctaggtctggctttatcactagttgtcagttttcccatctgaaaagtgaatgcctagctcacagtgtgcagttgttgtggatgttggattttttgagaaagctgcatgtgaaggttaatgggctgcacagatacaaggtagttatattattacttaaactccattgtggagactaggaacatttggaaattgcctttacttgaatgttcagtctgaataaaatttgcctctggattaaaagtcctcagcctcagggaaagacctactctagtttagtgtctgtttttgtgtgttctctccctgttccagtccctctccttctccctctc

SEQ ID NO: 6654 - DNA, 1991 bp, artificial
  synthetic oligonucleotide
aaatgttgtctcctcctctgcagtcctgcggcaaagacaggcacacaggctttctctgtggattaattggtcaggaaagacactttttatattgtcaagtggcacttaagccattaattcttgactgtgaaactgcttttcctgggcaatgctctttaaggaaaaacttattcagtccagtgactggtgactaagggaacgatggagcacagggaattgggcgggatctagactcctaataatgcctccttagccaatgaaaagcatttcctattgagacccccaagagttcccctggccgtcggctccagctcggacttcaggcctttttgtgtcctgtttgctaaaggcatgcgggctacagcattcaagagagggagtcgttaacaaagggaaagagataaatgtaaataagctcacatttacagaatgagcggtttgcagtaaaaagctgcggcagcccagagtctgctactttaggctgggctaacctttccctgtaaaaaaaaaaaaaaaaaaaaaaaaaaaaaaatggataaaaatatgcacttccaaagggcgagttgcccatttacatgtttattagctaattatctacaggcatcagcacattctctcatctagcacactctttcttggggtaagtttctcttttaaaaagatttgattttggcgtttgggggtgggggatagcataacaaactacagtggaaacactgatgctttgagagtgtaaggaaagaagttagacttcaactctgaagtactgaacaaggatcttcgtgatgaatggtaaaaaacgagaatttccattgttttggcaataatattgtttccgtggaagacatacaggattttcaggctgctgtttcatgtaaacacagttgttctaaagagctaatttaaaatcacagtgtagaacaatttagaaagtatgtcgactagctttgtatttctttggtttacagtttattgtgcgctaacgtggcttgtattatgatgaggtttcttctagtaaaactatacatgacatgtctttgatgcttaattgatttatggagaatgtgacatttgctatattgaataattcatgaacttgcccataaaggaagaatcatgtttgaatgaaaaactctgtcataaactgaatttgcaattatatgtgaaattaattgctgtttgccatacaaatgcatcaatgtgtcatctttaaactctcttcttgtaaattttaaatattttcagtaaaaaggtcttattgagttgctaaatacagtatttcagttaccttttaaaaggaaattcagcaatgtaatttatcattatttcagtgtggaaaagaccagacaaattcaaaggttagaatatttcagagcttggtggggttattcactttgctaccttacaaaattataccatctttctttatcttgactaacataaagacaataataataacctgagatccagattacccaatggctttgcaacacgtttatttttcagaacaaaattcccaacatcatatcccatcaacatagattataaaaccttttgccttgtcacagatgaaaagttgcactcttgccaagaaggatgagttcacctgataaacttgatggcatctacattctaaagtctctcctgccaatcagagatgggaatgaaagccttattggaacaatcaggccagtctttcagaatgtgtgctctctgcaagttaaagggagaaccaggaagatgcctcacagaaacattcaggccaagcttagctaaagcttgatctattcaattgccttttgggaaaatgcagtgagaattgttgcccttgctgtggtttgttcagcgcctaattgtgtagctaccttttgtctgtgtatatggtcatcacatatagtctgcccttggccttcttgttgggggaagaacaaaacctgtaatgtgtttgcgaatattagtactgaaaattgggagcccaataaaaggttacc

SEQ ID NO: 6655 - DNA, 1613 bp, artificial
  synthetic oligonucleotide
taaaaagctggataagcacattaacatttcaaattgtgtgtacaatcaacttttactacatggattctcatttaactcaaaggactttttatatctccactttgaacacagaagttaaaactatatagagaacaagacaagtcaggacagatctgcaagcgccaacactttccagatttcatagaacacgaagacaatactattgccctttaaaattgagattatactgaggagtagtatacgaaccctgaaaacatagtaggtgtttaaaagaagtagaaataggactaaataaataatggataacattttggggaagagcttccccagttcctgtcaaagctagtagtttaaattacaacactggacctgcttcagatctctaaatagagggaaggggatgttgttcaacaagaaaaaaatttaaaaataattgaaaagtatcctcaaatttatttttacaagagaagagtgttttctttaggaaataccactctaaaaatatacaaggctcttgcagtaaaagggcacagtgaacacccaacactggcattaagatccacctcaattttgacagcttctttatctaatgtttaaagccacctatgaccagagagaaacggaaaatattcgcgcgctcaagcagaccacttgccccaacccatactgcttggagttaaaagtgccctttgctgctcaccccacctccacgaacactcagagatcatagaaagatttagtcttagaacttcatccacaccaaaaggaaagaaagaaatgttaaatctcccggtcttgctcacccccctgtgtcccctctgtccctggggagactatgcgcgcccctggaggtggggactgggcgacatgcccctccttgatccccaggtccctacacgttacccaagagacaatgacaaggagtcccagggcatctcctcaaactctctctgacctccctccaggacagctggtgtgagctggaacagacagaacatggcacgacacgcgggaatgcagagtgacagagggtgcggtaagcagaaggtgccgcaaggagacagaaccgaggcgaccgggtaaaccccagagacagcgtaagaggagcaagaggggccctcccagggaagctacattttctcctctgctaccagccttctttctttcgcccacccctcccccatcccgccctgggacagctaccttgccggtcagtatctgagttctgaccgtgcggctcaggagggcctccacgtcttgccgcgcctcctccttttgcacggcggtaggggtattgaaggcgattttcaccatagtgaatcttcgggctgcgcggtaaggcgctgctggaatcagcgtcctgggctgcagactgcaagaggagatcctgttagcccaaacagcacttactttatcttcagtctaacactactgcaagccgaggtctgggatacttatgacgcagtcccaaactggggggagaccgtgggcgggcccagggaggtgcctaaagggaggagcgagagggggcccaaaaggggcccaagtgcctgagttgggggtttgcgaggtggcgcggatttgccactgggggaagagcaggggaagtggag

SEQ ID NO: 6656 - DNA, 1632 bp, artificial
  synthetic oligonucleotide
aggaagggagggagaaaagaacaaataaattcctgttgaagcatagtttctgctggaatcttcaaaaaataaagagacaaaataaaaaatttattacatgatcatttatcacctaggtacataaaactataagaaactcttatagtaaaatatgattattgcttatatctgtttacttgttccttgtagtggcttgttttattttattattttacatgtgtgctaaagtttctccagttaagtcttcatttgcttgtgagtgaatttgtagaacataatcacactcctcaattagaacagactttatacaaacagtattattttttccttgttgtgggtaaattgtaatttaatgcaaaaggctctgctgttttacattttccagagctttcattcattcttgcttagtaattacaaatggcttgtaaataaacacttgcaatgattttcaaaatgttctgtatttacttatgagtctagtatttctatcactgtatcacttaagaggttttgatatattgtatacaggttcattttacaatgtatttgaagtttgtaattctgcttaaatatgaaaaagtagaaagaattaacaaactgctgcttgcaggccaagagaagacagagctaagggaaatcaagacagaatctatcagaaacatgaaatcaattgacaaaaggtggaagactgtcaaccaaaataatatgttatggaccctcaaggctttctgtttatgctagaggaagcctaaaataatctgtggtttttgatgcttgatttagttttctacaagcctaattaacaacagattaagcttgctgccactatagtttattactgagagtgatacatacttgctgtttatttttctctggtacagaaagactggtggcagtaatcttaagaaagtcaatttctaatgaacaaaatatttcttggaaacaactcagttatatcatgttctatcggggcataactgttttggttggttataaaatgcaactaaaaacatcccctgttacaggatgaaactcctttgctttactacaattgaatgtgatgtaaacttttttgaattcatagccaagggtcagtaatctcttctttatggagaatgcatggggaagtttaattcaggtgtctgtgttcagaacaattctgtatgtgcattgtgatactccctccttaccaacttccacttattttaggtttcacttttccaaaactagaaaggactctttaattccatctccaaagtttttgatatagattacaattcaaggtcacgttggaatcatagtactgttttgctttgctttggatctttctattctaagcaagattttacagggaaacaataaaacagaagatatttgtttacacatgcaaacagactggcagccagatttttgtcttatttcctgaatgctctcttttgacttcaaagagagcttgatttacataaaattatgcagggggtaaagctggataagaaatcagtataaaagaacagaatacgttattcatagaataagatatgacatatgccaggagtccactcttagctgccaaccttaataaagagataaaagcttgaatagtaaaaatttaaaacgaattattgtatgcta

SEQ ID NO: 6657 - DNA, 1989 bp, artificial
  synthetic oligonucleotide
tacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggtaagatgaggactctccagttttatgctctggtactcctctgtcccttttccccaactccctgacatacagtagaaagccatagcccctcaattgatagggctcggacttacctggccccatgtaagtggctcattcttcctttcctgtacactgtgactccaataactcacttccccgtctcctgcctgtgtagtataagacaaaaatcagactttggtcttagactgtggccagacctctcagttaaggcctctaagataaccatggacagtatcccatgtcacagttcctcgcgcccgctagacctggcccaggttattttgaggtgagccattcccatagccaccttttggcatgggacagccacttcactgcagctggttattttgtgagtctaactaatttcagccttccacaaatctgcctcacagaaagtacccttgaaaaggaggttgggacacagctttttctctcatactttctcttctatagctttttattatggttggggagggacatgaacaaagccttgtggtaataatattctgctccacttagaaattccgtacttgttcggtcaagtatgcaaccaacaatctttcctcatgtagcaaatgctattccttgctattttgaaaagggaagggtattgtgagtcccttcactttttactggagtcagcatttgtccagaaacactccctcttccaaacatttctaaaagctcttgggtcagtccttattttctttcttacaggcggatgttc

SEQ ID NO: 6658 - DNA, 1339 bp, artificial
  synthetic oligonucleotide
agagaagcaaatagatgatattgtagggaacagaagcttaaagacaagagaagtgggttttagtggtggtcacaggtgacctgaaaaactatccaattcataatttggaagtgacaaataaacataaggagacaagatgagaagctgaatgtaggatttaaatgaatagaataaaatgaaaaaaaaagtcttggaaaattagaaaaaataaatctacatgtttactatttctcaaagtgctaatatttgatctttattttaataacaaatatcacgtttggtgattataatagatagttatcggaaatatatatatatatatagagagagagagagagagagagagttatcaaaaagattgtttctctaaaaatctttgattttaacagaatatccaagacatataatttctctttgacaggaaaccttttcaaaacttgaataataaaaatgaagttttattattacttgagttgattgattattaaaagatgatatggtaggaaataataaaacatttgctattattacagatactttagggataattccaaattaggtttgagaattgtaggattcaaaaattcttcaatgtaagcatagtgctcagaaaactcatttttaataaacattttccttatctctatgattttactatccaagagctgtttgaaaaaaaactcttaagggaagaaaaagcaaaaagaacagacttatcagaagggcaggtgagggcaaggttaaaaacaaagcaaaacaaaaaaggctctcttaaaggactatactactctggactcctgtatcccattttactgaccatagaacctacacatttaattctagatatggcttttatttactgttactttcttactactcttcattctagattgattctcgagtctctaatccaaaatctgtcaaagtcatggttgttactactttacctggtaattggttggaacagagtgtagcatgctttgtaaatttctcaatttctctttgttttattacccacattctatgatttttgaatattttttctaaaatttgcaatagtatgtaccaaaattctcacctctagatcatagtttctcaagcagaactgtagacatttcggtctgtacaatgttttgaggagactgtcctgtgtagtgtaatacttagcagcatctctgacctctactgcccaaatgccaatagcaccttctttcccaagttttgacagcccaaaatgtctccagacattgccaaatatcctttgaaggacagaatcacccccagataaccatttatctagctatagaattatctaatgctgtctttacattaaaccaac

SEQ ID NO: 6659 - DNA, 2051 bp, artificial
  synthetic oligonucleotide
aatgtctaagatgaaaacaaaaaacaaaaccttttctttgataggaagaagcatcctagtttctcagattaaaaagtaatagtaataaaatattctatgacaaagaaacaagaaagacctaagagttacatgttacaatctctaaagctgaataggtaactccatatttctttcttctggttaatttttctctggtacataaattaaggcataaagcagcaagagtgcaattgattccaaacaacttggaattttattgtaaacatcccataaagaatggcaacaaattagtccagtttttttgtctttgaagataattgcttataatgactgataactgccaaacaaaacatcttttataaatcaagccagtttatattaccttttttactgaattttagtttaacggacattttgcccatatacaatatcatatcaactatgaactgattttccatcttaaaatgtatggataccaagaacaaaaaaaaggtacagttatgttaatactgtgtaagacattacaaaagacaagaatgataagttacaggacaaagaaataaattactgattgccatcaccacagtattgtttaagaattaacatttgtagtactgcctaatgtgtatctggtgacatatgcaaaaacacatttcccaactggatttctaaatatttttgcatatcattttaaaattcaattaccaatggtggtttcattatgtatcaatagtcttattttttaagaaaatacttatcatgcttttatatgtcaaagtctcacattctagatttaatttagaagaaatgggcatacatgtaaataaacaaacacaacttaattctaaactgcagggcctttctactgtacttctcccatcaatgaatcaaaaattgccaatcttaagtgtggtaaattaggtgcagttttcatggcagaaagaaaagtgaggataaaagtaagcaggattgaaaagatgaaaaaagaaataatcaagaataagggtatataggccgggcacggtggctcatgcctgtaatcccagcactttgggaggccgaggtgaggaaggaaggaaggagggaaggaagagagggagggagggaggggggagggaggaatgaaggaatgaaggaagaaggaaggagaaaagaaaaaagaaagaaacctgagtgctacccatattccacaaaatatagcaccgtgaaaaaacttaattttatattgcaatttaatcaaaacttggtaaagaagctttgctaaaagatgagaaacaaaaaagcatgaaaatactttcacactagtttttgaaataagccataaaagtgactttagaatattctatttctgataaacctttcataaagcctcacgttccacaaaaatattggggatggggttagcatttaaaacaatggactttacatgtcgaaagttccatcccttcccctagaactattcatcacagaactcaaaatgttactgtaattgtttaaaaggctggacagcaaagtatactgaaaattatatatgatgcaagtctcccttttatggatgtgaaaattccaacttgaagataagtaccagttggtaaatgtacataaaatgatttccaacatacatcagctgtaaaaggtgtttaattccccattaccacaaacatacaaatttttgaaaaatgctcaaaaaagttttatcaaaaagttagaagtggcatttatatctttctctctcaatcactctattattgtctgatgacaatctatgggattaaaacaaaaacaacaaaaagataaataacagaaacgtacttaaaagtattagaaggctgagttaaatatctgagcgcacagttgtgcagaatgagatttctaattttactcagttactttgttactttgcatctgcgggaaacaaagtattatagagaagaattccaacacaagcctgatttctggggagggaaaaaaaagaaaaaaaattaaaaagggaaataaaaagaatagagggacacaggtatatgacaaaacctggactggttatctagaag

SEQ ID NO: 6660 - DNA, 1998 bp, artificial
  synthetic oligonucleotide
cttattctatatgacatgcttatttaatataaaattattaattattcatgattactccattgacatttcaagaaataggtctcatataatatgcatttatattttcctatagaaaagagatctatttcagttaagtatctctctaagggataattttttaatatgaagagtcaagacccaagcaccactagtgctggtgaaacactgggtaatatgtagtagaaaataaaaagtagctcatgagatattggtactcctttctaataaaataaagctgttgagttacatttttacttaagttttctattttaacccaaatagtgctactctgaggtgaaattcctgctacatcaaatttcaaactaaaatatatttatgtgaaaggtcagagaaaatataaggaatatataagaaaatataaaaaaaattagtgatacatttttcttaggttttaagaaactataataatatctaattggtatatcatgttttctttattatgtaagtaacatttaactgcaataatatatttcatagtcagacacattttcatgaaaaaaataaaaaaaaacagcattggagatttaccattctggagattaacggtataaataatataaacatgcaaaatatctcatgccactgcaacacaatctagcatatgtgagtcactcatccctgggatgaattgttttccagtaaagatttgtgaattatcactttccaatattgttccaacctctattttggtttttgtttctatcataacctccagtcaaatacggctttgtgtaaattagaaacatagatgagtggggaaaatcaggaatacgagggtctgctgagtactacttccatttcattcagaagagactgatttatctttataaattttcagaaaggaaatcgagtaataatttcatgaaactaccaaaaatttagactttcaagcctgaaactttaaaatactttaatattttctatacagcatatagaaaataaaatccttactgaaatttccatcaactaagcattcttttaaaatattgagcacttgtcttgtttctaaatgttggaaaataaagtgttgatttctcgtcacttacatccactgtgtcaaatatgatgactggccacctgtctctgaataaaccctgtagctctattttatttttggtatatgccatctaagtacactttaaaagacgctggtattcagccagatttcaaaaatctgttttgctgttcatggccaattacaacatttacacataatactgtacttcaaataagagaaaagtaactcattcctactaatcatgctgtgattcttacctcctctgcatcagtactgtttcgttcttctgctttaattttattataagtatccagtatatcagtacagctctgatccctaagaaacaagtcatttcaaaagcttcagtaatttttacaatttttcaattaatttttttaaaattaattttttaaaaaccttaagttagactctctggaagctaaaactgcttcttacccaataaatcgaagtaagacatcagttacaattttagctgctttaactataggactgtctggctcattgaaagtcctggcattatgttcaatatagcgtacctcccacattaatgctgatattctcctgtgaaagaaaaaatactctgttagccttggctaatatatttaaagtatattttaggaatatacaatatggaacaaatatgtacttaaacacagtgtgtcaaaggtgttccaatatgcatataactcaatatatttgactgatgagcactaaaaagagatgatatagttacagtatttaaagcacaagcagggattctgaaccactggaatgtatatacaaaacttcaaatagaactgacctaggacattataggtaaagagtcatttgacaaggtcaaaagaatgtttagtttagttttcaggggaagagccaagaagagcaagaaaaaaaaacag

SEQ ID NO: 6661 - DNA, 608 bp, artificial
  synthetic oligonucleotide
tactcatcagtgaaagcaaacaaacccacccataattgtgccttgtcaaacaaatgattaaaaatattttaaaattggatgatgaacatgaatagaacattgactttttatgcacatttaagcaaatattttgtatgcataatcatgtgaaaagatgaaactgtttgaaaatgtttaatcctgtgagcatgtgtctcgtggaaaatctgtttattttcagaatacttatacatttattaggagcaacctttatctttgtttttccatttatctcctacataaacatttatgaaatgtttaagcaaatgatgtaagagagcaaaatagtgctattacacctgaataggtgccctctaggatgaatacattctaggtattaaagtatgttgcattgaaaggatatcacataataattaatcatttagtgtagataaagcagattatctacactagcaatgaacatgaaaaccgaaattaaaaatactgtttacattgattccaaagataaaaaaatagagtattaatatagtaaaatatatatataagatctgtgtgataaaaattacaaaatgctaatgaaagaaataatataaatggagaagcatatt

SEQ ID NO: 6662 - DNA, 2215 bp, artificial
  synthetic oligonucleotide
aaaaaaaatacatttccttggtgtgaaagtttttcttaaaacttcaaaaataaatcgtgtattgaatattttaggattccctaaattttaaaatgacgtttcacaatacatgggctgctttttgaaaagattacttacagcagacaacctggcagatcttctctttggctataagttaaaaacaaaaatctgttaagagaattatggatacaaaaagctagaattatttttattgaggtcaaaatatttggtgtaacaatacataaatattgtcattaagtaattgtgaatttggttagaaaatacaagagaaatataagttttgatttttccgtcctctgaacactttacatactaaggaaaaagtcccaaattaagcttaagcagctaggctaaattaacacagtagctagtaacaaggagcacatttagaaatgaaaatatagccttttcttgccaaatgacaaagcaattattttgcttaaaaggaagaagttctctccacatctgaacaagcacaataaggtcttaaattcgaagaagcttgcagtttttaatacttactatatatacatttttttcacactcagtatatttttattgtgcattaattagattaaaattaataatatgcattgaccaaaatattagattaacaaggccataaaggtaaactgagaggtttctttaatataattgtcgcacaacaatgattctcgctttgtaggacatatagaagatggcatactctaggagttagaacaatatatatttaatgcaataacaaaaactatatagtactttaagaaatgtttcacatatgtgaacagtcatttagagcctcaactttctaaagtaagcaacatgtaagcctgtaaagtacacacaccaaatcatagtctaacccacaaaacacccaaataaaatattagcacatctctattgtcaagaatatttccgtaccatcatttctataaaaaaaagtgaaaaagccttttcttttattctgaatggcaattttaaaaagtcctctcttctgaaattcggatatatatttttgagagatcccactggtataccatattggaactcatattgtacaaatataccaaccagcatctattttttagctgcttatgtcaagtttataaaacgagtggtttttcctaatagatgctaagactaaagaaactcacctcctgcctcatatcaccttgacctgcagcctacacagaggagaaaaccacacagaaataaggtcattgatataaacacataaatcagaaaatactgcctgcggattacaaatttcaatataattgcttattactttctcctgggttcctgctcaagtagacacgtgttgtttcttaggaaccatgctacatactgctgttttactaatgtgcaccaagatgcaagtgcatgcacaagacatacttttacacaattgatagttaatttcatccttttgtgtaaattgcatctcctaaaagcaaacctttgtaattttgaaatccacctgctttagataatgtaaaagccaaaaatgtgggggtgggtcaaatgaaggcggagcttcatgcaatttcgctttcttgccttatgtttgccatgcaattgtacctatcttatcctctccactgattctggactattttctccaagttttgcatgcaagaattacagcccccacagtgttttcttggggagacctctttgttacaaagtcaatgctttattctaagaaactggccgccgattttaaaacttcccgccactacctgctttaaggttgctgtcagctctggaaaacagcaagacctactgcacaagtatagaaaagcacagtggcgggaatctcaggaaggggggatggtgattagaaacagttgttttccatatctgagcagccctttagcctgagaattatcaagctattgcacgattcagacagccacagagcacgggggaatttcagtattattcctatgttttaggaataaggaaggcggagttgtttataggaataatccaaaaacaatcataatgtcttagcatagtgttatacggttttaccaagcaatgaaacagcgttcgatttcacttctaggggactaagaaaaaaacgccgagcgtgaacttgtttcctgtctgcgaggagccaggaattgtgaagtgagggtttgcagaagacctgtggagctcgaaaggc

SEQ ID NO: 6663 - DNA, 25417 bp, artificial
  synthetic oligonucleotide
ttaggcccttcatgatgagtttggacactatcatttgatttcatattgaacttgagtgttccaatgagttttggatataatatttggcttctttaattacttaattattttaaatttgtgatgagagcttcacatttcattattagatttatttcattaataagctttattgagatataatttacatgccatacactgaactcatttaaagtgtacagttcagtatgtttttgtgtatatccagaattgtgcaaccatcaccacaatagattttagaacatttaaaccacccactaaagaaatcccttgcccattggtagtcacttcacattctccccaactccctcccccaatgtatctgcagtttaacacatcgatacatttatgtggaaattaaattaaagggacacagaccagtcaaagtacccttggaaaataaaaataaagttgaaggactcagaattctcagtttcaaaactcattacaaagcatcattaagacagatagtggcatagggcgagacttgtggatcaatggaatagaactcagaatccacaaagacacaattacatttgtggtcacctgattttcaacaaaagttcaaagagaattccatagagcaaaaaatagtcttttcaacaaatgacactggaagagtgaaaaccagcatacaaacaaatgaaattgagtgaacttcttcacatcatacacacaaaaaatcaactcaaaatagatgacagacctaaatgtaagagtgaaaacaataaaactcttataataaaacataagagtaagtcttcatgactttgagttagcctatggtttcttaaatatgacaccaagagcacactcaataaaagaaaaacagataaattggacttcatcgattttaaatattttgtgctgcaagcaatatcatcagtaaagttaaaagacaacccatataatgtgaaaatatttacaagtaatatgtacaacaagggaattttatccagaatatataaagaactctcacatctcaataagaaaaagacaaacaacccaatttataaatggggaaaggatttgatatgactcagtaattccactcctagattcataacaaatagaaataaaagcttacatgcacataaaaacttatacacagatgtttgtataggcattatttattatagccaagtagaaagaacccaaatgtccaccaatggataaatgggtaagtaaaaggtagtgtatcagtacaactgaatatttttcagcagtagaaaggaataagatagtgatacatgctacctcaaaaacattatactaagtgaaagaacccagtaacaaagtgactacaaatgattttatttcatatatgtgaaatatccagatcaggcaaatcaatagagacaaaaaatatcttggtggttgcctggggctggcagggagggagaatttgggggaatgaagagtaactgctaatggatatgggatttatttctagagggaacaatattctaaaaataattgtagtgtgctatgttttggatgtgttttctccctgccataactcatgttgaaatttaatgccattgtaaccatgttgagaggtggggcctttaagtggtgattaggtcattaagatggattaccctctttctcaggagactgggttagtcctcatgaaactgaatcagttcctgcaaaaacaggttgtgttataaaacgggtcagcctcctttgtctcctctctcttagcacataaccaattccccttccacttttctgctaaactatgaagcagcacaaggctctcaccagatgcagccacctgatcttgaattttccagcctccagaactgtgagctaagtaaatttcttgtcttgataatgtactcagtctcaggtattttgttatagcaacagaaataaactaaggcagggtgaatgttgcataaccctgttatactaaaaacatcgaattttacactttaaatgagtgaattatatggtatctgtatgatttcttactaaagctgttaaaaataaatgtgggtaagtgcaataaattccctttttccttgtgagtttatagtttataaattatagttgatgattgaaacaaaaaatagcattatctgatgttaaaggcaatagtatttaaaaagtgggaaaggtaaagggaccttaatgtaagtatggtttccccactatactaaaagtggtaaaatgttgaaaccaggagactgtgataagtcacatatgtgtattgtaatacctacagcaacctctatgaaaactatacaaaatatgcactcaaaaacaaaaacactataaatgactcaagatagaattctaaaatatgttcaagtaaccaacaggaaggcaagaaaagagaaatagaggaatgagagccagaggaaacaaacggaaaacaaataataaaatggcagacttaagttctaacatatcaataataaccttaaatgtaaacagtctaaatacaggaatcaaaagacagagactggaaggaaacaaacaaacattacccaatgatatactgtttgcaagaaacacttgtcaacttcagtaacaggggtaggttaaacataaaagaatggaaaaagacacaccaagtaaatactaattttaaaaaggtaggaattaatacatagtatccaatcaacttcagggcaaataaattactagagatagagggactttaaataatgataaaaggatcaattcaccctgaagacataatgatcctaaatgtgcatggattaaacaatagtgccccaaaacaaataaatgaagcaaatgcatgaagcaaaatctgatagacccaaagggagaaatagtatgttgaagtccccagctatacttgtggatctgtatagttggggactttcacatattcttcatagcaactgatagaactactagatagaaagtcatcaaagatataaaggagctgaacaatacaataaaccaacaggatctaatttatatagatataacactccacatgagaacagcagaacacacatttttaagcattcattgaacattcatcaagatataccatacccagcatcataagacacctcaatacatataaaataattgaaatgatacagatatgttctctgacaataatgaaatcaaattagaaatcaataataaaacaaaacaggaaaatatccaaatacttcaaaattaaacaaaacacctttatatagcccatcagtcaaagagaaagtctctaaggaaaataacaataaaacaaacatatcaaaatataggagatacagctaaagcagtgctcagagagaagttcatagcatgaaatcattacattaaacaagaagcaagtctcaaattaatattctaatactttcaacaagctagaaaaaagaaaaaagacaaacacaaagcatgcagaaagattatgaaataatacagagaaagggagaaatcaatgaagtcgaaaacagaaaaacattggagaaaattgatacaattaaaagctgattctcaaacaaattataagcttgataaacctctagcaaggctgacaaaaacaaaaacagattgcacaagtaaccaatatggggaatgaaacaggagatagcactacagatcttgcagttaatgaaagggtaataagggaggaatatgaataactttacactcataaattttaccagttataagaaatggaccagtttcctaaaaatcacacactctaaaatctcaaccacgatgaataatccctgctactaaacacttaaaacataattaaaataaattctacatgatgccttccaaaaattcaaagatataacatttcctaattttacaaggccagtattaccctgctaccaaaaccagacaaagatagtataaaataagaaaaatacagaccaatatctatcaagaacttagaagtagaaatttttgataaaactttggcaaacctaatccaacaatgtataaaagaaattacatacaatgacaaagtgtgatttattccaggtatgcaagactggttgaacatttggctcaattaaagtaatccatcattttaatttttttatttttaattgtttgtgggtacatagtaggtgcaatatttatcaacaggtgaaagaagaaaaatcgtgatcatattaacatatatggaaggcacatttgacaaaattccacagatattgatgataaaaactctgagccagttagcaatagagagaaattacttcaacttgataaagaacatgtaaaaaatcctattgttaacatcatattaaatggtgaaagactgaatgctttccccctaaaactgggaaagatgtgtgctctcaccactctttcttaacactgtgcgggaagttttagtcagcacaataagacaagaaaaagaaataaaaggtatgcagttggaaggaaaggaataaaattgtccctatttgcagatgatatgattgtttacatagaaaatccattgaagtctataaaaaaacctctagaactaataagtgtgttcagtaagtttggaagatacgaaatcaacatacaaaagttaatttcacttctatatactatgaacaggtggaaaataaaattaaaagcacaatatcatttacaattgttagaaagaaaataaaatatttaggtatatacttaaaatatgtacaagttctatatgcttaaaattataaactactgatgaagaacataaaaaaagaaatggagagacatatcacgctcacagaatgaaaaactcagtatataaaagatgtcaattctctctgaattggtctatagatttaatgtaattcttattaaaatttcaagcttttgtagacatagacataaacatagacatattctaaaatttctatgaaaatgcacaggttctagaatagctaaagcaatttcaaaaagaagaacaaagcaggaagaatcacttcatatcatgttaaggtttactatagccacagtaatcaaagcagtgtggtttggcagaagaataggtgcataggcaactgacttttggtaaaggtgcaaacacaaatcaatgaagggtagtcttttcaataaatgatactagaacaactggatacccataggcaacgatgaaccttgaccttaacttacaccttatcttaaaaactaactcacaaagaggcagagtaagatggcagaatgggaagctccatcaattatcttccccgcaaggacagtaatttaacaactatctacacagaaaaaaaaaaacatcttcataagaagcaaaaatcaggtgagctgtcacagtacctggttttaactctgtattgctgaaagaggcgctgaagagatagtaaaagcagtctcgaatcgctaatactacccctctgccactaccccagcagaagctgcacagtgcagggagcaactccacactgcaggaggaagagtacagcaacagtgaggcactgaactcagtgctattccgttatagcagaaaggagaactgaaccaaactcagctgatgcctgtccacagagggagcatttaaaccagccctagtcagaggggaattgtggatcctagtggtcaagacttgatttcctgcaaacctcatcacggagggctccagcaacctatgtctgcaagtaaacttgaaagacagtctatgacataaggattgcaactcttaggcaagtcccagggctgaattgagcccagagacagtggactgggtagcttgcaacctactgagacaccagctggagcagtcaagggaatattggcatcagccctcccctaaccccaggctgcatagctggcagtcttaaaagagacctcttctttccgcatgaggagaggagaggaaagaatgaggaggactttgtcttgtatcttggataccagctcagtcacagcaggaaagggcaccagagttgtgaggtcactgtttcaggccctagttcccagataacatttccagacataccttgagccagaagggaacctgctgccttaaaaggaaggactcagggccgcgtgcggtgactcacgcctgtaatcccagcattttgggaggccgaggcgggcggatcacgaggtcaggagattgagaccatcctggctaacaaggtgaaaccccgtctctgctaaaaatacaaaaaattagccaggcatggtggcgggcgcctgtagtcccagctactcgggaggctgaggcaggagaatggcgtgaacccggaagggggagcttgcagtgaggcgagatcgcgccactgcactccagccttggcgacagagcgagactctgtctcaaaaaaaaaaaaaaaaaaaaaaaaagacagactcagtctgtcagcattcattacccactaactgaaaagccctttgtccctaaacaaccagtaacgattacctggtactacgtcaaggccttgggtgagcctctgagactttctgccttcaggtgagattcagcatatgaccagctctggtggatacagtgcaaaactccttctgcttgagaaaagcagatggaaaagtaaagggaattttgtcttgcaccttagttaccagcatggccacggggggatagtgcatcaagcagtcccctgggatccctgatttcaggacttgactcttagtcagcatctctggacttgccctgggtcagaggggagcccactgccctgaagggtgagtctcaggccaggcagcattcatcacaagctgactgaagagcccgtgggccttaagagaacatcagtggtagtctggcagaactccccatggcctgggatggtggtagctaccaggagaggctcctctgcctttgaaaaggagagggaagagtgggaaggactgcatcttatggtttgagtgccagttcagtcacagtataatagaataccaggtaggcttccatggtttttgaatctagtccctgactcccagatagcacctctggattcacccagtgcctgggggaagtcttcaccctgcagggaaggacacaggtctggctggccttgccatctgctgactgtagaaccctagggccttaaatgaacataggcagtagcaagggagtggttattgcaagctttgggagagacccagtgctgtgctggctacaagtctgacccagctcagttatagtggcagtggccacaagaatgcttatttcgctccatccccagcttcaagtgatgcaaaacagagagagagagagagagagagagagagaaagagagagagagagagactacttttgtttaggagaaagtaagggaagaaaacaagtgtctctgcctggtagcacagaatattctcccagttcttgcccaaggtcatcaaggaggtacttttactagttttcaggaaccaaagtgttagtgggctttggaagcatcccaaaacagatacagcttggaacacagcacccaagtacttttgaatatctggaaagccttccaaagaaggatgggtgcaaacaagcccagacaatgaagacaacaataaataccaaactcttcaatgcccagacactaaataacatctattagcatcaacagcacccaggaaaacatgacctccccaaatgaactaaataaggaatcagggaccaatcctggagaaacatatctatatgtgaactttaggacagagaattcaaaatagtagctgtgttgaggaagccaaagaaatttaagataacacagagaaggaattcagaattctatcagataaatttaacagactgaagtaattaaaaggtttccagcataaattctgaagctgagaaatgcaattggtatactgaagaacatatcaaagtcttttaatagcagaactgatcaaccagaagaaacaattagtgaatttgaggacagggtattcaaaattatacagtaagaggagacaaaggaaaaaaagaataaataaccaaaaagcacatcctcaggatctagaaaacagccccaaaagggcaaatctgagagttattgactttaaggaggaggcagagaaagagatagggggtagaaaattgattcaaagggataatatcatagaacttctgaaaccaagagaaaggtattaatatctaagcagaagaaggttatacaacaccaagcagatttaactcaaagaagactacctcaggcatttaatagtcaaactcccaaatacaaaggatgaagaaagaatcctaaaggcagcaagagaaaataaacagataacatatttaatacagtggagctccaataaatcttgcagcagatttttcagtggaaacctgacatgccaggagagattgacatgacatattcaaagtactgaaggaaaaaaaaacttttatcctagaatagcctatccagtaaaaatatcctttaagtatgaaggagaaataaagatttttccagaaaaacaaaagatgagtgatttcaacaccagacatgtcccacaagaaatgctaaagggagtacttcaatcagaaagaaaaggatgttaatgaacaataagtaatcacctgaaggtacatatctcactggtcatagtaagtaaacagaaacacacacaatattataacaccataactgtggtgtgtatactactcttgctaaatagaaagactaaatgatgaatcaataaaaaataatgactatgacaacttttcaagacatagacaatacaataagatgtaaatagaggcaacaataagctaaaaagcaagggaatgaagttaaggtgtaaagtttttattagtttttttaattgtttatttgttgatgcaaacaacattaagctattatcagcttaaagcgattggatattacatagtatttgcaagcctcatgataacttcaaacaaaaaaatacaatggatacacaaaaaataagaaacaagaaacttaattatatcagaagagaaaatcaccttcactaaaggaagacagaaaggagagaaagaaagaagagaacaccaagaaacaaccagaaaacaaataacaaaatggcagggtgagtctttacttatcaataataacactgaatatcaatggactaaactctcccatcaaaagacatggagtggctgaatgaatgaaaaaacaagaaccaggggacttgctggcaaggtggctgaataggaacagctcttgtctgcagttcccagcgagattgatgcagaaggcaggtgatttctgcatttccaacagaggtatccagttcatctcattgggactggttggacagtgaatgcagcccatgcagggtgagccaaagcagaatggggcattgcctcacccgggaaatgcaaggggtcaggggatttccctttcctagccaaagggagctgtgagagactgtacccggaacaacagtgcactccggcccagattctgtgcttttcgcatggtcttcacaactggcagatcaggagattccctctggtgcctggcttggtgggtcccactcccatggagcagagcaagctaagatccactggcttgaaattctcactgttagcagtctgaaatccacctgggatgctcaagcttggtggggggaggagcgtccaccattgctgaggcttgagtagacagttttaccctcaccatgtaaacaaagccacatggaagtttgaactgggcagagcccaccacagctcagcaaggctgctgtggccaggctgcctctctagatatttcctctcttggcaggtcatctctgaaaaaaaggcagccgcccaagtcagggacatatagataaaacccccttctccttgggacagagcacttgggggaaggaacagctgtgggcacagcttcaggagacttaaacgtccctgcatgacagctcttaaaagagcatctgatctcccagaacagtgtttgagctctgataagggacaggctgcctcctcaggtgggtccctaacccccgtgtatcctgactggaagacatcccccagtagaggccgacagacatctatacaggagagctctcactggcatctggcaggtggcctccaggacgaagcttccagaggaaggaacaggcagcaatctttgctgttctgcaacctccactggtgatacccaggcaaacagggtctggagtggacctccagcaaactccagcagacctgcagcagacgagtcggactgttagaaggaaaattaacaaacagaaaggaatagcatcaacatcaacaaaaaggatctacacacagaaaccccatttgaaagtcaccaacatcaaagaccaaaggtagataaatccacgaagatgaggaaaaaccagcacaaaaaggttgaaaatttcaaaacgcagaacacctctcctcctccaaaggcacaacgttttgccagtaagagaacaaaactggatggagaatgagtttgatgaattgacagaagcaggcttcagaaggtgggtaataacaaactcctttgagctaaaggagcatgttctaacccaatccaaggaagctaggaaccttgaaaaaaggttagatgaattgctaactagaataaccagtttagagaagaacataaatgacctgatggagctgaaaaacatagcacaagaacttcttgaagcatacaaaagtatcaattgccaaatcgatcaagtggaagaaatgataccagagatcaaagatcaactcaatgaaataaagcaaaaagacaagattagagaaaaaagagtgaaaagaaatgaacacagcctccaagaaatatgggactatatggaaaggccaaatctacgtttgattggtgcacctgaaagtgacggggagaatggaaccaagttggaaacactcttaaggatattatccgggagaacttccccaatctagaaagacaggtcaacattcaaattcaggaaatacagcgaacaacacaaacattttcctcaagaagagcaaccccagatacataatcatcagattcaccaaggttgaaatgaagaaaaaaatgttaatggcagccagaccttagagagaaaggtcaggttacccacaaggggaacccatcacactaacagcagatctctcagcagaaaccctaaaagccagaagagagtggggaccagtattcaacattcttaaagaaaagaattttcaacccagaatttcatatccagccacagtaagcttcataagtgaaagagaaataaaatcctttcagacaagcaaatgctgagatattgtcaccaccaggcctgccttacaaaagctctggaaggaagtactaaacatggaaaggaacaacgagtgccagccactgcaaaaacataccaaattgtaaagaccatcgacgctatgaagaaactgcatcaactaattggcaaaataaccagctagcatcataatgacaggatcaaattgacacataacaatattaaccttaaatgtaaatcagctaaatgggcaaattaaaagacacaggctgaagaattggttaaagagtcaagacccatctgtgtgctgtattcaggagacccatctcatgtgcaaagacaaacataggctcaaaataaagggatggaggaatatttacgaagcaaatggaaattaaaaaaaagcagaggttgcaatcctagtctctgataaaacagactttaaatcaacaaagatcaaaacagacaaagaggagcattatatagtggtaaagggataaatgcaacaagaagagctaactatcctaaatatatatgcacccaaaacaggagcacccagattgatagagcaagttctcagagacctacaaagagacttagactctcacacaatagtagtgagagactttaacaccccgctgtcaacaatagacagatcaatgagacagaaattaacaaggatatccaggatgtgaactcagctctggaccaagtggacctaaaagacatctacagaactctccaccacaaatcaacagaatacacattcttctcagcaccacatcacacttattctaaaattgaccacataattggaagtaaaacactcctcagcaaaggcaaaagaatgaaaatcataacagtctctcagaccacagtgaaatcaaattataactcaggattgagaaactcactcaaaactgcacaactacatggaaacggaacaaccagctcctgaatgactactgggtaaataatgaaatgagggcagaaataaagatgttctttaaaaccaaggggaacaaaggcacaatgtaccagaatctctgggacacatttaaagcagtgtgtagagggaaatttatagctccaaatgctcacaagagaaagaaagaaagatctaaaatcaacaccctaacatcacaactaaaagaacaaaagaaacaagagcaaacacattcaaaagctagcagaagacaagaaataactaacaccagagcagaactgatggagatagagacataaaaaacccttcaaaaaatcaatgaatcaaggagctagttttttgaaaagatcaacaaaatagatagactgctagtcagactaataaagaagaaaagagagaagaatcaaatagacacaataaaaaatgataaaggggatatcaccaccgatcccacagaaatacaagctaacatcagagaatactataaacacctctacgccaataagctaggaaatctagaagaaatggataagttccaggacacatacaccctcccaagactaaaccaggaagaagtcaaatccctgaatagaccaataacaagctcagaaattggggcagcaattcatagcctacaaaccaaaagaagtccaggaccagacggactcacagccaaattctactagaggtacaaagaggagctggtaccattccttctgaaactattccaaacaatagaaaaaaagggaatcctccctaactcatcttatgaggtcagcatcatcctgataccaaaacctgcagagacacagcaaaatagaaaattataggacagtacccttagtgaacatcaatgcaaaaatcctcaataaaatactggcaaaccaaatccagcagcatatcaaaaagcttatccaccatgatcaagttggcttcatccctgggaggcaaggatggctcaacataagcaaatcaataaacataatccatcacataaacagaaccaaagacaaaaaccacgtgattatttaaattgatacagaaaagatatttagcttcatgccaaaaacgctcaatatactaggtattgatggaacatttctaaaaataataagatctatttatgacaaacccacagccaatatcatactaagtgggcaaaaactagaagcattccctttgaaaaccggcacaagacaaggatgccctctctcaccactcctattccacatagtattggaagttctggctagggcaatcaggcaagagaaagaaataaaagatattcaattaggaaaaaaggaagtcaaattgtctctgtttgcagatgacaagattgtatatttagaaaaccccatcgtctcagcccaaaatctccttaagctgataagcaacttcagcaaagtctcaggatacaaaatcgatgtgcaaaaatcactagcattcctatacaccaataacagacaaacacagagccaaatcatgagtgaactcccattcacaattgctacaaagagaataaaatacctaggaatccaacttacaggggatgtgaaggacctgttcaaagagaactacaaaccactgctcaaggaaataagagaggacacaaacaaatggaaaaacattccatgctcatggataggaagaatcaatatcatgaaaatggccatactgcccaaagtaatttatagattcaatgctatccccatcaagctaccattgactttcttcactgaactggaaaaaattacttgaactttcatatggaaccaaaaaagaacctgcatagccaagacaatcctaagcaaaaagaacaaagctgtgtgcatcacgttacctgacttcaaactactactaggcaacagtaacaaaaacagcatggtactggtaccaaaacagatatatagaccaatggaacagaacagagtcctcagaaataacaccacacacctacaaccatctgatctttgacaaacatgacaaaaacaagcaattgggaaaggattctttatttaataaatggtgttgggagaactggctagccatatgcagaaagctgaaactggatcccttccttacgccttatacagaaattaattcaagatggattaaaggcttaaatgtaagacctaaaaccataaaaaccctagaagataacctaggcaataccattcaggacataggcatgggcaaagacttcatgactaaatcaccaaaagcaatggcaacaaaagccaaaattgacaaatgggatctaattaaaataaagaggttctgcacagcaaaagaagctaccattagagcgaacaggcagcctacagaatgggagaaaaattttgcaatctactcatctgacaaagggctaatatctagaatctacaaagaacttaaacaaatttacaagaaaaaaaaacaatcccatcaaaaaatgggcaaaggatatgaacagacacttctcaaaagacaaaatttatgcagccaacagacatgcaaaaatgcttatcatcactggtcatgagagaaatgcaaatcaaaaccacaatgagataccatttcatgccagttagaatgatgatcattaaaaagtgaggaaacaacagatgctggagaggatgtggagaaataggaacacttttacactgttggtgagagtgtaaattagttcaaccgttgtggaatccagtgtggcaattcctcaaggatctagaactagaaacaccatttgacccagcaatctcattactaggtatatacccaaaggattataaatcattctattataaagacacgtgcacttgtatgtttactgtagcactgttgtcaatagcaaagacttggaaccaacccaaatgtccaccaatggtagagtggattaaaaaaatgtggtgcatatacaccatggaattctatgcagccataaaaaaggatgagttcatgtcctttgcagggacatggatgaagctggaaaacatcattctcagcaaactaacacaagcacagaaaaccaaacactgcatgttctcactcataagagggagttgaacacatggacacagggagaggagcatcacacactaggccctgtcagggggtggggagcgctagggaagggatagcattaggagaaatatctaatgtagatgatggtttgacgggtgcagcaaagcaccatggcacatgtatacctatgtaactaatctacatgttttgcacatataccccagaacttgaagtataataataaaaaatacaagacccattgatctgttgcctgaaagaaatacaattcacctatgaagacacacatagcgtgaacataaagggatggaaatatatattccatgccaatggaaactgaaaaagcacaggagtagctatacttacatcagacagaatagatttcaagacaaaactataacaagagacaaagatggttactatataatcataaagtcaccaattcagcaagatgctttaacaatgttaaacatttatgcacccaacctggagcacctggatttataaagcaaatattactagggctaaagcaacagataggtccccatacagtcatagctgaagacctcaacaccccactctcagcattgtacagatcttccagacagaaaatcaaaaaagaaacattagacttaatctgcactatatagaccaaatgattctaacagatatttacagaacacttcattcatcggctgcagaatacacattcttttcctcagcacataaatgattctcaagaatagaccatatgttaggtcacaaaacaagttttaaaacgttttctaaaattgaaataatatcaagcatcctctctgaacacaatggaataaaattagaaatccataacataaggaattttgggaactgtaaaaacacatgtgctgggtgcggtggctcacacctgtaaccccagcactttgggaggccgaggcgggtggatcacctgaggtcaggagtttgagaccagcctagccaacatgatgaaaccccgtctctactaaaaatacaaaaaattagctgggcatggtggcggacacctgtaatctcagccactagggaggctgaggcaggagaatcgctttgaacccaggaggcggaggttgcagtgaactgagatcgtgccattgcactccagcctgggcactgagagtgaaactctgtcttgcaaaacaaaacaaaacaataacaaaaacaaaaacaaaacaaaatgaaaattaaaaatataaaagcagtaataaattattttgaaatgaagaaagcaaaacaaaagatcaatgaaacagaaagttgcttttttgaaaagttaaaccaaattgacgaacctatgggcagactaactgaaaaaaagagagaagattcaattaaatggaaaatgaaaaaggaggcattacaattgacactgtagaaattcgaaggatcattagtagctactatgagcaactatatgccaataaattggaaaatctagaagaaatgaacaaattcctagacaaatacaacctacaaaaattgaacaaggaagaaatccaaaccctgaacagaacaacaagtaacaaaattgaagccgtaagaaaaagtatcccagtaaagaaaagctgatggtttcagtgctgaattctatgaaaaatttaactaaatactaacaccaatcctattcaaactattctgataaattgaggcacaaggaatacttccaacctcattctacaaggctattattaccctgattcccaaaccagaaaaagtcacatcaaaaaaaagaaaagtagccagttttcccagcaccatttgttaaatagggaatcctttccccattgcttgtttttctcaggtttgtcaaagatcagatagttgtagatatgcgacattatttctgagggctctgttctgttccattgatctatatctctgtttttgtaccagtaccatgctgttttggttactgtagccttgtagtatagtttgaagtcaggtagcatgatgcctccagctttgttcttttggcttaggattgacttggcgatgtaggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctgttttatttcattgagcagtggtttgtagctctccttgaagagatccttcacgtcccttgtaagttggattcctaagtattttattctctttgaagcaattgtgaatgggagttcactcatgatttggctctctgtttgtctgttattggtgtataagaatgcttgtgatttttgtacattgattttatatcctgagactttgctgaagttgcttatcagcttaaggagattttgggctgagacaatggggttttctagatatacaatcatgtcgtctgcaaacagggacaatttgacttcctcttttcctaatttaataccttttaatatgtagaaagctgaaactggatcccttccttacaccttatacaaaaatcaattcaagatggattaaagacttaaacgttagacctaaaaacataaaaaccctagaagaaaacctaggcattaccattcaggacataggcatgggcaaggacttcacgtctaaaacaccaaaagcaatggcaacaaaagccaaaattcacaaatgggatctaattaaactaaagagcttctgcacagcaaaagaaactaccatcagagtggacaggcaagctacaaaatgggagaaaattttcacaaccgactcatctgacaaagggctaatattcagaatctacaatgaactcaaacaaatttacaagaaaaaaacaaacaaccccatcaaaaagtcggcaaaggatatgaacagacacttctcaaaagaggacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgatccctcagggatctagaactagaaataccatttgacctagccatcccattactcggtatatgcccaaaggactataaatcatgctgctttaaagacacatgcacacgtatgtttattgtggcactattcacaatagcaaagacttggaaccaacccaaatgtccaacaatgatagactgggttaagaaaatgtggcacatatacaccatggaatactatgcagccataaaaaatgatgagttcatgtcctttgtagggacatggatgaaattggaaatcatcattctcagtaaactatcgcaaaaacaaaaaaccaaacaccacatgttctcactcttagatgggaattgaacaatgagaacacttggacacaggaagggtaacatcacactctggggactgttgtggggtggggggaggggggagggatagcattgggagatatacctaatgctaaaggacgagttaatgggtgcagcacaccagcatggcacatgtatacatacgtaactaacctgcacattgtgcacatgtaccctaaaacttaaagtataataataattaaaaaaaataaaaaaataaaaaaagaaaactataggccaatatctctcttgaatattgatgcaaaaatcctcaacgaaatacttcaaaactgagttcaataatacactaaaaagatcaggctgggcttggtggctcacacctgtaatcccagcactttggaaggctgaggtgggtagatcacttaaagccagaagttcaagaccagcctggccaacatgatgaaaccctaatctcgaataaaaatacaaaaattagctaggtgttgtggcccacgcctgtaatcccagctactcaggaggctgaggcacaagaattgcttgaacctgggaggcaaaggttgcagtgagccaagatcaagccactgcactccagcctgggtgacagagcgaaactctgcctctctctctctctctctctctctctctctctctatatatatatatatatatatatatatatatatatatatatatatatatatatatatgtatctccttgtttatatttgaaaaaaactaaagactccagaataaaactattagactgattaaaaaattcagaaaagttgcaggatacaaaatctacatacaatctgaaaatgaagtttaaaaaagtaatcccatttataatagccacacataaaattaaatacctaggaattaacttaaccaaaaaagtgaaagagctctgtaatgaaaactataaaacaagatgaaatcaattgaagaggataccaaaaaaaaggaaaaatacctcatagaatcaatattattaaaatgtccacactaccctaagcaatctacagacttaatgcaacccctatcaaaataccaatggcattcttcacagaaatagaaaaaaattctaaaatttatagggaaccacagaagacccaggatagccgaaattatcctaagcaaaaagaacaaaactggaggaatcctattacctcactttaaattctacagagctttagtaatcaaaacaacatggtactggcataaaaacagacatatacaccaaaggaatagaatagaaaactcagagttaatccatacatatacagtgaactcatttttaaggtagctgccaagaatatacactggggaaaagacagtctcttcaatatatggtgctgggaaatctggatatcagcatgcagaataatgaaacttgactcctatctcttgccatatacaaaaatcaaatcaaaatggattaaagacttaaatctgacccttcaagctgtgaaactaatacaaagaaacactggagaaactccccacgacaacagaccaggcaaaaatttcttgagcattatctcccacaagcacaggcaaccaaaacaaacgtggacaaatgggatcacatcaagttaaaaagcttttgcacagcaaaagaaacaatcaacaaagtaaacagataacccacagaattggagaaaatatttgcaaactacccatctgacaagggattcataaccagaatatataaggagctcagacaactctataggaaaaaaaagtataataatccaattaaaaatgagcaaaagattagaatagacatttctcaaaaggagacgtacaaatggcaaacaggcatatgaaaaggtgctcaacatcattgattatcagagaaattcaaatcaaaactacaatgagatatcatttcacctcagttaaaatggcttatatccaaaaacaacagcaaataacaaatgctggtgaggatgtaaagaaaatggaacccttgtacactggtggtgggaatgtaaattagtacaaccactgtaggaaacagtttggaagttcctcaaatgactaaaaatagagctaccaaaaatagagctactaaaagtatgatccagcaatcccactgccgggtatatgcctaaaagaaaggatatcagtatatatcagtatatatatatatatatatatatatatacacacacacatacacatatatatatatatatatactcttaaaacttaaccaaaaaactccttacaacccattagaaaattagaagtaatcagagagtggctgattatataatatgtaattagagagtggctgattatataatatataaattatagatattataatttatataattatataatataattataaaatataaattagagatattagaaaattctggcaagaatgtggagaaatgcatcatggatatgttgcaggtgagaatgtaaaatggcacagccactcagcaattgccctctgggtcatttttccctggagagttaaaacttatgttcacacataaagctgtacaggaatgttcgtagcagctttattcataatagccacaaacagtaaaaactcaaatgtccttcaatgtgttaatggttaagctatggaacatctataccatggaatactacacagcaatgtaaaggaatgaacaattgctacatccaatagcttgaatgaatttccagggaattaagtcgagtgaaaaaaaccaaccccaaatgatcacatattctgtgaatcctttttaaaacattctttaaataacaaaactttagaaataaataacagattgccagggattatgaacagggtagtaattgggaaggagctgggggcagtagttagaaaaacacaacataatggatccttgtcataatggagttggtttgtatctagactgtgatagtgtatacatgaacctatatttgtgataaaatttcttagaacttaacacacacacacaaacaaatgagtgcataaaaatatgtagaaatgtgaacaaggtcagaggattgtctcttgtaaatagcctgtttgtgatatagttttgaaagtcattaccactgggggaaactgggtaaagtatatggtatcactctaatatttcctacaactccatatgaatccatagttctctcaacaaaaatttcaattaaaaaaatggatgagtttggcttatggaatagaatttgtcaacctgttctccaaaatactcaatgtcattttgttttctaaaaatcaaatggtcattgtagttattggtgtggctggtatcctcctgcaatatgtttgcctccaaagtagtaatgggagcagacattgtactatgtgaatgtgatctaaatcaaggtaggccaaggtatggacagaagtgaagccaggctaacacatattagcaacagctaccatcatgctgattcactttttatttaatcaaaatgactgaggcctcagcctaaagtttaaatcagagttgaaattcccaattcttggtccctctgtctagagctctacacacctatgggtcttccaacttcaaacttgaagtcgttggttaaatattagtgtctcagtgagacctttcctgatgacttatttgaaaaataatctctgtattccctttatttgctttatttatctccacagcacttatcactttcaataagcaatttaatttacttatttatttggttcattttctatctcctgctctagaaagtaagctccatagggcaaggatttttgtctactttgctcaccactgtatcccaagggcctatctcatagtaagtttacaataattatctatttaataactgaataaatggggtaactcttctgtcttctgttgagagatggcttctccgaagattgatttcttgtcttgcactctgcttgtcagtgtgattgataaagcaggcacccctgaataacctgtgggcactgatactatcagttgtttaagatgaagctcgtagttcaggatgcttctgattatagttcacttatgggcctagaactattaagttttaagtaccaacatgagcatgagaacctccatgaatttttctaccctagtagattcttatagatagtgggtctctcttggaagcagattgcctttacatgtatgcaaagcctggcagaggtttgaagtgagtctgggtctgctggaccattattaagtttcccattgccttgaaatctgccagtgtgtgggtatatgggcagccaagatcccccctaatttagataaagctaaagcaggagggcttagctgattttatcattactgagtagctgcagcatttcttgccagtgggcctggcacacttttacataaagtggctgaattttctgcaataaggtgttttctgctagtgtatttactcagtcatagctggtgctagactgaaacaggatgtctaagaggtggatgcatttgaccgggtagcctttcagctgtatatacagatcccaggtgaccagccttagagatctataacagttgttcacataaaagtgtcgaaagcgtttccttgaatgtcatggttagggcagcattattccatagcacatcttttccaaaactggaacttttaaacaatgtctgtcccctaccttgaaagtattggcgtctcctcataaacaagaactcacataccctccagagtgctaatactaatccaacataggtatggcatagggacctatggacagaatgacctagtctatatattttccatcaaataggatatttaaaatattccaccttcctcagaattatgaggcctgagtttcctggagttatataaaaaattttatcaactgacccaggtaaaataaatttttttttttgagacggagtcttgctctgtcacccaggctggagtgcagtggcgcaatctcggctcactgcaagctctgcctcctgggttcacgccattctcctgcctcagcctcccaagtagctgagactacaggtgcccgccaccatgcccggctactttttttgtattttcagtagagacggggcttcaccatgttagccaggatggtctcgatctcctgaccttgtgatctgcctgcctcggcctcccaaagtgctgggattacaggtgtgagccaccaggcccagccaagtaaaatgttttaaatggcattatatacctgaaaaaaaatgtgcaaatgttgtgtcctgagatgtatgagtaagacatttgattaaaaccaatagttctataattgctttcttccaaaaattgcttagttaccttccagtgttgtcctaatgaaaagactgcataccttcttccacaatggttgaactaattcacattcccaccaacaatgtaaaagtgttcctatttctctgcaaccttgccagcatctgttgtttcttgactttctaataatcaccattctgactggcgtgagatggtatctcattgtggttttgatttgcatttctctgatgatcagtgatgttgagctttatttcatatgtttgttggccacatgaatgtcttcttgtgagaattatctgttcatgtcctttgcccactttttaatggttttcttttattgtaaatttgtttaagttgtttgtagattctggatattagacctttgtcagatggataggctgcaaaaattttctcccactctgtaggttgcctgttcactctgaggatagtttcttttgctgtgcagaagctctttagtttaattcgatcccatttgtcaatttttgcttttgttgtaattgcttttggagttttcgtcatgaaatctttgcctgtgcctatgtcctgaatggtattgcctagattttcttctagggtttttatagttttgggttttacatttaagtctttaatccatcttgagttaatttttgtataatgtgtagctagcatttggtccagaaatctcattactgggtatatatccaaaggaacataaatcattctattacaaacatacatgcacgtgtatgttcactgcagcactattcacaatagcagagacatggaatcaacccaaatgtccatcaataatagactggataaagaaaatgtggtacatatacaccatggagtactatgcagctataaaaaggaatgagaccatgttctttgctgggacatggatagagctggaagccattatcctcagcaaactaacgcagcaacagaaaaccaagcactgcatgttctcacttgtaagtgtgagctgaacaatggaaacacatgagcacagggaggggaacaacacacactggggcctattgggggatagagtgtggggagaaagagcattaggaaaaataggtgatgcatgctgggcttaatgcttgggtgatgagttgataggtgcagcaaaccaccatggcacactttcacctatgtaacaaacctgcacatcctgcacatgtaccccagaacttcaaataaaaataaaaatttaaaaaaagaaaagtctgcacaaatgctgtcagctcatctctatcaatacgtgtagtgcttctaaaactatgggtttcataatatgacgatcatgtcctatttaagttgtggagagttcaataagagtcctacccagagggccaaagcatcttgggtgataagatgaatcaataaccatttgagccagagggagaattcaaatggtagttaaggaggtaaacaaaagttttaggataattttgtctctcttggttaata

SEQ ID NO: 6664 - DNA, 802 bp, artificial
  synthetic oligonucleotide
aattccatgcaaaatgagatttcgtttgtagagttaaaaaaataaatattttgttttacagtataatgaagatgtgagactatgaagaaatatctgtcatataccatcatgaagaattattttggcggtgttggttctttggagatgatctacaatcttcagtttgaatatactagtttagagagcatgaaatgttattatataatgttttaaagatgtggacttggcttcaaaaataataacttatacaagaattcaagggaaaacatatcaacaatgtatattagatatgaaaatctcaagattagaggacaatactttctcttgtaattttttgtttggcctagccagcaactgattattttgaaaccaactgaataagatcatacttgacttagaatcaaacttaaaatcatccatttttttcccaagatacagtatttgccttaggaggctgctcataactttttatacaagtgtaagaagttgccaaggtggaattaaagttaataacatggcaatgttaagttttgaagcttcaggccttcatttgatatatgcttaatcattttaaaaaatatattatttttaacaactgaccagaattttacctaactgatgaaataattgtgcacactgaagacacggcttctcatcctggtttgtcactttctgcattgccatggggaaatttcttaacttcacttatttcttcatcatgattattgctactatattagtcaatattaatttaatacagaacaccaaagaggttaagaaaattaagttctttttctatttt

SEQ ID NO: 6665 - DNA, 2075 bp, artificial
  synthetic oligonucleotide
catagattcttggatgaagaaaatactcagggagaatgtggttttagtaaaactatgttagcagttaaggttagagcaaagttcaggaaagccatatcttataccagatttattgctgtggtgtgcagtgttctatcagctttttgaacattaatgatctatcttaagctttagcacagatggtaactaaattggattttatatcattcaaatatttggggaagatggtgagtgatattatttagttgttatttcgatctttctgtggattattattcctatcatatactagaggtattggactacagatatttattcagtattttcttggaagataggatgagtcatacattttcactttgataatatctaaaatactaccttttctatccctataagacaatgttaattatagaaatacaatataaatacaataatatattttaagagcttgggtgatctatacaaatattttacttattgtgaccatctggaaaaaatgcagtctacgctgtggcaaacaaaataattctgaaaacataattaaaaacaggaggtgttaactcctgggaactttatattacatgcatgagcagttcccagaacaatagaaaactaagtgatgttatataggcaaacactcttatgtaaggcagatgttggctatcctaccacccactggaaatgaaaagctagcttatttgtttgtgtccaaatgactgtttgtttgtggaattagtctttccagaagatatatatatatacacacacatatgcatatattttcttatgtgtatacacacacatacacacacacacacacacgagaaagaaagacagattaagagagacagaaagataaatggagagagagagagaaagagagagagaaagaaataatcataaggcagtttctgtagtactttagttattgatggttttaaaatgtatcagtacaaaatgagtataataaaatagcagcagtagcactgtggggtggggtgacaagctacagctccaaagctatctaaacagaatttaataaataaaatattttacaaaagaaaatgtgcattgttaacattgcaagaactgcaaagccagtaaccatggcatgttgtagaaaatagatttgccagtttctggaaatttggctgaaatttagtttattctccactttattttccttttttgcatttcaagaaacaaatttggcccttgacagcaacaggactgaatcataatttgtgccactctatggctgaattccaaatggctcaggcgcatggcaacaggagtggtggcaaggactttttcttgggattttgggcaccactccttgcaggagagtttagtatactacatgtgggaacaatcagaggcagacaaagcagctacagtcctcaagggagagcagcaataagaattgggttaaactgaaagtctttgccaagagcttggttttaaaaaatggcattgttgaaacaatttttttttataaaagaataagcatgggtttggggaaataagtggatgagctccagtttttggtgcagaaaattatgatggagtacctggaagcaattacaagttccgtatggtgccaggggagtagactgtggagattgtttcagtctcttttcacgtggtgttatctcataaacatatgctattgcatgttcagaggatgtagaaataatttactgacttgttcaacatttgttcagtggttttacatgtcaatcagcaattaacaaaatattaagagcttactttgaacattgcactgtgccaaggaataagggatttccatgtggctgatgatatagtccttacattcaagaactgaccagtaattaaagacataggaaatatgtatgcactgcaaggctgtgaaatgcagccaaaacaaaaatacataaaataaactgctacagatttccaaataggaacaaagtaattatagaagattcaagtagaaaatgagattagtgcgagactataaatgataggttggtaatatatgagaagaaaagacaagtctaatcaacaacagtagattccagaaggtagac

SEQ ID NO: 6666 - DNA, 1399 bp, artificial
  synthetic oligonucleotide
cctagcatgcagtgttaatcatgataccataattctgttacaattacactcttaactgtagtaattgcaaggattaaaatggcattatagataaataaacatacgggaactattaaaccaaaaaccaaataatcttttaagcttttatttgttttttaataaccactaccttttaaaacataaatctatttttttaagatagggagtctgacttaatccaatccccctattggattacaaaatacagttcaaccgctattttaggagataaagagcagatgctctatgaaggaagctgagaattcttagaatgctcttctaaggaagctgggaattcacctggataatcaactttgtgacctcaaagctgcttcaccacttatggggtattcagctaggtgagtctcacacctgttggtaatgatgaaaatgtgctggaatgtctaagatcccatcgtgctgacattctcagtggcacgtgcacaacataccacggaattgaggacaaaagaagaagtattgctatagttgagttccaggtgtgaatgaggagatttatgacaccctattaattacaatttctctaaggcctggaatctctgcagtaatttacctgaaggacctaacagcactacagtggtttgcaagagtgactgatataggaaagctttgtttctgaggtcattgaccatacagataactgtagttattaactcacatgctatgcttgtgtttggggatatggctaaatagctgcttctctgctacatgttctctgattcttcctgatttttcagtagcttccataaagtaatctttgttataaataaaagtggcccatcttttcaaatcatctgctctttttcccactgctcttccacactctttccctcttaagctcaatatatgtaccatacacccaataagcatacatactcatagcccagtagattatgtttttaaagatgtatcatcattatttttctctgtgcattttgaatttgaaggtaaaaagcatccacctattggcaattagaagtcaaacattttggattttaaatagaatattatgctgtttatgtaaaagacctaggaaaagatcttctgaccctgacacggatgtttgttgtactacagtacccgatctcttaaataagctaaagagtgtgttgagtcaagggttactataatctgctataaatgggtcatcagatttctcaaataatacaaaatgctaaaatgtaaaaatcataatttagtattcttaacaactcagccaccctccctttgttcatgcaattctgtccatcaagaatctctccctcctattccttatgcagattctaccccacattcaagataatttcaaatttcacttatcccctaaatgcttttgaat

SEQ ID NO: 6667 - DNA, 1641 bp, artificial
  synthetic oligonucleotide
ttcatctataaactgaaacaataaaatcatccacttcatggaatgaagagaaaaaaatgtatgtaaaagtgctttaaaaagccaaagtaatattagttactcttaattataggtcaaaatatcaattatgtaattcttcatcttcaaataactttcacatttagtatctcaattattcctcacaacaattttttgaggaaaacaggacaagtatttccaaatacaaaatattttctgatggcctgctgagtataaggtactatgctagatgttacaatgttataaccaagtatgatatagagttagttcttctttcctagaggttatcatctggttgtgtaatcacgttggtattacagtaaaggaaacagaagctcaggaaagtgagattacctgcccaaagctacaaagcaaatccaagagaaaaaaaagtaagccttcagaaatattttatcactgaaaaatccttcaagctatgaaacaaagtctcctgtcagtccaatgctttttcacatgttcatactgcttcagttagaccacacagaaaatcaaaatgaaataggtcaaatgttagaaaccattgtgggaattctaaataccatgttgatatttgggctaggtggaatggaagtgaaagtacttcaagtcttttgtgctatattcagtaaactgtttcagtaggactgcctcagatagcgtcatttctggctagaccaccccaagggaatgagaagtcctaattatctttaccaccaatcctttctttgattgaacatgaatgagatgatttgatcttaagtggagattatacactgggcaatgccgggtagtcttcaaatgagcttaaaagaagcttttaaagagtatacatcatcactgggagaaacagaattgtttgggattttttttttcttaaactcaaaaccatttagatcattattccctttgaactgcagtttctacttgagattggaaactgcaagggaagaaataccatcggctgcttcattgatgtcttgacaggcatatgtagcaaagaaaaaaatataacaaaagatatccaatttgcatgaatttctaggttcatgactggtgtatatacagttggaaaagttagtagtacttaaatttctagatacagtcaagtcaataaattatgtaccatagtgatctcaaaataagtgcttttttatacaatgaattaaaaaaacataaattaagaaagaaagagagaaaactaaaaaaaaaaggaaggaagaatgaacaaaggaaagaaaaaggaggaaaatatagcatcctattttcagaaatgagaaatgcaagtatgtgtagttcttctatgtgaccaaggtccacattcttataaaacatgtaaattatggcagatcctaacaaattcacatattggatcctacactatatactggcttaagtctttgtggtttattattattattaataaaaataatagcaataatttattgagcaattgctatgtactggactctactataagcactttgcttgtcttagctcatttaatcatagaaataaccttaggaggcatgttacataaatattcccatttaacaaatgaaaaatgagaacacactgagaagttaaataacttgccctgagtca

SEQ ID NO: 6668 - DNA, 1994 bp, artificial
  synthetic oligonucleotide
ttaatctcacccttctacaatctactatattaattataagactggttccacagatggccaataaaaggagagcaggacataattaaaatgtccacaatctccattactactaccagtcttgagttatacagatcaccggagacattttaaatagactatggttaatatctacccttaaaataccttacagatgacactatagttctagtcattctaaagacagtttttaaaactagattactaccttagtggacttgctaaaatctccttaagttttaacacccgagtgataaaataagctgtacaacaaacccttttgtcacaagtttacctgtataacaaacctctacatgtacctcgaacctaaaataaaagtttaaaaaagtactcacattaatttttagttatataaagtaaaaaatacaaacattattttaaagaaggatcagtggactttcttagagaaaaactcatggattattacagatatgtaaatctcttctattaatcctagtttcttgtattttacataccttatagaaagaggggcagtaaagtagaaaataactgctgcttatgacaaaaccactgtagtactagatttcaagtggtagtaccgaaatccattaaagaatattctttatttgcctccaattccatttccctgaaaaaagtggccttcctgagaacccaccgtggcagtgataaacgttgccccttcccctccaagactgagaatctctcttccaaatcctagtctttgactacggctttggtacctactgattgccatccttgatgccatatttctgcctgcttatttggttctccaaatgtcacctgttcctgactttcccactgctatggtcagataacctgtcaaaataagttgttcttccatgttgtgtcttcttgttccaattgctatagtagactcttcctccttaaacaagttgtgccaggaatctggaccttctctgaataattatttcctctaaattataaaataatggaaattacatcagcgaagcctgtattaactgaataaacattatgctgatttaaaatcaataagcaaaaaaagaatttttttctaaataggaattgcaagtttgagacacataataataataataataataataattaaagttctgattaatttccctattcaactcataaagaatcctatgatgtaggtactcttattcaaaaattatagaagagaaaataagacatagtgtttagttattataaggtgacaaaactaggaaacagtctgattttagcgtctatattcttctagtcaaccccattccattgtggtaactaaagcataacaatcattgtcaaagatgtgatggacagttgttaaatctaaagtgtacattttaatatctacaggcattcctaacctgaattacacatacatatatgcacaaacacatgcacatgcacacactcctccgagttcttcagcttaaaggactaatcagagcattcagcctttgttccatcatggaaattgggacctcactgctttttagctgcacattttacatgaagagttcaatctaagtctccatttctggagaaacaataaatgacttggctaaatagcaaatgtgtctcaagaataaatgttcattactctacaggaaattcaactgtataactgccacgaattaaaaagatgcctaaacggatcgaacccatatacaaacaagtatatcggtctccaaattaaaaatacatgcatataccaataatacataaatgtgtatttgggtgagttcaagaaacgaggatttaagttggcatgcatgcacatatgggaaggagggctctgtttctgaaaaacaaactaaactcaaaggcccactgaaattgaaaaagtcacattttagagtggtccttcaagttttgcattcttctaaattgtgctttgttcacagctacatcctagtacttgaatcctgccatttatgtggcct

SEQ ID NO: 6669 - DNA, 1956 bp, artificial
  synthetic oligonucleotide
tggaggaaggaaaacttcagtagagaattttaaaatggagtggagaagcaagtcggaaaagaggtcccataaaggctctattcctaaaattcactagtgtaaatgtaatacatttacatatttaaataaaacactgattgtacttggtatgtgcagatattgaacttgaaactggaaactggtagtggagaagacatctgttcccatttggactggtttcccttttccagttcaatattacctgcacgtagggaacacagatcccaacaaagttcttctcagatgccaaaatcaaaagtatttgagcagactgtaatggtttgattcacattagtgaggcaaacttattgaatgtagaggctaataaattcccagttaaagtacaaagcgctcattgattttacaaggaaaaatctgtgattccactctgttcaaagaatgtttacagcaaatgataaaatgtaactagctttgtttttcaattaggcctattcgaaaattcatcaagcattctccctgctccccacaaagatctctccattatcacctcatctctggggtcagaagggtgtacaaacacaaaccgggttagaggtaacaaaagggaggaaaaataaggcatctgaatgcaagcatatttgggtaaaactgcacaatttctgaaaatagatgctgaaatagatggtaggtttatatgctgccctcaggcattgataccttcaacttgcatgcttatttatattcgcatattctgctattaggtgggaaacagttaccacagcaacctctaaatcacctggcagcttagctgtttcaataaagccatagtattctaacacttaaaaaaaaatagttgtatatgacaataaaaaacaatgtcttgtatgtgatgtttttaaagtgaagggcattcatcttcacatcgtccttgttccatccatccagctagctagtagtggaacttgagaatgtatatcaggtgttccaaatctgaatttcttctcttttttccactctattccaccgagtttataagattttcagtgaattagcattggttaaatttttttctaattctcagtacacattcgagtagaaggcttatacacgtgcattccatttttcacttgggcttttcacttttactttaccattatggagctgcttcctttaaatattacatatgagtgaacaacggtgcatttagcattaaagtttacacaggagggagaaagaaaaacataggctgttataagaataatctagtttagtgcatttattactatgtataggtttcaggtaaccttaaaaagtgaagactttttttttttttttttgagacggagtttcgcccttgttgcccaagctggagtgcaatggcgcaatctcggcccactgcaagttctgcctcccgggttaaagccattctcctgtctcagcctcccgagtagctgggattacaggcacgccaccatgcccagctaatttgttgtatttttagtagaaactgggtttcaccacgttagccaggctggtctcgaactcctgacctcaggtgatccactcgcctcggcttcccacagtgctgggattacaggcatgagccaccatgcccagtcaaaaactgaagactttcaaatgtaaaatatatccactagcagttttctgttagctccaagtatataatttcttcttactggtgcacaaatacgactgcaatggcaagtcaaaatttctcatttcctgagaattttgttttctgtttttataaaactgcttttaatttttgatggtgaaagtttgtttctttgtgctttcattatgcaagatataatcttgtaacagtatttgcatttccagtctgcagtgctaaaatctaagcatctccttattcacttccttttggcagctaatttagaatgtacaccaattaactggaaggtgaaaataattgga

SEQ ID NO: 6670 - DNA, 5312 bp, artificial
  synthetic oligonucleotide
ggtgaaggttaaaaacaattttcctaggggatggcatcggggcgcggggtcacgaacgttttcctgtatacctattcgtagtgggtctgcagagtgttttgggtgagtgtgagggctgcccgcttcagcaagcagaacctttgacagaagttgtgggatctgtgatgggaactgatatggagcagtgagaaagcaaggtttccaattgaccagctagattgggaagcaaacttcgaaataactgaatattgtcagtatcacattagattttactttcccagaataattcagttcttcgtgacctaaaaaatttttcagaaaaattgaaagaacaggatatctcttagaagctttcagaccttgatatcgaggttcttaatacaatgaaataaactgaaatgttcttattggaatcattggtttcaactttattggtttagggtccaatcgaagacgttactttgctcaaagtttgtagcgacgttttgttttgcagtcctaggcacacaactagcccgcccagacagccgagtgagtctgaaaaatccctattcactgagatcaaaatgacatttaaacttgctttactttttctttatttagattaatctaaataatcaaaaaggagttctacaaccttaattttccacctcactccctgactgccccccaacaacacatccctcacatcttttccccatcaacataaaccccgcggtggggggggtagtaatcaaatgtacggccgccactctgcgctaggcagccaatggagctgaaagattgattcacttcctgcttgggtctcattgaaactccggagcttcaccagcctaatttggaaagcgagcccgacctcccgcaccgctattggccgggcttactcctggccaggcggagacgcgctgcgattggccgtggtgggtgccggtaacccgtgctagcgtctttggctccccgcaccgtagatgtcaaaggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaaggcttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactctctcattcaggcttctcaatgctgatacacagttacattaagcagtccaagctgggatctcatattcctggctccccgggcaacagttccctttagccttttctgctgatcaatacatattgtttactcagagtaaggtttgtttggtcgctcctctctaggaagaacaaggagtgggataacgtgggggcggggtggggcgggggagggattgggaagacagatgtgtgcctctgaataacctttcagcgccttggttatagcagctgtatttcaggtgaaatttgttttacaatagactagttttgcatttttaaaaacttctatagcgtttctaaatgtctgcggtgttttactacaatctgtacacaatatttgtgagataatttgtatctaatcgaccactccatgttattattgctattattattactacttcgttgagctgatggctttttaattgcttagaaaagggaggagatgaatgggaataggcggggagagagatgcctatctactcaccgcccccccccttcccaaatctctatgaggaggagaggatacaacgaagagagttattgatgatgatattggttatattttttttccggggtggagtgcctaggaagggcagaatagggaagcctattaggtttgcaaactagtgcgaagtagcagcggcgatttcgcagctttctgccctccctcctggaagtgtggagcccgcgcaggctaccgcagcatagatcgaggtatctgagaaggattcggcggcaactctgggccaaagaggtggcctgacagtctgggagggctccgcactcaccggactccaggattcctgcgcgcagaaatccaggcccccagcctcgctagggcgaccttccgcgcgacctcacttcggccctcctagaggaaagactttgccttcacacgcgattactttcactggagatcacgacccggagacgctggcgactgggccagcgcctcccatttcggttcacctccagttcaccgccccctctgagtaagaaacccttggggaggggtggcgagggagtgggggataggcattctctgctcagtgcagaacggcaatgaaatgattggcaaaggtcacagggattctggtccatccgcgtaccacctctccccccatgtatataccgctgtctgtgtgtgggctcgtggggagctgtctcggcgtttctgataagcacagctggtggaagcccacagcgacgatccagcgagctagcgagcgcccgggaggctgggttcctgctttttaaaatataaatatatatatatttttaaatctctgtgtgtatgtgtctctgtgcgtgtgtgtgtgtgcgtgcgcgtgcaaacgtgtgtgtgtagatagctgtgtgtatcgcgttactatgtacaaaaacaaaaagtacaaaaaaaaaaaaaaacctggctaggctgtgtagagatcccaaaaatatgcagttgctgtggctttattgctagctagtatccacacaccaggtccacaggcgaacctcattcccaaggagcacacacgtgtgaggccggccaagcacccaacacccagccgccgccggccagacctggctgggggcgctgcacgccactgctggccgcctagtccggcctttaggcgcagctgctgtagacaaagcttcaaactacctaaggaccagaaagcccggcccggttgtcgaggatgcgttagtatgagttgccaggcctctggtccaccacactgtgtctccctcagctgcaggtcgaagagcatgtgttaattcaaatcccggacccttctacttttttgtcaagtctctgcattctgttggtagttaggttttagttctgggattttatttttttttcccccacactgagttcatgttttacaactgttgggagttttttgtttgtttcgattttttttctttgcagttaattgctatggttcgaacctgagttaacccaaatatttctgccgactttataactgtacagttttgtatattaaacgtttttgaagttattaatttaaagaaagatcatttagtttattcatttagtaactgatgtataataaacgctattttcattaagagttgctttttcaactattttattcaaattgcctattgcagttgccaacaattatttattttcaataaattctgcattgtgtttaaaaggaaattctttcacagataagttggatgtcaaaaagaaaacaattcgctgtaatgtttgatgtgaagttttagtcaaggggtttatattgacgcaatattttattgttgtaaaagattaaaaaggtttaaataaaacatttttccaaaaaaaaagttttcttctcctggtcttattgtgtgctgtgtgaggtggagcgtttaaacagaggcacattccgggtgaacagcacttctgctttgcttcagcttataaatcattagtcattgttttgactcttgattcccttcctctgactttcggcctttcagctcagctctgaaatacactggcgcacacggcacggcctattctggagcccacgctcacgcaaagcacagcacaaattgtgggaacccgcatagggaaggctcgaggtgggttttattttaggaggtgcaaccttactaatgttctccaaaaagagagtctctctctctcgctcgctcgctctcgctttctctctctctctctgccagcagatagacctttctccaaacctgcctctcctgaaactgagctcagatcttctataaggctgtcatttcgcctcactgcacccatccttcttcttcctctccattctgttaggttc

SEQ ID NO: 6671 - DNA, 2191 bp, artificial
  synthetic oligonucleotide
tatttccaacatgtgtagaagtttcataaaatctcagtaatgaaaccaagatcccatcttactactatgaagttatttgtactcttcaaggcctaaaacttcttaacaaacacgacacttgtagaaatttgctcatcaatgagaacacatggacacagggaggggaacatcacacaccggggcctgtcgggggtggggggctgtgcgaaagatagcattaggagaaatacgtaatgtaaatgacgagttgatgggtgcagcaaactaacatggcacatgtataactatgtaacaaacctgtacattgtgcacatgtaccccagaacttaaaatatataaaaaaaagaaatttgttcatacatctttgtaaaaaagctaagctaattctatgttcaagtacatttgcccgagttaaagttcaggcaacctgttaaaataaaaaacttcaatagaaagtatggaatgataataactatacagaccatcacaactccagagaataccttactcaactggcaatacaaagcagtagaacaaaggcaaatcttaattcccacaaattagaagcccgtgaaagaagtgcctttgggattttatcagcttgaaatgaccaaaggaacatatccttttcaacagttaagtattgcttggaaatttgctacggtaactgctctgagatgattcacaagtaacctatattaagtagaccacacagtatgttataatttctgcacatattaagtgaccatcaagggaaaatgaatgtagatagaatacatcatctaatcacatgggtgggcacactcatggattatacccaagttcactaacgatttttaagatatctgattgatgtggcagcttagaaagcaattgtatccttgtagcttcaagttgcagaaatcaattttgcactgatttaacagatcgctttggcatgagaaaaacagagcaatcaatggtgatatcagcagcctttttgtcatgctgacctaaaggagttggctataatcagtctgaagcaaaaaaaaataataataataaaataaaataaaaaagcatccactgctgccaatatattagcattaggtactcagctcaggtgttttggtgttgaaataatctgataaaaacaaaaggaagaagcttcaggccttgaaacacacagctagaaataaagactgtatatattaaatatgttagtgaattggttcttaaaatgaaaatgagagatttatagaatgaacatgggtttatattctaaataacatatgaaaatgaactggaattgttaagagaaactcaaagggaaatgttagagcttgtggccagagaggtggagggataatgttcaataaagaatatttctgtaatagatatttggaagaattgtgaatgcaagggaggctcacatgctcccttaaactacaggtgggaaagaaaatgggagaaggagaaaattatttttatattaagtgcttggtagaattcaccaagtgtacttgtaatataaatgggaaagaatataagaattactatctattcctttaatacattttttacattaagaccacttgatatacactatttctgaaagtctttgaacacactgacaacaaaagttcatagttatacaggaatgaacctgttatattttattttcattatttttcttcccaaaatgcagcttcatcacattgctctgaatttatagagtttttcttctgagactcctgtcatgtcagatgtagaatcatatttctaccatccctatgaagtagctagaggaaagtggggaaggataggaaggaaggaaaacccaattatttctgtataaacacagcaagtttatataatttgtaataattcagccaggtaatcataagttagtaagaaagaatagccaagaattcaactctgactctccagataaagacaaagaatgagagcaaatgctccctatgggcatgtattagtagagagaagtagcatttcatccataatacactattttctttataaaatgtttttttagataaagtgagatttgcagagtagctaacaacaataagtatttgaggatgaatttagaaaacattgctttttgtcgactgctagtctaacctttcttgattgtataaattgagaagggttatgtgagtttcaaaccccaaggccataaccctctcag

SEQ ID NO: 6672 - DNA, 1292 bp, artificial
  synthetic oligonucleotide
agaaaaattttcctgctcatcttatatttttctagtttcttaatggtgtttttctttattctaattgtggactatggagacgtgaaggacatttcttcttctgcattttatgtactgtgtggcaagataggtctattcagaatgttctaaataacaatatcaaacataaaatactataattcatttgtgttgtggagggcttatatatttcttaaataagcacttcatgaagaagcagtctagtgcagaagaaagattactgaactaggagttgagaaatacatttgagtcccaaatatttcatataattctgatgtaactttagacaagttactctcctttcccagtaaaacaacaacaacaatagtaaatgtgtattatacatttactatgaaccaagcaattgaggagtactttatatcacatataacccttaaaacatccctacatggtagaaactattataatcaacactttatagattaggtgactgcagctcagaaggggtaaaaaaaaaatgcccaatattgtacatagccaaaaggggctatacaggcttcagaactgaagtccaagcagttagtaagagtcaagactggtactcaacctcaggtctgtctgactccagagatcacacttttaaccaatatgaagtgctgttgctttaccacattctattgatccttagttcccacatctataaaaatgaagatgttctattgatctccaaagtaccttttagctctaacagattgagtctagtgtcaaaggaatattgagatctccagtagtagctgaaatggcaaataagagccaaaaaccaggcatcaattgttcccctcacatcacatggaaagagatctatcatgccattgctttttcttaatgatattgggaagaagcaggagtgtgtagcatcaataaggttttgagttactaagtcaatgggagagaaaagcgtagcatttctgtcaggaaactaaagatctgagagaaatctccagcttctcggttcaggaattattaggaaaaaataattgttctctttgaagagtggagaagacaagccctgcacaaatcggcaaccaataacaatatagaaaaaaacctctgaatctcctgagaagaattcaacaaggcttgactttcaagtaaagaaaaccttggtatattaatttcagtgtcataaataatgaattacctcccaggagtaacattccagaagggaaattcattcttttggttaacataccaaaaagacatggaacactggtgaagcaagatttattttg

SEQ ID NO: 6673 - DNA, 3542 bp, artificial
  synthetic oligonucleotide
cctgtctgcttgtttctcattgctttagtcattccagcaagatgtgactttccctgaaagttggaaattgcagttccttctataactgacgtttttgtcaggtggatttgtataaccaagtctttcactgtcttgattcaggcagagtgacaacaacaacaacaacaacaacaacaacaacaacaaaagcggccaaggggaatggacataccaacaaatagactgagagactatgaagaagtattatctgttaccatttcaccatttttccacaatgagtttaaattttgcacctgaaccaagaaccaagaatagcaatgtgtccttttcctctacaaaactatatttggtctaatctattctctgaaaggaagtaaccattggaaaatcaaaataaaattaagggactttaaattcatttgggtttctcctgatttcaggagctgtacagcaagtaaaaggataaggataatcctatataatgtcatttcagagtgtgatttcaagtaccattcttccaaaacgtcttcctctgctaaactgctaattcccaaatatctgtcattcattaactcaaaagacacctgtgtctaccatgtgccaggcactagtagtggaagatggtacaggagaaagtacgggaaaggcgaatgaaaaaaggatatcaccaagagaagaaaaggttcagacaggagaaacagatttttctgtttctcaagtgtgatgctaatgtcactgttaatatgtttgatttatagctccaattagctagttcagtataggtgattggagcttttgaccaactagtaccctttttagttgtggaataaaattatcctgaaaagaacaatattttatatttaggttttctttctttacttacagctttggaatgattatggaataggcattgcattaatttaaagtacataaaatttaattcagtaagtcaatatctacccatattgttagcatctaactgattcagcactcttggtttgagcataagagagcagaaaaatagtttgtcactgcttataagggttttttttccaggactcatttgtttctagttcctgaaaaggattacctagagtatatatattttttgtgaaccacattgtataagttcgaagatcactgattatatgttgttggcatctacagttccacaaggacctacattggttttgccagtattttatataatattcctgaaaccagtaggcagtgataccaagaatattcctgggctactattcaaacagtaattaaacagatttctttcaaatgttcatataggaaaccaagcaaatggctttgatttttattgaaagagcgctatttctttagagaaactaagaaattaacattggtacaatactattaactattctatacaccttattcaaattccaccagttttctcaggaatatcctttttcctctccatgatcccaactctccatttagtcgtcatgtcttctgtgtctcctctgatctgtgacagttccttattactgccttgtctttcataacctggtcatgattagactgagattatcaatttgttgcatgaatactacagagatagagtagccttcacagtgcaccatatatatatatatatatatatatatatatatatatatatatgtatatatgtatatatatgcacatatatatacacacatatatatatataatatatatacatatatatataatggttggtcatgttaattttaatcatttggttaaggtaatatctgctagatttttacactgtaaagttataatttcatctctgtaattaccatatgtattgtgggggagatactttggggttatgaaaatatcatgtttcttatcatattttgtccactagttttaacatccatgatttttacctgaaacagttattactgtgtaactatctaaaggtggttttctattttcctcattccttctactcatattcattgaaattttttataagaaaaagttatttcttctctcccatttatttatacattcaatcatgtatttctgtaagtatggacacagggatatttattttattctatgggttataatccagtactatcattatttatttatttttgttcaaattgttccagctttggtcattggaatcaccttcagattggctcctttgtccctctaacatgttccctccttttttgagtacttcactactctctgggactataagatgtcccagactcatttttatattatctgccctagccctagaatcaaacattttatcatggagtattggtcccttttataagataatgataattagaaactaagatctgaatactaggtgtactcattgctacaaggttttcactgtttctaggctctcttggtgaactgagataagaagtactgatgctccatgacttatggtggggccacatcccagttaacctactgtaagttgaaaatgccttcaataccctgataagcccattgtaaagtaaaaaaattgtaagttgaaccatcataagtcagggaccatctgtatatgtgtatatactaacaaatacatacacacatccatgatttctatatttattcatctgcatatatattacattaagcaggagttcatactgatgtttttgacttacatctctaattccaattcagcacaacaagattcattttagccttccctcttttcccatttgtaacttttctctgacagaatgaagcctggttctttgtatctataatcttagttagtacatacataaagcactttcagactatttctgaactttctattctattgtatagattatttttatgagtacaactgataaggaaaagaatggtttactttaaaatatagtgtaggaaaacaagattgggaaggaggttttcatcctgactgtatgaattcacatagacaaatgtcccatgtgttatgaactatattctctcctttacatccagtggagcaattagtaagtccctttctgttttcacaggaaaacaatttaggggagttctttgctctctcattcatcaattatggtaatcagcctaccagcaataataacaattacaactaacaagctaacataagattacctgtgtaaggtactctgctaaatgctctatatgcaatatctcatttaatttttacagtaatcccccaaaatgtaagactataatattttctttccattttgcagataaggaatgtgagttataagagagttaaataatatgctcaaggtcacacagcaggaatgggagcataggtcactttgacaccagcgttagcactcaaccactattttacacagtcttactatagaaaagcatactggggagaaaaagaagtttggcagctataaagagggtgctacccatggcaaacaaactctccacaggcaatctattgtttgttacagtattgtctaaggaccacttatatcagaatcacccaagatgattttaaaaaatgaagtttcctgggcccaagccaaccttacacacca

SEQ ID NO: 6674 - DNA, 1741 bp, artificial
  synthetic oligonucleotide
atgcacagtccttcttagctgcattcaagtgtattaggaaacattgattcacatttgcaaaagtcatgaagcatcttttggtatgcagacttctaattcttcatgcaaatatttctcctcctcagtatttatgcaatgtttgaaaaatataaacagctttaagataatttaatattgcagacattttcttcacagagctgctttgcaagcctattaaatacttcctagataacaggcagtaatttatgtatactttcaagattttctaagtaaatcaatgcttgtgagaggaactagtatcataacatcagttactgaatatcataaaacaagatctatcttatttttattgttgttaaaaccctacctacattttgagtaaactttgttagttcttcgtcaagatgatagtaaggagaactccagtttccacattgaccagagctttgatctctgagcaagctattaatgactgccaagtctgaggtgctattttatgatgcagttactcttgcctcaggtactgagcccatcaaagtgtctcataaacattttgtgttatttagaattcctaagaacatggatttctagtgatgtatctcagtcaaaaactccactatgaccaaaatgagtatggatggttgcatagtaataattatcaaatgcaccattggaaacattctttcagtttgccacatgaaatctcaagaatgagagactgtataattcagtgtaggggaaaaatacaatgatccagctcctgattttatataaatgagtacttgcataatagttttaaaattatttccaaagataaattaagtcatttgttcactcactcagcaactactgtaactatagttacagttgaacaattatatgacaggctctcaaccaggtaacacataggtgaataaaataagtctcttctcacaggaggtttaggatgaatatatcatcatgtgttgtataacaacgtttcagtcaacaatgtgccacatataatgacagtcatcccataaaattataatggagctgaaaaatttctatcacctagtgatgttgtagccatcataacatcatagtacaatgcattaacttttctatggatagatacacaatacttatttgtgttccaattgcctacagtattcaatacagtgacatgctgtacaggtttgtagcctagaagcaataggctataccatataccctaggtatgtagtaggctatatacatctaggtttgtgtaagtacactctatgatgttttgcacaatgacaaaattgcctaacaatgcatttctcagaatttatccccatcattaagtgatgcataatggtacttaagatatcaacaatgtggttttcatccccaaacaagaaacactagtatgtgtatataactagggtacaacattttctctgaagacagataaattactaaactggtagagctttttaaaaccaacatcctgaaatcagtaacaagaactgctatatgaggttttgcttacctttcccttagaagtaacaaagttcatgtgaggtgagttgaaaaattttaaaatcatgattacaaaaagatatattttctatataagtgctgaattttgaggattaaaaaaagaactttatggaactgccaagcctgagacacttacataaaacatatttaaaaaatccctaatggggtagtgaatgacccctttgtttccacagaatttattacaatggaaaac

SEQ ID NO: 6675 - DNA, 1694 bp, artificial
  synthetic oligonucleotide
aaataaagaaaacacattgcctgaggcttcccaaaagctgaattaaattttactaaaatttgttcagttattatcaattattatcaaaatataccaaagcttataagatgtaaatgattctcatttacgttacatcttataagatgggtcaaatgaaattgatatgatgagaatttggggttaggaactaataaagtgatattcataggaaaaaaaagaaagaaaagtaattcgggtcattaatccttagtgtccataaatttgtgtttcagttctttcttagaaattcactgtctctaaacttctttccctttttttatatctccttctttgttttcttgttttttttacaccagtatatttatttttgcttgatgttttaactttttaagttttctttacattgggatcaagttcttaatacagtgggacttaaggattttttaaaagaaaaatgcaatgaatactatcttagtaaaaataaagaaagagctctttcaagtagaacatataactctagcaaagtatctggggaggggggtggggtgtagagtgatgagtctacaaaaaaattccttttgccctttaactggaaaacccatcaaatatgtgttgggatttagataaagaagactgaatttctgtacaatttacattggaatggagggaatgaatccattttttacactttcttgtaacatgtaacattttactgataatctacattctaagaaattatatatttcattcccattgtttgttttagattttcacaccattttgagcataaatataaatctctgtatttcaacactctcaatattcaatcacaatcaagtaagttatgagaagtttgcaataacacatcggaaatatgaaagatttcacaatatgaaagattttcacaatgcagctgcctggcaagcgttttcattttaaggtaatgacaagaaaaaagaaaaaaaaaagcagaggaaattactgcaggaaaaaaaaaagtagcacttactaaatgcaatctcatcaacccattttatattacattttctaatacaattagacattttcctctgtggcttagtaaagatatttaaaataagctgtttagagctgttaataggagatatttctggttcttaaacaaatctgagtatgatgattggtctcagcaaataagaaacagatatcctgggccgggcgcggtggctcacgcctgtgatcccaacactttgggaggtcgaggcgggcagatcatctgaggtcaggagttcgagaccaacctgtccaacatggcgaaaccccgtctttactaaaaatacaaagaattagccgggcgtggtggcaggcacctgtaattccagctactcgggaggctgaggcaggagaatcgcttgaacctgggagagggaggttgcagtgagctgagatccggccactgcacttcagcctgggcgacaagagcgaaactccgtttcaaaaaaaagaaaaaaataaaagaaacagatatcctggatatttttgtctagaattggtggtacaattccctatttgaaggcgaataaatcttttagtctttaagaaacacatattctgaatgattattcttattaaaatatatttatctttagggtctttgaaggtacatcgaaagcaaactaaacttaagaacagacatcctttctctttcctaaatt

SEQ ID NO: 6676 - DNA, 3615 bp, artificial
  synthetic oligonucleotide
gcgggtggagcctttcatgagactaagatcctaggaaatacactttgagaaacactagactagaatattctgtcccttgaagaaagaaagtaattcttttggggattctttacatttatcaatgatttggaggaatctgaatatgtctatagtgtctattatagtgctatcctagacctacagatctaagatagaatgtgtcaaacagaaggcaagggaattaagtgtgttgatgtaatgtgatgaacagtatctctgaacttaaattttctttcagattgtttctgtgactccaaactttcaatacaaacatgctcaagatgtttctgaggatttcatctatttctgccctattgatgtggaagttcaggataagtccagaagacaaaaacaacagaaaccaagtatggccccctgacaacacactgaagaatgtatccattagagggccttggggattatcagtccagtggtaatggttaccacctccccactaactaaggagttagaaggaatagcccttataaaaccaaaaacattttagggtttcttcacctagagaaaatgacagttaaatctccaaggatcctagaatcccaacacatagatgttacagaaattgacagtccagagcaaaggggaaaggatgccacaatattgttgctcttgtacctggaaaggaagagctagataatacagaaattccaactttgaaattcactgggcttatacacctggaagctttaacaaataattgttcagtatcctctggatagagtcacccacaaactccaaaaaatctggaatctccagaaaatgcagagtccccaggaagtgatgaactggaagtagcaagaagcatgtattctcttttttttttttttttttttttttttagatggagtctcgctctgtcactcaggctggagtgcagtggtgcgatcttggctcactgcaagctccgcctcctgggttcacaccattgtccttccttagcctcctcagtagctgggactacaggtgcccgccaccacgtctgactaatttttttctgtatttttactagagatgggtttcaccatgttagtcaggatggtctcaatcacctgaccttgtgatccccctgcctcagcctcccaaagtgctgggattacaggcgtgagccacgtgcccggcggaagcatgtattctcttagagaaagaccatctttcggcagttcctgggcagagctcctggaagcactgctgattggtgaagggatccacattctccaaactattctgacagaagaggagagagagattggctacctccagctaccaccagaagaggagaatcaagcaactaccatactcaagggtgaccatctccatgctttggaaggcccttttccattgctgcccccagcatcttaagtttcattggtggcacagtcacagactgccaggatacagcgatgtcaggagctgaaaactaaatgcaccaaagttaaatgcaacagagttaacatccagaagagaaatgcttcttcttctcaaatgatcataatttgttcacagaaggtaagattttcaaactcgcttcaactacttttgtaaattatgtataattttccagacaagcagattttcatcagtgaattcattttcaaacttaccacctggaaatctgtttctttatatcccataaggtatcagctttttctaagagaattggggagttccctacaattgtaagcctaatatttggtgattacagtattgagaggtgacaatgtgctagcagcccttgctcactctcagtgcctccttggcctcggcgtccactctggccatgcttcaagagcacttcagcccgtggctgcactgtgggagcccctctctgggctggccgaggccagagccagctccctctgcttgccgggaggtgtggagggagaggcgaggcgggaaccggggctgcacgtggtgcttgcgggccagggcaagttccaggtgggcgtgggctcggcaggccctgcactcttggagtggccctgggctgtgaggggcttagcacctgggccagcagctgcagagcgtgcatcaggtcccccagcactgccggcccgcctgcaccttgcttgaattctcgccgggcctcagccgcctccccacggggcagggatcaagacctgtagcctgccatgcccaagccccccccccccaccaccgtggcctcccacttggcccgagcctccctgataggtgccaccccctgctccgttaaagagtgcaggcccgtggagtgggactggcgggcagctccacctgtggcctcagcgagggatccataaggcaaagccagctgggctcctgagtagggtggggtcttggagaatttttatgtctggctggaggattgtaaatgcaccaatcagcactctgtgtctagctcaggttttgtggatgcaccaatcagcactctgtatctagctagtctggtggggacttggagaacttttatgtctagctagaggattgtaactgcaccaatcagcactttgtgtctagctcaaggtttgtaaaggtaccagtcaaaatggaccaatcagctctctgtaaaatggaccaatcagcaggatgtgggtggggtcagataagggaataaaagcaggctgcctgagccagcagctgcaacccccttgggtccttttccacgctgtggaagctttgttctttcactcttcgtaatatatcttgctgctgctcactctgggtctgcgaagtctttaagagctgtaacactcaccctgaaggtctgcagcttcactcctgaagccagcgagaccatgaacccaccggtaggtacgaacaactccagatgtgctgcctttatgagctgtaacactcaccatgaaggtctgtggcttcactcctgaagccagcgagaccacgaacccaccagaaggaagaaactccagacacgtctgaacatcagaaggaacaaactccggacacaccatctttaagaactgtaacactcaccatgagggtccacagcttcattcttgaagtcagtgagaccaagaacccaccaattctggacacagtatgactttaagttggatactttcaatgagaccccagttaataattatgagaaaataaactcttaaaatatacaaactagttatgactttggaaatttggaataaattttctcttttaaaaataactttcagttaagtgggtaatcttgagaaaatgactagtcctcattctatcacagattttaactgacagaatggcaacatttaccctctaacacacccatccacccagtaacaaccctgttggttaaaacagaaacactccactccatttcctcctgcatgtgagcaccatagtggctaaaaagtattaattgacaaataaatgattaatattatagcctatacctgaagtaatattaacagaactacttatgatgtatttataatgtacattaaaatcctaggctgaaatctgcacttaactgtaaggtaacatttttgtttttatcattagagctatttaaacatatatgaaaataatactatgaataccaaatagtactaggaatttttaattcta

SEQ ID NO: 6677 - DNA, 1890 bp, artificial
  synthetic oligonucleotide
ttttgggaaataagattgttataaatttattctaagcttattcacaattttaagacttttcttatttgcctgttgattattgtgaaataaacctgactgatattaaaatcaataaaaagtgtgcatcaatcagttatgaacaaagttagcttgacaaatctaggtataccatttatttaatatgcagaaatgttaaatttggatgaaattattgacaaatacacagaggttaaggctcaaaaacagaaactgtaatattattattcattcctgtggcagaccactatgtagatataagtatttttcctttgaaaaatacattaatgcaattaaaacaccttgatccatttttttccttttttggttctgtactatttattttgcattttatttttatattggcatatatatgtatgtatatgtttatattaagttcaataaaagaaaatagtcactcaatgtttcttttgtagccagtattattagtttcatttcatcattatttcttaaaataattttgtcatttacaggacagttctgttaaaaaggatctgttttgggtatgaaatgtgataggtatcaactaatgcctagtatatagtttgcacataataaatatttgttgattgaatgaatgaatacatgaattaatattgggactgttaatgggcatattatgagcatcttctttcctcagaatccttcagggaggcctacagcagaccttgctcctgttgtgaatattgcaatatacccttagtatattctcctgatagcaccaaaatcatcctttaaaaatgtaaattagatcacatcacacctttgctcaaaatcctccaatgatttcccatcttattcagcataaaatccaaatttattttggcggcacgaaagcccctacactgtgttacttcgctacctctgaaattattgctccagcctcactggactttttcattgctgttccttccgtatgcaaccctcttctctaaattcctccaggacttttatcaaatgagcttatcagagtctttctctcattgatataaaccagtaaactcccacctcattcccatactgttttattttccttcatagcatttgtctcttttttaaaatttattatttatttttatttatttatttatttttttgagacggagtctcgctctgtcgcccaggctgaagtgcagtggcgcgatctccgcttactgcaagctccgcctcccgggttcacgccagtctcctgcctcagcctcccgagtagctgggactgcaggcgcccgctactacgcccggctaattttttttgtacttttagtagagacggagtttcaccgtgttagccaggatggtctcgatctcctgacctcgtgatccgcccgtctcggcctcccaaagtgccaggattacaggcgtgagccaccgcgccggcctcatttgtctcttttactcctgtaatcataagctctgtgaggaagccactatgttttgtctatgccccgaacaactgcccggcacagagtatgctctccgtgacttagttttagaatgaatgaacttacccatgtttcgcagaggtaataagttgtttttcttactatataattaattattaaagcagctacatttgggtattaagtccttatctggacatatcacatatgcccgaaacaaaataattaaaagttctgcacccaggaaaataactcccaactggactattgataatgttctggaaggctttatctgggaccgggagggtcaaccacaggggtgaacagtttctccagaagacagctgaccgaaaccgcagcagttgccaaggcggctggaggagggcggagaaaaggcggtaactggcaggcaaggggcgtaacggggtggggc

SEQ ID NO: 6678 - DNA, 3216 bp, artificial
  synthetic oligonucleotide
ttttcctttctatacctttcttcactctccttcactttcttcatcgaattgtctaccattacaaaatagaaaagaaatgaagggagggaggaagggaaactgcaacacacacaggttttattggggtgaggcatacctcttattactctggtcagtctaatttgtcaaatcctcgagggtagggccgatacattttttttttaacgtcgtccaacatctattagaggttcagtcattgattatcctcctccctttcttcgtttcccttgggaaacctggaaaacagaaaatcttcccacagaaactcctcaggggcgcgccgagatctgggcttgcgcacttggacttggccggcgctcagcccccgcctcaagccggcggggtctcgcactaacctagcgcgggcgcctcgatctcccgcgcgcgcgcgtgcgcgagacccccctttggccccctaccctgcagcaagggtagcgtgacgtaatgcaacctcagcatgtcagcagcaatataaaggagaatgaggcggcgcgcctcccagacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaggagactcctgacgagaaactagagggacgtggatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattactctaattaaaatccaaatagtacactgttttaaatgttaagaacatgtccctttcagatttattttgttaacacacaggtagtttattgtgaactctcttggccttggacctcattttgcataatagcaaagcagaaaacaatggcatttgaaaaaagatacacaactaagaatttctaaaattgtgaagtttgctcatacataaagtaattctgtctgaatcgtttgttatacagaaatgtcacctacttctgtagcatatttatgtatatacctgaaatggtgataggggttcctctgagactctcctgcctcctgaataccaatttagccatcctcctttatttaagaatatattaagttgtattacgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaa

SEQ ID NO: 6679 - DNA, 644 bp, artificial
  synthetic oligonucleotide
aactcacctgattagatcatcttcacctatataatctctttatttaaagtcaactgatatgggaccttaatacatctgcaaaatcccttcacaaaattaactaggtttgtgtttgattgaataactgagaggaggtgcatctacaccagaggtctggtggtcccagcaatcttaggagactgtcttagaattctgtctagcacatactgctttttttcttgcttttttatgatccattcagcacatttgtcccctaagatttttttaaaatgtaaatcatgtagtgctcccttgtttaaaacactcaaacagttttctattgcactgggaataaaattcacctttccctcaactgggcatggatttttctgttagtaaatgaactcagatggagttccttgatttgcatttgtaacaactgcttgacattgagatggatgcttctttagaatcatccactgtcacaccctgtatccaacaaactgagtctcatttttatctatgatttgcatattagtgactcctaaatttatatctatagccccaacctcccttctgatttccagtttaatatatttaattgtcagcttgacacacctagttagatgtctaataggcacctcaaattgaaaacatttaaaaca

SEQ ID NO: 6680 - DNA, 288 bp, artificial
  synthetic oligonucleotide
ttaatgatttctttctcccgtccaccttaaccactaaaccccattgttacatcaaccactaaccccattgttacccatcaaccatcattgcattgcctccaaagtattaaatttaagcattctactctaaccccaaattccttacttttttgttcaattacttaattaccgcacaccattagttcttcaaactcattgagcctgtacactaagtacctaaccatgttttcactaaacagccctccctatttctgttcatccctactcactcagcttaaattcattgac

SEQ ID NO: 6681 - DNA, 1768 bp, artificial
  synthetic oligonucleotide
cctgggcaaggtggcctgcttaagatgagattcatttaattttgttgaaatattagaccaggcattcatttatctgatggtgtagtaaactctgcacttctctctgctagtgaaaactatgcctataaaactatttctcagcagactacattattagaccggaagattctaaatatgaaatatgttactttctcttaatggaggtcaaataagaaaactctgccatggtgaggttatagacggcctatcacggcatttctactctaaagttgttgggtaaaaaattctacagaaattgagctactacaattgtccagtatgttgtactttaaataagtgagagatttgcatcagaatcaaacatttggatactgctctctcttttttagtttaaccccctaaactaccatcaaatgaaagagacaatgcaaagttagtaggggaaaggggtcagggaatgtcgctactatgcattcagatttatttattgcttttacaagatccaaataaccaaaaccctacgtgttttaattgccctagctttggaatcagattgcttgggtttacaccttggctttgccactgaatatgtgatattgggcaattcatttaacctctctgtgactcagtttcctcatctataaaaatgaggattaatagtgtctgcattcctggctgaactaatgtacataaagcatctaaaacaatgcctgttccagagtatgtgctatgtgggtgttggctattagctaattattaattagtcttagtaaatgataaaatctaattaataaaagttaagcctgttttttaaacacacacacacttgccattctaagaagtttcttttgcttgttgtgcttttcctattgatctcatttattcaattgttcgatatttctcctgacccctttcctgctctcagattgagatggtccagaaaacaaaactcccattttaacaggtatcttgtatctacctctgagcatgttaaagcagaatgagagcagcatttgtaacatcctgcccttgacccattaacttgggtccatgctgaaagctccaagtgcaatttggaagcacttttgatgttcaattttaagcagctgtcttcttcttaaagcctttcagtcttaacaatacagcagaaacagaaagcagaataagtagaaatttcctagctgacaaaatgtatgagttagaatcgtgtaattttccaaattgtaaatgcatgtaatattttttttgccaccacaccaatcctgaaacgattccttatctgaaaaaagaatatttttattagtcctataattctaagatttcttaatcaaaaaccgttatgctagatgtttcaaatccaggccccgtatagcataaataaacttcatttctattcaaaccattttaatttaacaaaataatttttattttattataattacttaattttgaactgaattctgaatgcacaatttaattactaccaaatgtgttttgtgctttagagaaaataatagagaattttgacctgctttaggataataaagaagtcaaaactgagaacctctcaaggcttttctcatagtagcagtttattttccttaagtggcatctctattctatcacaaagtcatttattgacatatgaatttgggtttgttctcatagcttgtagacattttctctttctcattccaagaaaggagacaaacttctgtattctgagttctgagcaacatttttcagagaatggtagtttttagctgat

SEQ ID NO: 6682 - DNA, 4029 bp, artificial
  synthetic oligonucleotide
cagcaatatgttagtttctgagctttcagttattttgagagaagtctatctctcatgtttgtctaaaaagtatagtactatcatcacaaacaatattaattatgtatttatttttacgaacagtatttagaaaaatttatttttattatcatattgttaatgcattatgtatgttatgtatacattatgagatatcctgctatactgaagtaaaaacattttgaaaacatatgtaattatcatataagactatactatctcttaatggcctttggtagcagggtatataggtgcaattacagagcacctattttaagaatcttgagtttaatgccatattaaagcatactaaattcacagaaactatataaaaactttaatatgataaaaaagatcatccataaaatattatatatgtagtcaaagccttgatcattctaaaatgatagtaaatgcgcagacactgaagacttgctctatataacactactgatgataagatgggatgcattatgatatggttccccttttgggttcaatccaaggaagtttaattaccaaaccgcaagttgacctccccagaggacataagttagacgtcagtgagtatgggttttttttgtgtatgtgtgttttgtttttgtttttgtttgggacaaggtctggctctgtcacccaggcaggagtgcagtggcaaccagtgagtatgtcttttgctgtattgtctttaagctgtagacatttggaaaattcatgtctatctatttaattattggaatttaaataaaaacttcttcacaaccattttgatcgctcatgattagatttgttatgatagcctgtgcgtgtgtgtgtgtgtgtgtgtgtgtgtctatccagtacttattaagggtattctttgtggtgccaggcagtggtctaggtgctaggtgctgtgaacgaaatgaacaaaacggtctgttctttcatggaccatacagactaccatcatcctatcattagcttggggtgtataagctgtattatccctcctagtatatttactaaattatgaaatatttgagattacaaaattttgccacatctattattgaataatccttaaatttcctttcctatatctgcctcatgcattatatcagtaaacattagacttttttcagtcttcggaattataccagaaaagtccaactaaaaatagttattaagatacaaaacaaggtattttagttttatgagtgcagaaagtgttcttatcttataaagtacacataaaaaggagcatgaaataaaacatgtatttccacttaagaatgaccatagttaattgaccttagtaactttttatgatatatatttgttaaaagggatatgaattcttaaaattcataaagttaatcaatccatgagacacacgtttttgttataaaacatgcaactgtggatttttaaaaaaattatgttaaaaagcttgctttgatttgtgttaagagttttaaactagtaagatcctcaatcttagagcatcatttgctttgcatgtggtcctatacaatattatgccaaaaattaaaacagagatgagagttgtttatttttgttcatccagagtacattgacccttaaatatgttatatttaaatgtaaataactttacaaaaccagattatttgcaaacatgtataattaaatgtttaatgttactgttaagcttgctgctttgaaaatatcctgtaatctgctaaacttctaaatttattttgtagaaaaatctgtgagttccctctaggtttttatctgaggtatgcaaaaggggaatttgttcatagaaaaaaaattactccatagtacattttatgcaaagcatacaatctttaggtctcactttataagccaattagcatattcactttaaacatgatattttccaattcaattcatttcaacaaatatttagtaagcacctactatgtgcaaggctccttatcaggggaagtggtgatactaagaacttgccacattcttattgtctcatctccagattatctaggttgagttttattgtttcatggttaactctcagctaacctacattagtggaaggaagagtaaacaatacatataattcaaaaacgtggaaaattaaaataacattgatttggctttgcagtgcattataaaatgttctcagcatatttacctgtctaaatatattttacttattctaatattaaattttatttacttttttctgattaaactctcttttaatgggtctacaaaattgtgtgacagattttgatcaagttgtttccattaaaaagtactgattttaaaaactaataacttaaaactgccacatgtaaaaaaaaaaacaaaaaaaacaaagtgttccacaaaacattctgccttccttctaaagattttacaatgcattgttatcattaaccagtcttttactattaaacttaaatggcccattgaaacaaacagttcaaagattcttcttccaccactgattaagactagggtggcaggtattagggataatattcatttagccttctgagctttctgggcagacttggtgaccttgccagctccagcagccttctgatccactgccttgatgacacccacagcaactgtctgtctcatatcacaaacaccaaagtgacccagaggaggatagtctgagaagctctcaatacacatgaggttgccaggaaccatatcaatgatggcagcatcaccggacttcaagaatttagagccatcttccagcttcttaccagaacggtgatcaatcttttccttcagtacagcaaacttgcatgcagtgtgagccatgtggcaatccagtacaggagtatagccagcactgatttggcctggatggttcaggatgatcacctgagcagtgatgccggctgctttcattggtgggccatttttgctgtcaccagcaatgttgccacaacgaacatccttgacagacacattcttgatattgaagccctcattgttcccaggaataaagctttatttcatttcactcgaagctttattttatttcactcaaagcttcctggtgcatttcaacagactttatttcagttgtaacatcgactgcagcaaaggagaccaccataccgggtttgagaacaccagtcttcacttgaccaccaagtacagtaccaatgccaccaattttgtggacatcctggagaggcaggcgcaagggcttgtcagttggaccagatggtggtaggatgtagtccagagcctcaagcagcgtggttccactggcattgccatctttacaggtgactttccatcccttgaacgaaggcacgttagcagttgcctccagcatgttgtcatcattccaaccagaaattggcacaaatgctactgtgttggggttgtagccaattttcttaatgtaagtgctgacttccttaacgatttcctcatatctcttctggctgcagggtggctcagtggaatccattttgttaacaccaacaattagttgtttcacatccagtgtgtaagccagaagggcatgctcactggtctgcccattcttggagataccagcttcaaattcaccaacaccagcagcaacaatcaggacagcacagtcaacctgagatgtccctgtaatcacgttcttaatggatacagtagtcattacaggtgttagcagatcaaaacctggcaaattacatgaggccagttactgactttaacacaccttcctgtgttcagaacccctaaataaccatcttccttcagttaaataaaaatttcttgacaccagaggaattatagctttggattagaatgcattgatgagtataactctaaatcagatttttgtgaagcgtttctactctgtgaagagaataattaattgattttcagcttgcaattaagaaaaggaacattatatagtcttgatgctgattatatcctgtcaagagcagtcattttcatgatgggcacatatagaacattgtgacc

SEQ ID NO: 6683 - DNA, 579 bp, artificial
  synthetic oligonucleotide
atgaaacataaaaaaaaataggctgctttcaagtattttattatcaagtcatagatctttttaaaagagccagctgatttatctttgatattttctagaataggtagcattgctttaagtagtggtatccctttcatctttgtcatttacatattggtgctgaattcaattgcatgaacacaaattagatttcttggtcagaaacagagaaggtgaaaagtagacaaaactatggagctgcctgttcccttggtatcttaggttccagatctccatgtccttttatcctctccttctttggctacacctaggcaactgtatcttccaccatcctccctgtcctacacagtcctacccaagttatatcccacaaatgttctttcccacctccatttctacaataatttaaattttttatacttactttataaaatatgtctgaactgtctagactgcatgaggtaagactgtatgaattgagtcattaatcaactttggaaggtaataattgcttgcttttaaggccttttgatttgaaatccagtttcttaggctactctgtatattgtgcattgttag

SEQ ID NO: 6684 - DNA, 293 bp, artificial
  synthetic oligonucleotide
atatctctaaagaaaaggaactggtatagtagaggaagggattgtatgtactaattaatagcattttccgtaacaacttattctttttaggcaaagtccttgaactatgtgagtacacatcagaatctgagttattattgaagattgtattactaattgcagggaaaaataggaattgtgagaatgtataaattttggaaatctctgtcctttgctactttggatttggagaagacttctgtggtgtttcataggagctgcagctatttttgatggggcacaaattaaatatg

SEQ ID NO: 6685 - DNA, 3403 bp, artificial
  synthetic oligonucleotide
cagtataatgtgacttgtaatatagagagatgattctttgtaatgggtgcagtcagggaagacttctctgagggttagtatttaaccagatatctgaacaatgtgaaatatctagaggacacaaatttgaagcagggtgaataagtggaatcaagagacagaaaaacagtcagtgtgactggaacatagcgagcaagggaatgtgtggtacaatgtgaagtcagtctggcaatctccagatcgtgtagtttctattaagttctaaacgtggtgctctgtgctaggatatctttgtaagccaattatattatggaccttgctcaaagcataattaaaaagatatgctaatcaaaattcacagaactaagtatataattgcaaagtactttatggtaagtgctattaaggagattacctaatgttatgagagcatataaataaagtgtgaaacctgatttgattaaagaaaagtttccccagacaatgatgatgagctgagatgcataggataagtagttagtaagatagaatgagagaaagattggaattatagacaaaataagttaactttttccactttttaacaagtagtgaggcaagaaacagatgtccttttaagaaactaaagttatttttctcttttcacttggatgtacaaaataagaagtttagattaagaagaaacaagtagtttaagagtaaaagtacactttggttaacaatacaatcattaaaccttaaaggcctcactccaggtttctggtggtcattgatttctctttctgtgctgctgttacagcgtgacatagaaaagaaggatacacttagatctggtgaggtggggccaatgtaagctgaacagcaatgtactgctgctgtcttccaggggaagtaggtgaatagtcattttgggaaaggcactgcatcaccagcttctagaaaattttttcaagagtctgaccattgtattttttctcaaatatatttttttaaatctctccctggagagtggctttgaactctagctttgctcagatagggctcccataaatttggtggtaaatatttatgtgtttttcatgatagttctttatcctggtggatgaccaaatgcctgtgcctgatcatacccaggtatcttcctcacagaaagaacatttttaggctgtcagaatcctttttggttcttgtctgacctgtgtccagtttattcctactaagatagccactccacagcagagtcctgaccaggaggagaatcaggtgtgacacagagaaggcaactcaacaaaatgcacaagataacagaagcagtgtattacttacaaatcccggagagaagaaggcagcatgcctcacagggaaaacaggaagtagggaagctttctgggacacattggttcaaccaacaggtggggaggaagagagagagaaaaaggagcctgtgggccaaagccttcattgagatccaaggtgttacccaagcaagttttctgtgtggagttctaattggtgggttatgaatatgcaggcatgtgttccatggattcccactgtgactgaaaagtgaccgctatggcttatctgcaaagcctgtgtaggatgtggggatcagtcaggtagtatatagctgtcccataaagatgtggtcagtaggaggtgattgtataagaaagatatatggatagatctgcttgaggaactacgggaggcagagaactgggaactgtgtcaaggatgactaagccttgcttgtggtatgaaaaagccaaccctatattcaaaataaatgtcaaggcaacataactctattaggatctactatactggcctcataaaaactttgaccaatcagactattctagcaacttggagttctggaaatgtttttcgtgaagtaaacagaaaaggaaaacaatgctaaatgatggcaattaatatgtataaaccaagaagtaattttattttattttattttagaaactgatgtttattttccatcaaccatttttccatgctgcttaagagcctatgcaagaacagcttaagaccagtcagtggttgctcctacccattcagtggcctgagcagtgggagctgcagaccagtcttccgtggcacgctgagtgctccagtcttcagtagggaactgctgaataggcacagagggcacctgtacaccttcagaccagtctgcaacctcaggctgagtagcagtgaactcaggagctggagcagtccattcaccctgaagttcctccctggtcattgccttttcagcagcagcctgctcttctttttcaatctcttcaggatctctgtagaagtagagatcaggcatgacctcccatgggtgttcacgggaaatggtgccacgcatgcgcagaacttcccgagccagcatccaccacatcaaacccactgagtgagttcccttgttgttgcatgggatggcaatgtccacatagtgcagaggagaatctgtgttacacagagcaatggtaggtaggttaacataagatgcctccgtgagaggctggtggtcagccctggggtcactaaccacaagaagccgtggctcccggaaggctgcctggatctggttagtgaaggttccaggagtgaagcggccagcaattggagtggctccagtggcagcagcaaacttcagcacagccctctggccagtattcctggaggatataacactgacatcagcagggttttcaatggcaacaatagcacgagctgtcagcagaagcttctcccaggtcctcttcagatttatgatatagatgccatcacttttccttttatagatgtactgttccatctggaagtcaagattggtgccacctaagtgggttcctgctgcaaggaacttaaggacatcctcctccttcatttgcaggacatcaagggctccggacattgtgaaagtttccctttaagttacgacgggaatctagaacaaccccctatggacccctctgtaggtagtgcggaaagaccaagaagtaattttataacattaatgtgtgtatatatcggtaaaatgtcagctgcaggtaagggaacaattgactgagtggcttaagccagaatttaaaatgtattgtgtaagaagaaatcaagagatagataatccctggcttggtacagtgccagagtggacctcttaaaaagtgatgattatgatagtcttttaaatacttccttctctaaatgtttaatgtcaaagtttaactttgttttaattttaatgttttgtttaattttgatgttggtattgatgttttcaaatgagcaaagtgcatgtaatcatcaccaccaccaatacactctcattgctaatatttgattacaaaataagataaatattgacctgttattagataattct

SEQ ID NO: 6686 - DNA, 800 bp, artificial
  synthetic oligonucleotide
taagtggctataaaatggacaagtctacttgctagagcctgggtcacatgactgcaccttcactgaaagttgagtaaaagatgttttcatcttttattgtggagagtgagtagtgccttaaggtgataaattcctcagccatggaaaatgggttcaaaataatgatctgttttatctttaggaactgatttcaaaatatttgaaaatattggggaagccaaagtaacagtatatgaaggttatattcagcctatgtgacattggcttatgatttctagtttatactttccataaaaatctctgataaaaatgttcatgagaaaagaaccaaggacattctgggtaatgtattctgggtaacaatattctgggtaaaatatttcagtaattacaatttcacctcttttattgttttggaaatcaatattttcttattgttgtttatagaactatcacaaaaaaactgtcgaatgtgttgctgaaatccagatataaatgtggttgtcttttttcgtagttccatgacttgataagtaaatgagcttgtttatatgatatgtgttttgtggcataggtacttgatgaattcatactaattacaaacatggaaactgtgtagtataggggctatgcataaaaacggtggaatcataaggatttgggttcaatccacattccgctgtctactaactgtgcgatattgagaaaattatctaaccttttggaacctctattcccttaacattgtaatctagaaaataatagaacctactctatatggtgtttgtgaagattaaatg

SEQ ID NO: 6687 - DNA, 250 bp, artificial
  synthetic oligonucleotide
aaattctttgatttagttaaatttctatatgatccagttaggtgtgcatcatttaccagctgcatacgtctcttcatgcttcagtaaggtgtgttgcagatggctactgataattgcatggcactgcagacataagcaatacaaataatggataaatcagtgaaaattaaattctgcttccagaaataatttaaactgacctgctaaaatatcttaattgtctttatgcaaaggacagtggttcagcaaa

SEQ ID NO: 6688 - DNA, 449 bp, artificial
  synthetic oligonucleotide
tgcaaagacaaatgttggtagggcaaactgcttcttgcttcctctgggtgagacagaggaaaaaaaactgctggctttttaccatcaaaaaggagacctaaaatcttgttaaactctaggtataggagacacaacaggtcttcttgatggatttttttttttttttttgctgtgatttctgcctctggaaaggaactaagcaaaggaagacagctggaacgcctatctgctgacaaaggtacacttggaattttaggcaggctactagatacatatcgttttgaaaagtagctttgaagcatgcaaatgagctcttatggaaaagagaagcacacttttggggggtggatcaactcagactcaatgactggtaaaaaaggggcttaagaaagaaaagccttgcaagaaagcccagattaacccagcagagtcctagctttgcctgaaaa

SEQ ID NO: 6689 - DNA, 810 bp, artificial
  synthetic oligonucleotide
gaaaaacaaaaatataattttcaattttgtattttatttatgctaaaatgaataaatatacaaacacatattgtgtgcagaaaagaaaaagaaggaagaaagaaaagaaatgaacacacacactggaaaacaaagaacaatgtataacagtgaatgtctgaaaattgaaataacaaatgatttcactaaaaattctaaattgtccacagcttttgttatcaaaaatagctatttaaatatagtaaaaatatagagaaaaacaaaaatataattttcaattttgtattttatttatgctaattataatctatattgtcattgaataaggtaattaattcatgtgtcattgagcatttaaagattaattaactgttgccaagctcattgttaaatgaattgcttctctgggagatcagttacatcttggaatattttatttataatgcatttgacctattcacctgtgatgttggactacagtgcatcaaacttagtctaattgtgcttctgttatatactatacacatttgaacattctcaaaatgaaatgatgtatagacttgtggtaggccaaataatgcctattctctttccgcaaaaaaataaaatgaaataaaaattaaaaattaaataaatgcctacatcctaaatgtaagtattgaacttcacatggcacaaggggcttttcaaatgtgattaagtatcttgaggtggggagattttcctgggacactcatgtggggtcagtgtaatcacagggtccttataacaagatgagggtcagagttatagaagaagatgtgacaataa

SEQ ID NO: 6690 - DNA, 1158 bp, artificial
  synthetic oligonucleotide
atttttcacacttaaaactgaaaaaccaaaacaagtcagagaagcctagaatccttttggcctatcctttagccctttattgcaaccatgttcttcatttttcccacactccttttgaaccatttgtataatgatattaaactggatgggaattcattttctgcagcccctgcagattaaaatctgcaatgttagtcactccttgtgagaatacagccaaactgttcctggattattctctttttcaagcacatagatatatatgtaatccccaagttctaagcagaaggaactgggatacaatacctggcactttacatgcaatgtgtcattgaattgatcaataacgctatgtaggtaggtgtgtttgtctgttatattttcgaaatgaggaaaccaagacctggagatgtgaggtaatttgcccaaagtccacagatactaaatggaagatatcggattcagacttatattttgggatccaaaaatccatgtccttcttatatatgacactcagccttatgagttataaaaatctgtatatagaaaatatgaaatggcgaatcttcatacctctcctcaatctattgaacattctaattatactaatattcatttggggctgctgttattataattgttattgtttgaggaaacgaaacgggatattggatttaattatttcagtattgtaatgagagagccaaacttgaggacacaaagcaaagaaggataacatatacaaatgatccgaacagagcaggcatattgttattctctattaccacatgagcaattacataatacttacacctggaaaaccaagagcccccatacttcccatacctcatgatgttcccttgggtgttaggaaatgatgtgttatgctgtaaactctttcttgaatgtagacctttgatttcctaatcttctttaggaaatcaaaaagagattctacgacaaacatttatccattttgtggatactgagctttatttcttattttgttagtagcccaaaatattttgaacacagaattagtaactcatcacctctcaaagagtcaggcatatgaaagaagtatagcagtctgtccgatagggctctttttaagttggtaatttggttacagttgcaaagaactttctatataaacca

SEQ ID NO: 6691 - DNA, 1268 bp, artificial
  synthetic oligonucleotide
ttttaaacttgcctccttaaaaacacgcttttcacaattttcagtcaaccaagtactatttcaggatcgggtatattaatcgtatgtgacatataattttgagtataatttctgaggtgaattaatggattggtggtatttattgtagttacaatcaatgaaatgattgtaatttaaaaataaaaataaaacatatgactcaaaataagtgtgtcttattaacaacaacaaaacaccctctgcctaccaaaaatgcctaagaattcactgaacactgagtttctcttcttactaggactctgttacatttagaagtcaatagaagacattagaaaagtaaagtgttgagaatatcattgaagctgtgctatactaagcatatcattgtcataagactttcatatgaatttatatgctgtattgttttgtttctgcataacatttcattcccattaaattgggaagtcatgtgacagcctataatacatatatattttaaattggcattaaatgaaaaataaggaatcctagatattgaagtacaaagaagtgacataagattgggatttaaattataacacgaaaatatttttatatggatttatatatcctcaataaacttccttcattagggaaaaatacacactgctttctagaaaaattattttattggccgggtgcagtggctcatgactgtaatcccagcactttgggaggctgaggcgggtggatcacaaggtcaggagatcgagaccgtcctggctaacacagtgaaaccccatctctactaaaaatacaaaaaattagccgggtgtagtagcacgcacctgtagtcccagctactcgggaggctgaggcaggagaatcacttgaacccaggaggcggaggttgcagtgagcagagattgagccactgcgctccagcctgggtgacggagcaagactcatctcaaaaaaaaaaaaaaagaaaaattattttactatcttttctcagttaaaattccatcaaataatccaaatccatctgtaccaaccagtgtatgtgcctagactatgtctcttaccataacgaaactattccaacataactcaataatatgatttatttttcacaaagaattcaaaattatctgtctaatccttttttattaactctcaataatgaatttcatagtagttctgaaaacaagatgattacctaaatcttctgataaaaaaatcgaacgtacttagtaaaccagtttcacaatgatagtaaactacatatt

SEQ ID NO: 6692 - DNA, 885 bp, artificial
  synthetic oligonucleotide
ttctgcactaaaatatataagacttacaattacatgctacttaagatcatgtcacatgagaagaaatttgttgctgcaatagtagtaactatgattggatcagaactatacagaagcaacagatgtattgtggggtgtgtaagaaaatcaaaggctttgtagcccgacaaatctgtcaacaaactccatctccataatttgggctaatctttctaaatacaagttttttcttgggtatagttttatttatattgatttaagaataagattattattataaattatctaacacagtggctggaatataggaagttcttaatacattttaatgaccattgtcatttttcgtttagtcaccgtcattttaatgagggtttggcaaagcccaagagggctgcagaaaggacatgttgaaatctgactaattctaattatttcttgtgctttcctagtttctacttcctgtccatttttgtattttagacttagaatttgttctgagtggattgtcatagcacaatctctctccttcactgtttaattttcaaagtagctttgtcaatttcattcattctatgatactcatagattatcaaatttctgcctggaactgtactaaatttggaaatatcgagacatacaagacaagtatcctgaggcatttcaatttactgaataacataggcaaaacaattaactgttttaatactatatcatagtatactcgatactagagggtcataaagaaaaagcataaataaaatatatattcctcaatattctaggggagggtaagtcagaaaatgtttctgagaggaaatcttgcttgagatgagttatgaaggtttagtaacatttaaggagcagataatgttatttgaagca

SEQ ID NO: 6693 - DNA, 819 bp, artificial
  synthetic oligonucleotide
taagatataaacttagataacacattcattttattaatgcatgatatacataagagccttttctagtttattcttctctattgttctctctccttctttgtctctgtcacatcttctcacacatacacgcacatgcatacatataacttcaatttctattccactagtgtaatggaaatgcacttctagagagaatctctagagagcatgattggataacctcaattcaatagggtcactgaaaaaaatagtagtttgtaactaaacagtcttaattgttttcagaaatatttcaaaaatatagcaagtgagttaagacaatggttttagatcaacttcttagatttcagttcattgtagtgaaattgatctttaaaatggtataaatattattaacaattgcttctctggttatatgaatagatacacctatagagaaacaatgggtttgaactattatgagagtgtgggtatctattatgaaagggttttcaggcaataatgaaaatatctaaacctttaaataaggacaatgaaagggttttctatgctacatattaaaataacggctttaacacacttgacataagctctttctattctttaaaggacattatgcaaaactaataatattattgttgtgtcaaatgtcttattggtaaaaaaaaacactgagattattgtattttaacactgtgttctgcaaaactgttttcttactaattgttctacaacttcggatagtccctcctattattaccacataaaggaaaatttagtaatttgtgagaagaaaatataaaaaggaatagttctgtc

SEQ ID NO: 6694 - DNA, 10280 bp, artificial
  synthetic oligonucleotide
atatgaaatgtcctatatatgtgtgtgtgtgtgggtttgtgtacactttgatggagaataagttgtgttattttattaagcaaaaacattgccttttatggtacataaaatgactcgtgtttccatgctattaaaattcctacgtaagtctaaattcttatacattccattctctttgtatattttccttttaagatgacaaacatttatttcaaaatatctacattttataagcattatactctagtatccagtttacttactatatatatgtatctgtatacatatgtatattcacttatacatattggtggtaacacttttctccttttattttagttttacatttctggagtttggggaaagaagctattgaaatttttcttatttcaagatatgtttacatgacctacttgcaaacttaacaaaatcatctgagattattttttcttctttcagtaaacttaccaaaatttgaacataacttgaaagtaatgattggtttgctgttttgattgtttgtagacaagtcctgtgccattagtatctaataaagtgagtgacattgaagaatttggtgacaagaatacaaactagtcaaaatagattgcctctatgtcaataattataaggctgcatatcaaaaaaatatagtcatatatatattctaggcactgtttagggatagtaaaagaactaaaaattgtgtacatacattttgttggaacacaatggaggtgaggttggggggtatggtgtatttccgtgtggtttgagtgcctgtgtgtgtgtacgcgggtgtgagaattactttttacagaaatataattaagtaaaagtaacttggcatgtaaaatatgagacagtgaaggaataggagcatggaaaactataaattttataattgtgccatgtttagacttttcagttatttcatagttattgtatcagacctaagactgtggcacatattaggttcaaaatgggaatgtagatccctaattctagatccttaattcttaatgcttttcaccatcacatgctatagttcattcacacaaatcactgtgttgtgtttcttttggttgacacagacctatccccaagaaaatggactcaaaagacaccaataaaagcttttaaaagtatttttataagcctgggaactgcaataacccctgtatctattaattgttataatataattatgtgaaatatgagtgaattgtgaagagacaggagtaaaaactgaacttttgggaaggaaaattgctaaggaacgaatgcagagtccagtcccaagggaaattggttagggtatccatttagcacagggtatttggtaatcaaacacatggactggaatacagtttcagaaaacattatgtatcttagtgatgaaagcaactgcttttcactttttgcaaacatgacattagtgaaccttctgctaaatcctctacactatttagtaaatctatatccatcagattgattgtctttctgatactgccaaagttcaggtgtatattaatttcaagaataattgaaactgaaacataccaaatagtcccatagacagtgttttattttttttgattaacatagaaattgacctttctgatcttaaaacgtgaaactcaccagatccagacaattacataccaggcctctcaaatggtatcaaagaattgaaactcaccagatcatcacattctgacaatgagatgtcaggcccctcattcatcatgattgcttccttaaccatcctgagtttcccttttccaattcattgttacatttcttccctgtatataatctaatttcagttagtcagggagatggatttaagactgatctcacatcttctttgctgtagcacttgattaaagactctcccttggtgataaccattatctcagtgattggctttctatacagccaacaggagtagcaggagctagactgaactcctggtgttactgaaacaccaggaaaattttaaaggaattcccatttgcaggttgaataagccctactgactgagagaggagggaaacaccctgactgtttcagtatggacgcttctgggggcttatgtgtaattgtgtgttttgtttatgtgtctgggcatgtcagtgttttttgtgggtaccagacagtgggattgactcctctcaatttgacaaattctgcagtaatttttgtttacaaattgaccaagtccacctaatggaaagggaagcattcagattgtttcagtttggacattcttggggcttgtgtgtttctgcagtagttggattgtgttttggtgattgtttgtgtgtgtttcatgaaaaattagaattcaataaacagatattcttttgtaacactgtttggccctaatattctttggaatctggagttttctattgaatgagaaagtgtgtttttttcaggatcttatgctgctgttctacgcaggtatgtgcctagttagtaggttccaggtgatgtcctgaggtgctgtttgaccctaatattctttggagcctggggaggtttgggtctttaagaataaaactgccattaaagttgctttacccaaaattttggttcacagcctacattgggttacctattggggcaaacaaagtttagtcatgtaaacatgttcatagacaggtaagtttgtattgctatctcatggctacagttcaaaggtaaaagctattggaaaaagctttgtgtacctgaagggaaaatagaaagctgaaaatatttagttaataaaatctttaaaacatgatagaaaactgaagaaatggcaattaacattgctcatagtcaaagctcttagtctcaatgaaggcaaactgagaactattataatgaaacacattggaagtttggctatttttttattatactttaagttctgggatatatgtgcagaacatgcaggtttgttacataggtatacacatgccatggtggtttgctgcacccatcaacccatcatctacattaggtatttctcctaatgctatccttcccctatcaccctatccctcccctatcaccccatcccatgacaggccccggtatgtgatgttttcctccctgtgtccatgtgttctcattattcaactcccacttatgagtgagaacatgcagtgtttggttttctgttcctgtgttagtttgctgagaatgatggcttccagtttcatccatgtccctgcaaaggacatgaactcatcattttttatggctgcatagtattccatggtgtatatggatctctctgcagagagtggatctctctgcagaaactctataagccagaagagagtgggagccaatattcaacattcttaaagaaaagaattttcaacccaaaatttcatatccagccaaactaagtttcataagcgaaacagaaataaaatcctttacagacaagcaaatgccgagagattttgtcaacaccagacccgccttacaagagttcctgaaagaagcactaaatatggaaaggaaaaactggtaccagccactgcaaaaacatacaaattgtaaagaccatcgacactatgaagaaaccgcaccaactaacgggcaaaatcatcataatgacaggatcaaattcacacatgacaatattaaccttaaatgtaaatgggctaaatgccccaattaaaagacacagactggcaaattggataaagagtcaagacccatcggtatgctgtattcaggagacccatctcacgtgcaaagatacacgtaggctcaaaatataagagatggaggaatatttaccaagaaaatggaaagcaaaaaaaaaaaaaaaaagcagggtttgaaatcctagtctctaataaaacagactttaaaccatcaaagatcaaaaaagacaaagaagggcattacataatggtgaaaggatcaattcagcaagaagaactaactatcctaaatacatatgcacccaatacaggagcacccaggttcataaagcaagttcttagagacctacaaagagaattagactcccacacaataatagtgggagactttaacaccccactgtcaatattagacagatcaatgagacagaaaattaacaaggatatccaggacttgaactcagctctggaccaagtggacctaatagatatctacagaactctccacccaaaatcaacagaatgtacattcttctcagcaccacatcgcacttattctaaaattcaccacataactggaagtaaaacactcctcagcaaacgcaaaacaatggaaatcataacaaacagtctctcagaccatagtgcaatcaaattaggaatcaggattaagaaacacactcaaaaccacacaactgcatggaaactgaatgacctgctcctgaatgactactgggtacataacgaaatgaaggcagaaataaagatgttctttgaaaccaaggagaacaaagacacaatgtttcagaatttctggggcacagctaaagcactgtttagagggaaatgtatagcactaaaggcccacaggagaaagtgggaatgatctaaaatcaacaccctaacatcacaattaaaagaactagagaagcaagaggaaaccaattcaaaagctagcagaggacaagaaataactaagatcagagcagaactgaaggagatcaaggcacaaaaaaaattcaaaaaatcaataaatccaggacatggttttttgaaaagattaacaaaatagatagaccgctagccagactaataaagaagaaaagaaagaagaatcaaatagacacaataaaaaataataaaggggatatcaccactgatcccacaaaaatacaaactaccattagggaatactacaaacacctctatgcaaataaactagaaaatctagaagaaatggataaattcctggacacatacaccctcccgagactaagccaggaagaagtcgaatccctgaatagaccaataagaagttctgaaattgaggcagtaattaatagcctaccaatcaaaaaaagcccaggatgaggtggattcacagctgaattcaaccagaggtacaaagaggagctggtacgattccttctgaaactattccaaacaatagaaaaagagtatacaggactcactacaagggtacctcatttactcagccttccactctcaacttcagatgagaactggagtgtgcaagcactggaattggccaactggtttggtgtcagcaggagtgagctccatgtgggccctgtggcattgtccacgtatggatgcctgtgaccccaaagccctagaggtcatgttaccagtgctctttaagctgtgtcatccatggatggcttaagtgtttgtagctcagtgggcactttgcctcattgtgtggggccgctgccctccaccactgaggggaaagggccagtgtgacagccttttgtatccacttgtggctcccaagctcctgtccagagtccaggaaaaatgaggttaaatgaacaagttgaaggatgatatatgcagggtattttattgctgattaaattgcctctcagtgggaagaggtgctcaaaaggggatggggaggtaggcaatcctcccctgaagtctggctgtctccagccagattcttctccaaggttacaccatcaagctgtccctccgaaatcaagccatttttctccaacatccaaccatagtctctgctcctctccaactgaatcttgggtctttacaggcacataatggaggacagggtgggccatgggtagtttaggaaaagacaacattcaagcaggaaaacagggatataagttctcattttaggccatggtttcaggctttttggcttgagggtttcactggggacctgcccttttctgcctagaatttctctgcctccttcacctatcagtacaagtactaatgtacttattggtcatctgcctacagtgaatttctcaattgcacaaaatatatattggtattgatcaacttgaagacattaatctgtataccagaaacaaaatgtccattaggtgtttgttttaggctctgggtaacattgtagcctctcatataaactgagtaggagaaataattggagtcggttttctgtttatttgtttttgcttttaattttcatttatttgctgtttgatctttttggaattttaattatatatacatatatataaaaccattgatggtttttagtttctaatggaaggcttttatttgatcccatgaatagccatttattggcctatgcatttccaacaattcatcatctgttctatttatctaaaattccaagctgcctatgtcaaacctgcaaaaagtaagtaatagaggacgtcaactatttaaaatttgattggttttgtttacctctgacagagagctacaaatgctttaaggtttctgtaaaaataaaataaataagatttatttttacatgttttgagcagcagtgttacattacttcatttgaaaaaagtaggtgagaataaagatgtttaaataatgtttatttccaaggtaattcagttcaatcaataatttgagttggtttcagatctttttatttagggaatgaagaaaaattatgacatggacgtaaagttttaatgttcagaaaagtttggtcttgcccttaaggaaattatactgactgtgatttctctcaaaccaatttagttgtatttaacattattaaaattcaatgacatttgcttgggttaagtcataataaaaaaagtatgactttctagtaatttttttttatcccaagccatttatcactgataggcctcgatgtgtataattgaaaatgaaatatgtacaagtgttaccctggcttgaatattttactggtgaaagttacctaatcagttgtctgtactgtatctagaaaccaatcttggaaatgtgtgatgatgtccttttaaaacagttgaaaagaaattactgtgtgcttgttcttaatttgtccctgttttgttgtatagtatttaaatgaaaggagattattttttctcacactgaatttccaaaactgataactgcatttataattttttaaatgatgaagagaaaccttagtcatcttactttgataagtttggagcaggaactatcacaaaagtttggatagtaggaactatccaaacaaaagtttggatgcttttgatcacagttttgtcactagaatgctagcaactagacatgcaataagtaatctgactaacttaatacacagtggtttcaagtgcagcaggcagtagcctctgaacaccaaatcacagtgttttaatttgtgaaacgatagagaaaatgatagcactttctgtggtataaatatcttattaacccatccttgtgctgttaagttatagggctttgaatcctggaacttaacagcacaaagtgcctttgtatctgaaaaggcacacacgatagagaaaatgatagcactttctgtggtataaatatcttattaacccatccttgtgctgttaagttatagggctttgaatcctggaacttaacagcacaaagtgcctttgaatctgaaaaggcacacacttctgctaaattttgagcattgacaacagtctaagctgtgttttgagaccacagagaaagtgaaaatcagaatgaatgcttttgtgaaacacagaacaagaagtttgaaccgttcaatctctctagactcagggactatcatgaaacaggtgggcacatgaaattttaagggccaattttgtgagataaaatttgttcagagttttttttatatataaattaaacattaatattaaaagcacactgatgtaaagccaacatctaggcctgtgtgtaaaaataacagggttttcttggagcattgatctgctctttaatagagttataaaagatttaacagaaattttatcttatggtcaaactgattaaaattagatagatttgtttttaaggttttattaaattttattaaaattagctttaacattaataatacaccatacaaaggtaaaatttggttttcttctttggagaaaattttcatgtactggataataggagatttttgtttaccatttgattacactgcgggggaaaaaggatagggagagacaaatttatttgacctcatgctatctttattaggtttcattgtttgagaaacttcgtctcatcactatcaaaggataattgtttttgtggtatcattctggctaaatgaatgactagtttgtagtaacttgtggttctattttgtagtatcaattgtcttaaacctttgatagttgaaagattttccaacagcaaaatttcaagttcgaaattcagtctttttaacctcatactaacttttttttttttatattgggtcccctgaagaccaacagagacacattaggcttatttggtaagttagaattatacaaaaatcattgtcaaatgtgacatagtatttaacttcttttgggttatatttataaagatgtgttattaatacgtgttctaggactgtatgatattcctgaaattctgacataccttaatatatttgttaagtaatgattataattatgttgaattttttttttttgccaacagaaattacctaatttcctcatcaactgtatctttaactatgactgttttaagacttttgtcatccacagttgtttcttgttgattcttgttaaaaagtgacttaaaatcagttttaatccagggcttgcttctttggggcagtttatggaaggaactcatgaataaagaattctgataactttggagattgtgccactggattagaaagaaaacttccagcagtctaattaactagctgatgtgtttataaagactgctaacaaaatatgaagcacagtaggagctgattggatggtctgaactaatggtggactgacataatttttatggcttttttgcttgaaatattgttgattctttgtttttcagaatctggagaacttttttctttagagctatttataaccttgaaatatactttaagtatattgaggatagattgaagattttgagtcatagtcctctctctctctgcctaaaatttgtaaactatttgtgaatattcttaattcatggcaatgtgattgtttgtatatgtttagtaagaacttgttttcttttataaggggatgcagttggaggaactgattattttccaagggttttgactgaaatggtctgtgagaagtttcagcaaagccaactcaagagagcctatttggacaataattatttctgcactttatgtgggtaatcaggccaaatatatgggactaaatcttattttgcaggaaggtttgtcctattataattggtctttggtgaaagtgggtgactagagagagaaaaattgtatttcaaaagaaaactatagtaccaatctttgatttctccatggccacatgatcacccatggtatggagtacccacaatgcccctcctcagcaggaagaagccagaatgattgatcatcagaatccccatgattgaggaattgataaataaaagggggggggggaggtgctgaaaccaatctaatagtcacataggtttttttttttataaaaatggaaattgaccattctagtcttaaaacttgaaactcaccagattaagacaatgagatattagccctctcaaaaggtatcaaatatcaaactcatcagatcatcacatccggaccatgagacaccagaccactcattcatcatgattacttccttacctcacctgaattcctgttttcctatacatagttacatttctttcctgctatataaacctctaattttagtcagtcagggagatggatttgagcctgatctcccctctccctggctgtagcacctgtttaaagtcttttttcttggcaataatcattgactcaatgattggctttcagtgcaatgaacagcaggacctaggccaaatccctagtgtttggtaacaaaactacttctcagggaaattaaacaatggaaaatagaagaaaactctcaaatgagaaaatcagtcttcactatgcaatgattttttctcttgcactcacatataaaaaatgctaactaccttagagatacttgagggtgaaagaagcaatatttctttgatatatgttacattgtttattttaagatgacagttttctaattgtttttgaagtatgatttgtttggctatttcttttttgaaattctagtt

SEQ ID NO: 6695 - DNA, 471 bp, artificial
  synthetic oligonucleotide
tgtatagtagtaggtggcaaatgaaattacatggaccccaataaaataagtgagaaaggatgaaagcatgaaaggtattttacattgcttctacattcacagtaagtagaaaagcattttcatgagctgaaaatagaaggagaaaagatgttgaagtttggagcagagagaagaaactgtgaaatagttatctagattctagaacaatgggcgaggtaaatggagtaggattgctagacagcattaaggtgctcccttatggttagtggttatgtccatattcataatataactgttcatctacttttctgtttcctttctcttattctctcattctccacttcttcttgttatatattcatatattcttgctacttccaagtgtaatcttaaagcataattctatcatgccattatcttattcatttttttttaaattttctggcgtggattacagaataaactataaaa

SEQ ID NO: 6696 - DNA, 964 bp, artificial
  synthetic oligonucleotide
actcaaataattgcttgcttgaaattttaactgtaatctggggctgagaaattggggttgtgacaattatgttttaattgatcttgggtcatacatttttagggtattgctaaccttttctggtaaagcagtttatcttgctatatatgcaaaggttacctagtgttcaagttgttggatgaaatttcaaatgtttttaaatacataaaacaatatggaatctctccctaaaaaaattcttcagtgaataattaagaacattatattaaataacttgtcagtattaagaattcataatttaaaaagagaggagtttcagatcaattgaatacacattttgaaatgcaaaaaaaaataataattttacagttgaaaaaatggaaaacatatctgcgtcagatactagttaatacattctctccagagagagagccctcacagaaatttctaaaggtgatgattagatacaaaaggataaaaaaaagtcatggaaatctttcataacaactctgaaaggagagtcattttctctgttgcaccattgatgtagatccagaggaacaatgagaatgtagaaaaggtggcaaaaagaaagacttggcccttggaaatataaacttgtggcacgcattgaaagttcattaaaaagtgtcagtatttaatgctagaaattatctcagaagatacattactgcttgctttcttaatttcataggtactatctaaaagctccagaacttcttagaattattaaggtattaaagcaatattataataacaatgattctgaaatgtgttataatgatttgatttttgaagctccctttgtttgtactgagttagacacccaaaattttctctttccaaggtgtattggtaaattttttaattttctatggcacaaatggtagatcatacctattaaaaactcaagatgtgcatggcaattgggctggaggactgt

SEQ ID NO: 6697 - DNA, 5350 bp, artificial
  synthetic oligonucleotide
aggtgaatagaatttgaatttagatgaaatgaataagtctatttcagacatatattctaacttgtgtaaatgtataggaaaggcatatagataaagttggaggaatcaaatcaattcaatatggctgtagacataaaatgtaggatgaagagtgaacagggacatgatcaaaggaagatgtagctgtcaaggcatttataagcttggtaagtcatgtaaggaatctgaactttaagagcaatgaaaaagattaacattgaccactgaagtgatgtgatcagagtaaggaaggtgagttagtactgtggtcgtaatacaggtgactgtaatggtggtctgaactaatttaaaattgaatagccataatagacgggcttagtaattgaatagatggtagggagaatacagctatcaaggatgattcctatgtacgtacgtaaggcaactaaatgggtggtttttaattcactgatacagagaacatatagtaaagatgatgaacagaaagtggaaatatgagaaataggggagaatcatcagattttggcaacttgtgtataatggataatttttacttaaaattctgaaataaagactgttttctaatttagggtagaatgtttttatttccatttttaaaaccgaaacaatacaggttttaatatgattctgttatattaggattttattaatacaccgactctctgttgcatttatttgatagatatatctgtcatactggtattagtatattttactaagaaatcaagttggaggtagatcttaacaaataaaaggctcagtgaaaacaataaagtttcttgttgtaaaattatgcaaatagcaagaatgtaagtattccaataacaatgtagggttgtacaccctatggttgctattacttcttcctggtaaaagtatttttttgagacatagtctccttctgtggctcagactagagtacagtgacatgatcatagctcactatagcctcaatctccccagctcaagcaatcctcccacctcagtctcctgagcagctgggactataggcacgtgccacaaagcccagctttttttctttccaaatttattttaggttcaggggatacatgtgcaggtttattacatgggttaattccctgtcatggggaattagtgtaaagattattttgtcacccaagtaataagcatagcaaataatagatagtgtttttttttttttaatcctcaccctccttctaccctcaaacctcaagtagaccttggtatctattgttatcctctttgtgtccctttgtactcaatgtttagctcccaattataagtgagatgatgcggtatttggttttttgtttccgtgctaatgtgcttaggatagtggcctccaccttcatccacattgctgcaaaggacatgatatggttcttttcatggctgcatagtattccatggtgtatatgtcccacattttctttatccagtctaccattcatgagcatttaggttgattccttgtcttcaatgttgtgaatattgctacaataaatatatgtgtacacctgtatttatggtagaataatttatattcctttgggtatataccaagtaatgggattgctgggtcaaatggtaattctgttttaagtatttggagatatctccaaactgcttttcacagtggctgaactaatttacattcccatgagcagtttatgagcattcccaagtttttcagtatctgttattttgttgacattttagtaatagccattctgactggtgtgagatggtatctctttgtggttttgattttcatttctccaattactagggatgttgaacattttttcacatgcttgttggtcatgtttatgacttctgttaagaaatgtctgcgaggtcaggatttcgagaccaccctggccaacatggtgaaacactgtttctactaaaaatacaaaaaattagctgggcatagtggcagcgcctgtaaccccagctactctggaggctgaggcaggagaatcgcttgaacctgggaggcagaggttgcagtgagccaagatcgcaccactgcactccagcccgagcgacagagtgagactccatcgcaaaaaaaaacaaaaaacaaaaaacaaaaacaaaagtctgttcatgtcgtttgcccatttttaaaatgaggttgtttgcttttggcaagttcatttgtttatgtcctttatagattctagatacctgacatttgttggagtcattcagaagacggttgtttaattttgatgtaatcatgtgactttgagagatcttcttagtgctggtttctatgattatttcactgtggtctgaacgtgtggttggtattatttgattctttgttgaatttgttgttttatggccaattgtgtggtcagttttagagtatgtgccctgtgtagatgagaagtatgtatatcatgctgttgttggtagagtgttctggagatgtctgttaggttcatttggtcaagtgttgaatttaggtcatgaatatctttgttaattttctgcctcaatgatccatctaatactgtcagtgggttatcgaagtctcccactattattgtgtgtttatcagtctctttaagaactttaagaacttgttttacaaatctgtggaccccagtgttgggtgcaaatatatttagaaaggttaactcttctcgttgaattgaatgctttatgattatgtaatgcccttctttgtctttttggatcattgttggtttaaagtttgttttgtctgaatttaaagcaggatcccctgcattttttttcctatttccttgggatatttttctcttttcccttatgttgagcctacggatgtcattgcatgtgagatgggtctctcaaagacaacgtacggtttgttcctgcttctttatccaacttgctactctgtaactttaagtgatgtgtttagttcacttatgttcaaggtaatgtaaatggactgtgttgatagtttatcaactaagcattgatagtatgtaaatggactaaacacactaaatatactaaatattgatatgtgcaaatattatcctgtcttcatgttgttatctggttgttttgcagatttgattgtttagttactttacagtgtcaatggtctatggacttaagtgtgtttttgtagtggccagtaatggtattttgtttccatgtttagcactcccttaaggacctcttgtaaggcaggtatggtggtaatacatttcctaacatttgcttatctgaaaaaattattcttctttgcctatgaagcttagtttagctggacattaaatttttggttggaatttaatttttgatgctcaatgtaggcccacaatctctccttgtttgtaggatttctgctaactggtttgctgttagcccgataaggttacctttgtaggtgatctgtcccttctctctagctgcctttaatatttttacttttgtgttgaccttggataatctgatgactaggtgtcttggggatggttatcccataacctgtgtctcacaggggttctctgcatttcctgaaattgaaggttgacctctctagtaatgttggggaaattttcatggacaatatcctcaaatatttttttcaagtttcttgctctctttccctctcttacagggatgccaatgagttgcaggtttggtctctttacataatttcatatttctcagaggttttgctcattgattcttattttttctttatttttgtctgactgagttgatttgaagaacttgtctttgagctccgagattctttcctcagcttggtctattctgttgttcatacttccagttatattatggcattcatgtagtgaatttttagctctagaagtttagtttggttctttcctaaaatggctatttcatctttcagctcttatattgatgtattaaattccttatgtttctttgattgggtttctactttctcctgaattttgatgatctttgttcctatccaggttctgaattctatgtctcttattttagccatttccacgtggttgaggactatttctggggtgctagtgcagtcctttggaagtaagaaaacactctaactttttgagttgccagagttcttacactggttctttcccatctgtgtgggctgatgttcctttaatcactgaaggcatcagggtgtactggttgtggtggtggctctgtgtgttccaagtgcacaatagtggaggcagagcagcagttcaacataaccactcatgcatgccagtggcaatgagacagtccacatatacgcactgacagagcagtggaggggactgtgggtgagtatgttccagcaaagcaataggaagaggcttctggtgggtgggggcatgtttgttggggcctgtcagctgaagctctctgacagttatgaaaggtctgctagtgaaggagctgtggtggcagctgccaggaagcactcctgttgagcgttcaaggctacaatgctagtgggcatggctaggcatgatccctgagagaggctggcagacagggaggttctcaggtcatactggccccatctcatgggcaagactaccctgttttattccaagtccaatagtcaacaaaggccaatctcacctagaaaagcatggcaagccttggggaacgggcattcctggccatgttcatctgcagccattccttcgccaaaccatctgggctccagacagtctggagtcctgtccctgatacttcttaaagcagccctccctttcaggtcaaatatccatgggggttatcagatctcctgcagctaggattctacaagtctgtggtcagattggaccacttctcgcctgtttaactcatccctttcccaagagctgtttgggaccaggaactagtcctggtgtttgtcagcctcatgcagggttctcagctttctcctctttcagtccagagtctgcattctccttctgtccactctcaatgcccttcttctgaagatctgcttggagtatgctgatcttctcgatggtctggtattttggtgagagatgctcttcctggttgcatctagtcagccatcctggcttttgtctccatttttttttgtttttatttttagtagagacaaagtcttgctatgattcctaggatgttctagaactactgagctcaaataatcctcctgcctcaagctcccaaagtgctgggattactggcatgagccaccacaccaagccaagacttcttaataatgtgttttacagttattcaaaattattttctagtagaaagatgtagattacaagtttttatatttatttgg

SEQ ID NO: 6698 - DNA, 2886 bp, artificial
  synthetic oligonucleotide
tttttcctcccactgcttctttgtaattatatattatactgtagattagcagggtagacaaattaactacaaatgcctaagaacacactgctaaaatcattaattcacacttcgaaatgataagcaaaatgaacattataatgttcattactgtgtggtcacatgcttttacagaatgcagctatgtatagaatagaattcagtttttcttcaaacttttgactctccagaaatggaacataaacagtcaattaacacagtcgaaaaagagtagattttatatactaattacatgcattatatactgtattcttacaataaagtaagctggagaaaaaaggttagtaagagaatcataaggaagagaaaatgtatttactattcattaagcagaagtggatcatcataaaggtctgcaacataaatgtctgcatactcaccttgagtaggctgacgaggaggaaaaacaagaaggtctggtcttgctgtgtcaggaggggcagaggtggaaaggtggaagaggcagaaggggaggcaggagatgcaggcacactctgtgtacatttacagaaatatgtcataatttctttctgaatttttcactttttcatttctctaggagtttttctatacagtaccgattcttcttccattatttgctttagtttcactggccatatcatagaaagggcaatgtcataaaagaagtcaaatgcaatcttgaatcattggaacctttctgccagattgccttatgtcaatttcttttctggccctgtttctatgtcttcttcttcattgtctggcactggtttggaagcactaatctccatcaagtcattttcttttaatttgtctggtgtggggtctgtgagctctagagtttctccaagccccatatcttcaaagcctaaacccccctaaacacattttttttaacatattcacaatatctttcatgatttccctggttagctctgttgtaagtcctgtaaagtaatgcacgacatctgaaaacagttttctccagcagaaatttattgttttgggcttgatggctttcatgtttctttctataacaataatggcatcttcaatggtgtaattcttccaggctcgcatgacgctctctgtatccaggttctctttcatagtgttcacaatcctttccatagagaatcacgtgtaattagccttaaaggttcctatgagccctgatctagaggctgagcttgacatattgcatctgggggaaggagaccacttcaacacctttggtgttgaattcacggggtttcaagtattcggggacattgtccaatatcaaaagaactttaaaaggcagtgtcttactgtagaatacttcctgagttcagagacaaagcatggaaggaatcaattcaaaaacagggttctcattgtccaggccttcctactgtacaacccaaaagactggcagctggtgcttatattttctctttaaggcttagaggtcagcagctttatagataaaggcagtcctgatcataaacctgactgcatttgcacaaaacagtagagttagtctatccattcctgccttacatcctggtgcttgattctcctctttagtaataaatatctttggtggcattttttcaagaacagggcacttttctgcattataaatctgttcagttagttatctcttctcctcactgttttttttaatggcatctaggaatttgtctgttgcttcttgattggcagaagctgcgtcttctgttattgttacatattttcatccatacttctttctaaatttatcaaaccttccttcgctggcattaaatacttcagcttccgattcttcattttccttttgctttaaattgtcatataatgactttgctttttctcaaattatattaaattgtgtaggtctgccttttttagtaacaattctgcacccacataaaagctgcattttcagtgcaagacaaaaagatatttcacaaaatgtgaaaggttttcacatctgctgggataccagtaacaatggcttcatgtgtttctttttctttttttacagtgctccttatgctggatccatttacctttaaatggcaggcaactgcagctgcagacctcaatctacggtacatatcaagcaaatcaactttttcttgtaatataataacttttttctgcttcttggtagcacttccagcatcatcagtggcacatcatatgaatcccatgttgttactaaaacggtgttacactaaacatgatgaaaatatgcaagaaccatgagaaatccctttttactgtgacgcacaatttactaaggagacaagctgctcatgtggagatgatcagcagcacagggcattttaagtgaatgctgacaacacgagctcactgcaacagcaacagaaggtggctatgaaattgtagtagtgcaccacatactacagttaattttatggagttgtgatttaataacatatctttatgtttgtctactttcaaccgcaaatgacactatgtaaggtctgtaagtggttgtatgaataagttttgatgtattttaactttttataacagatttgtgtgtattttatggtgataaataataaaatagacaagtatctaggtattttatgcatttgcaacatacataactttttgttatttttttctatatgtctaagatatgtggcttgtctgtgagttttttcaaattgttgcaaatctccaaaatatattccaacatatttattgaaaaaatctgtatgtaagtggatccgcacaggtcaaaaccatattgttcaaaggtcaactgtatatcagggttgattttacaaaagttaagaaagaagagaaagatctagtaaaataatt

SEQ ID NO: 6699 - DNA, 1424 bp, artificial
  synthetic oligonucleotide
tatttaaaattctgcatgccatagcacctcttcctttaagagaaaaaatcttcaggatggacaacttggatttaagcctctgtctgtcccacttgttagtcctttgtgctgtgaacaattgtacaaccctacgtagcagccctgagctatagcttctaggggtcatgaagcattgcctttaccctttgacttctttctcttcttagaacctttcctgtcctgctcaatcctatttattaaacagatcctatcctcataactgacctcctcaccttcatccaaactctagtatttatttaccggtatttgacatttttaatgtgcatttgataatgatttgtacataacagttgctgtggaatacatcttctatggctaacttatttctgccattggagtcatgtttttcccccatgaagtgtgccattcaaatggaccttcttcaataattcaagaaattcaataatttcttattttattttcaactaaatgaaaactgtaagttcatgagagtagcttatatttttttcttcatttttactgccaaaaatatggttgctaaatcccaatatagacaaaggtcaattaaagactatgtaattgtgctactaatgttattactgaagatatgttaaatcacatttacttttgcatgtgtgttttggaaagaagctttacagttgagaaaaccataagggtagaaatagaatacacacagaaaagtatgaaaaaatgcttctaatagatctgatagagatttagaaaaacaattgtttaaattagcacaatccttagggctgaattggctgggatctagaaagaacattactcacctttcaagggtgttaaacttctaatggactgagacctcatccagaaaacatgggaatttatgctttctcctggacagaaaagcatgtatcaacttcttcagttgcaaagtctcacagtaattgaccaggaaaactacaatttctatacaaatgctagatgaccataatccctcctcacgcaagtaacattcctttctcatgtatggacattgcaattcataaaagggcttatcacacacatctcagaggatatataactacattgcagcaaggcctttggcattctaagatagaggacctaggttattaaaagcacagatacagaacactggcaggaatgtgtgttttcacaaaagagtgtgtgttttcactgaatagcatatattgcaaattgatacagtgcagtttggtagaaaagacactaatttgaatttaggatatgtggattttaattcaagccctgtctccaaatataagctcctttatttagcttgaatctcagttccatcagttaaatgggaatgcaggtctagatgttttttttaaggtctcagtgagttgagaacctatggtgacagctaaccgggggtt

SEQ ID NO: 6700 - DNA, 5698 bp, artificial
  synthetic oligonucleotide
ttttcaacagactcaatttcttaggtaattttctggattgcttagttcaactagtagagtctccttggtctgtaagtaatgtttctaatctattcagatcatttcctattggactatacacctaaaactaaatgctctgctccatattatatatagaagaattcagattaactataaagtaaccatgtagctgaatttatgagttatataccctgaatagaaatctagagtctgttactctttagcgtcatggtcttgtgcaaatcacctgtcctctatgaatttcagtttcaggaattgcaaaatggaataataatattaacctcataagtctgtcatgataactttaaatactttaaacggtgacaaaatagttctcttctcctgcctagggattaaatggaaatcttcagaaatcaattaattggtatctaatgtggatgttatgaataattcttagtatttgaaagcactcccatagcatgcctgtgccacactgtccctggatcaatcagtgattttatttgcattgagttcctgccatctcccatgacacagtctcatccagtattgcaatccccaagagtcagagctgtaaccatttagcagcttctgatttcccctctcagacatttcctagctcccaagaagagtgcaatgcatgtgctggatactgtgaataatgaagggacggttacaggaggagcaaaatgtaatagcgaagtgtctcctcacacctgtgcaagtaaatatttctctgttttctttcatgcagacctgcattgagctgcggtgctgatgtttctcctagtagcatggctttcggtataaaaatatgcaaaaaagtgacgtgaggaatatttgaaccaaggttttaaccttcaaaatatcaggaatgggaaaggaggcagctaagaagatggagaaggatatactggggaaacaagtcataaggatttgcctttcagttaaaaaactttccctgaagcagctattagagaaaagcaacttattataattctgaaaatttttccttcttgatgttctatctctatgcagatgtcatctcctcttccattcagtagacaaaaaataaaaaatggatactgtgttattggtgctctgaaacattctctactttttctccttttatttcaggaaaaagagccacctcctttcaaataattgcacagcaccagaaagataagtttttctacaggataagcacggaaagtggattttccccataaaatcgtacacctttctggagagaggaatttagaaaattcacctggttaattttctggcgtctgggtaaatttaaggagttgttccttgaaacaagaataagagttgaccagctggggtggttttgatgttgttactactggttttttaatcacatgccaggaacgggggaattggcccctacttccttatatccacgacccttcgaaggcataaaccagccacattcctcctggtacctttagtggtccttggggacctggcacccggatgcccacccagccgtcgcccaccaggcagccagagctggctggcaagcaccaggcatgaggctccgggctggtttcctccctctcttgccccctttcctaccttggaaaagcgccgtccatgcccgcgacgctgcctggtctctggcagcaatgccacctgactcactcctgcttgctgtctggggtagccaaatgctaggtcgctagaacttctccttccctccttcacacacacacacacacacacacacacacacacacacacacagcccttcgctgctgtcagaggattaatctggaaaggcgatcgaagtaccagaccccgctcacagttgagtatgatatatgcggacagcctctcagctccaactgtgactttgccaggcttctgcccctactacccctagtctgccttaagtatcctttgtatgagaaaatggtgctgtgggatgcttgttctctagctggagtcggcagccagcggtatcacaagaaaaacacacaagaaaaatcaaacttctctgagaaaatgtgaatgggtgaaacttaaagggaagcctaagagaagagtgagcagaggaccgaggagaacattgtatgcccagggttttgctcaggaaagctagcagcccgaaagcggcgcgttttcttcagcagcgggtcccgcacgcgagagtgctgccagcacgctttctgcctccttctccaggaggcgagcagtaacttcctaagcttacctccatctctcccccgcccttcttgctggttctccgtcagcggggaggggccgcccccggatcgatgggggatgtgaggtgcagggagtggggaccagaggggggtactcagcagttggtgctgcgccatcccttcccagcaggcggcccggacactggttcacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgcagctgccaggtcgccacactcgccaagcggcgagggagcgcctttgcctaccaggccggagaaccctgttcttcagtcgccttggcaggggcagcccctccttctggcaatgatgtcagctgcagagaggcttggcccggccgatgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaacccagatttggggtcttccctcctccatttcctcctttcctccgcgccccagctctctccctttttcagcctgcaccttcactattcacagtgactttacttatttagcaacattttagagggcaagtgttccagatgcaataatagtagtaactggtgttaaatttctgctgttttctctcccctcgggtgataaaaaagatgtgaagaacggcctctttaaaaaaaaaccccgtggctgctgcttcgcctgtcacagagc

SEQ ID NO: 6701 - DNA, 8158 bp, artificial
  synthetic oligonucleotide
attgtttagcattgatcagcacttgaataaattgagttgctatcatattaacataagtagcaatgctttagtgagattttctttcttcctttcttttatgatttatagttcttgaaacaggaagtcagtttagaagactgcagagttatgtatccaactattacttttgaaccaacctaatacaatgataacagaaggctgtgaagtacattctaacaactgtttgcatattccatttaaattcccagatttgactgccagtatggatttgttgtcagacttcctgtcttctctgtggtcagacatgcctatctttgcatttttcaactctatatgtaattattcttgtctaccaaatgagtcaaactctctaaaatatttgaagagatttattctgagccaaatatgagtggccatggcccgtgacacagctctcaggacgtcctgagaacatgtgcccaaggtggtcggggcacagcttggttttatatattttaggaagacatgagacattaatcaaatacatttaagaaatacattggcttggttcagaaaggtgggacaactcaaagtgggggcttccaggctattggtaaattgaaacattttctggttgacaattggctgagtttatctgaaggcctgggatcaatagaaaggaaatgtttaggttaacataaaggattgtggagaccaagttttattgtgcagaggaagctctcagatagccaacttcagagagagcaggttgtaaaatgtttcttattttacaataagacctaaaagagtgcctggctcttagttgattatctcctggttctggaaaggaaggaaggaagacaaagaggaaagaagattctctatataatgtggatttttcccacaaaggatggctttgcagggccatttcaagatatggcaaggaaatatattttggggtaaaatatttttaatttcttccttgttattcccgagtcagattggaaagtaagtcaagatatacaaggttaaataatccccatttgatggaatttatggtttgtagggtgtgactccccagaccccttagacaggaatttgggcaagataaaaaagttagagcttagtcctcattctcaaatctaggtagtttgacgtggttgtataattgcccaatatctcagcaggcaaggaactgcaatttatatctttcagaactttacaaggtaatacactgaagacaccagccttactctaaggaacacaaacgtatatagtagtgatctctgtgtgatgtgaactctgaaaatttgagacaagtcttagttattttagaaagtttatgttgccaaggttgaggacacacgcccatgacagccccaggaggtcctcaaaacatgttcccaaggtagtcaaagcacagcttggtttagtacattttagggagacatgagataccaattaacacatgtaagatgaacattagatcggttggaaaggcaagacaactcgaagcaaaagcaggatgactccaggggagagagcttccaggtcataggtatatgagacaaacgtttgcattattttgagtttctgattaacctctccaaaggaaacaatcagataggcatttgtctcaatgagctaaggggtatcttcgaacaggaggcagatttgccctaagcagttcccagcttgacatttccctttcgcttagtgatttcagggttccaggatattttcctttcacagagatgtggtttggatctgtgtccttgcccaaatctcatgtccaattgtaatccccaatgttggaggtggggcctggtaggaggtgattggatgatgggggcggtttctcatggtttaccaccatcccccttaatgttgttgtggtaattgtgactgattgagttgttgcaagacctggttgtttgaaagtgtgtggcaccccaccactcactctcttcctcctcctatggccatgtcagaggtgcctgcttcaccttctgccataactgaaagtttcctgacgcctcctcagaagccactatgcttcttatacaacctggagaatgccgagccaattaaatctcttttcattatgtattacccagtatcaggtatttcttcacagcaatgccggaacagactgttacaaggtgtatatagagaaatgtgactattgtgtggcgagagggtacgttttcatcctcacatgctgaaaagtgagaagaggaatatactcgagaatgtattttgatacataaatattatttcattgcttttcccttttagcataatttgcacattttaaatcatgtaaccatttcagagagaaaactatattaattatgagatagttttatctacagcttgaactatagaagaaatttattactacatcagtgtgaaccagaccatatttaaatagattatttaacctgtggacaacagggttccagagtagtggtaagaattccgtaaggaaattacctttattcttggcatagactttgcctagtaaaaagtgaataggcacaaatgtctcctatgattttatacctaatcactgttccctcttgagattcatctatgcatgctcagcccttttaatggtatttttttcaggaatttatctgtatgaaaagcagtagcctgagaaaattagttacagatttgccaccaagaatgataaatgtctagtggagcagaaaagaggcatagaacatgctcagactcatcacggaaagtgactcaattttccagtgtatcagcatttgtaagagaaatatatagaatataaagtgatacgcaagagatgaactctccaatcattttaaagtgccatttgggtattatacatattaaaatgtccacatttctcatttaattaggttattacaagatacaaatttaatatgcctttactgaaactcatgacttctttttagtcctaaatctagctgttttcattaaacacaaattatatacgaattttttattcataaagcttcattcctttttacctatttatattttgctatttaaaaatatccagcaccacacaaaaaagtaatatgtgtgtgtgtgtgtgtgtgtgtgtgtgtgtgtgtgtgtgtgtatatatatataaaacattaaattaaaaaatagtaatatctagcatggttgttttgttgacatcccacacactggtttaaataactgaaaaaaaaatggacaacagcattttatcaagacttttctttgcaaaccatttgaattattttataaaatgagtagagataggttacttaccattgcagaatctgtttctttagatattagaaatagagatttgattttgagccataacctcttgcttaaaagtattcttatgccctatgatatgcaggtgttattcagatttaactgtttatctctatctttgaggatatacaggtatatatgaggacaagcccacttgttctctcttcctaaaggaatacacaaaaaatcagggtgtagaaaaatatcttatttctccctcattttatacactaggacaatgtgagacatttaactgctctatcatgtccactactaggctgtctgccaattggatgatcatactttccaattatcctagactctagtacttcagtgtttaggacagttggattttaacaacagaattcactaggacaatatgctatgccatcatgaataccttctggctttggggaaaaacaacaacaactgtagtgctttttatgtacttggagaatattttgaaataagtaaagtattaatttctaatatctagaggtttagaaaaacattaacattcctctttaatttgaatgtttatgatgtcactccacaaacacacatattattatcaatatttaaattacatcaaagatatatccaagaacaaaggcccttcattgcagtatacatggtaatatatgcattatcaactgaagaacacggagcaacaagtgaattctgtagagatttcagctaataaaaatgcaagtccaaatcccaaatccgagtcctcctatcccctaacccccaatccccagctgtggtgaaatttccagcacaaaaatgtctaggttgtcattagtgtttcaacaaagctaatgcatttactcttccattgctcactaattttcaggctttttctgcatttcatatcctctctttgtctccttacctgctcttttcttctttggttacttttgtgacattttgtaccacatgtccttagaattctattcctaatattatgtttttttctccaaaaatacttttcaaatgttcttcacaaggttctagtttgttgtttagaggtaggtacccctgaataagatatatcttttaatgtatatttaataaaataataatatttcattctggggctagtatggcacatcccaaaggaaggaatttgcatttctctctcatactgtaatttttattgagtttctcatctagaagtaacctccttttgatgttgtcaccactatagtcctaaattaagcctacttcaaagctttaaacaataaaaaattctaattcaggcagaaagtcagcaaagatacagtgaacatatgctataagcatgaaatttgaacaatctataatataaaaatatacgccatttaaaccttatgtcctacatatcaagggtaatgactttgctttttagtaattaaatttgtacacgtagtgaaattgctaatggatattgattgacaaggcaaaaatcttcactttgagaaatcttccattttcctagaaaaatcttagagaagttatttaagtggcaacaaagttgattctgaattactttttgctattcaagttccaagacgaagagaatcattgagcacttttaggccaatcatcatgcattttttcttttagaaacaaagttaaggtgttcaacatctttagacaagttcttgaatatactatcacaattattaaagattataaaactacaaataatagaattagttacttatattgttatcacagtgggcatcaaagacaagatgtttcccttacatatatttctgaaggaaagtaaggttagattgaaatgttgtttgatattttccaaaatgcaagtcacttgctgaagatcaatctgccttcatatttcagataatcaagggagagtctgtctaccttattcacaaactgaataaatagagattcattctgaatgatatatgcaggcccctttttcctttatgatttaatatacaaggcacgttgaacacatgggacattatcttcacttgctctcagggggactatgtaagaggactgaatgaatagacaagtttatacatagtttaggggccctaagtggagtgtatgtgtatgtgtgtgtgtgtgtgtgtgtgtgtgtgtgtgtgtgtatgtacctgctatatatgaatatatacacatatcatattgtatttgtccattttcatgctgctgataaagacatacctttatgtctgggtaatttataaagaaaaagaggtttaatggactcacagttccatgtgctggggaggcctcacaatcatgttgtaaggagaaaggcacgtcttacaaggcagtaggcaagagagaatgagagctgagcaaaagggaaaccccttataaaaccatcagatctcatgagacttattaagtaccacgagaacagtatgagggaaaccacccccatgattcaaatatctcccattggatcactcccacaacatgtgggaattatgagagctacaattcaagatgaagatttggatggggacacagccaaaccatatcacatacatacacattgtataaaatgatgtacaaagtatgtgtatggatgaatatatgggaaaagttaggattaaagtggaactgagcctaatggatctgtcaaactcatgtcaatctttattagacagagatgttcatctggtgatggtaccattttagctaataagaaggtataaactattgataatcttgcttacatttctctttaattttgtttattttctcctctaagattagaaagcaaaattgaaaaagtcagggaccacgcatggtggctcacacctgtaatcccagtactttgtgaggctgaggtgggagaatcacttagcccaggagtttgagaccagcctgggaaacatacggagacccatctctacaaaaaaattaaaaaactggccaggtggtgtgcacttgtggtcctagctacttgggaggttgagatggaaggattgcttgagcccaggatgtcatggctgccttgttgtgttcacaccactgcattccagactgggaaacagactgagcccttgtctcagaaaaaaaaaaaaaaaattgaaaaagttctcaggaaagatgcggggaaatatatttttttcattacaccattcccccaacacgaatatattttatttttttcttttcatttcctttctaagtctttgcatctctaatgatggtgtacattcatatgaaaaatttgatatttagcagaattaatactcagttaatacttaaagctatagattatagtttgataagtaaaaatgagttatgaattatgcagaactccatagaatttcaatatatgtatcctcattttatttatgtatctgctatatatatgtatatttatattcagtcctcccttggtatctttaagggattggttctagcacccccataataccaaaatccttagacgctcaagtcccttatataaaatgatacatagtatttacatatagtctacacaccttctcctgtatattttaaattatttctagattacttataatacctaatacaatgtaaatgctatgtaaatagtcattatactgtattatatatatttgtattactttttattgtagtattgttatttgtattgggcttttaaaatatttttgatcctcagttgcttgaaatcaagaatgtggaacccgtggatacaaggtgccgactgcttatacatatatgtatgtattcaaataatgaaattcattcctaaagcatgaatattttagggaaaaaaatgaggtagcagacgatatcttattgatcctagggatttattattttattttttcttcttgcaccagtgtttcctggcctacactaatctaagtaaccaaaactacattttatgttgtgaggttgtgtggtcagaaattgagcccaagaactaattaaggtggaggtagattcaactccaatgataggtaagcactcactaaatgtatttctacagcaagacacaaaactaataatgaacatgattgtgataccatataccttcatttctattttgttttaattaaataatataaattctttcataaataaacatacggttggtcatagaaaccatcaggctaaaccaaaagatgatgtttgaatttgctcatcattttgttcttcccttaggacactagctaaaatctcatccatggttaaagcacaggcatgagtctcaaaatgttcttggtattgccagaaatccactgagctggttgtgcttgtccagtgaagctccaaatgctcttttttttttttttttttttttttttgagacagagtttcactctttttgcccaggctggagtgaaatggtgtgtgatcttggctcacagcgacctctgcctcctaggttcaagcaattctcctgcctcagcctcccgagtagctgggattacaggcatgtgccaccatacccagctaattttgtatttatagtacagacagggtttctccatgttggtcaggctggtctcgaactcccaacctcaggtgatcagcccatctcagcctcccaaagtgctgggattacaggcctgagccactgcacccggcccctgaatgctctcttttaattaatcattgtaaatacatatggatctgtgtgttcctaaaagggtaatgacatgccatactggccacatcaagcatgtttacaaagtataggctagtaactcatatctattttaccaaaacatctctaaaaactgctctcctgtcttaatcatattttgatcttgactttttttgtaacttttctgttagaattatctattcacaccttggctcagtatgtgctttttgttgttaataatttcatgtgtatagctttttagaaact

SEQ ID NO: 6702 - DNA, 822 bp, artificial
  synthetic oligonucleotide
aaatacttatgcaagcttttcatgaaacgcatttctaagtactacctgctggttcagattatgtcttgttctattttattgaaagaattcagaagacttttaaaattaggtatatagagggtgatttttaaaaatgcctctcttaacagtagaatgaaactgtcatttactgaagccacaacctcctgagaaggaaaataagaaaagtcaaaaagaaaacattcaaggaagatgtctttctaccttttgctatgtaatctttctgttggtgccctacaccactgcacacctccctgccagcacatacacagaatcgcacacagttactattgggaacaatagacaaagaaaaaaatgtttttattttttattggtattcaaagaactgagatgtagaggaaaaagaactgcagtgaaagtccagcaatgaattattcaattccttcaatttgttgaccttaacgaaatgcaaagtgatttgaactaaaagtaattaacaagagagagtgtgcctagtaaaaccaagaaagaatcatatttgtttcaggaatcaataacagccagtgactgaaggtcataaaggaaccattcaggaaaacaaagagccttttgccaaggcagttgtcatgctgtatatgtgtgcacatatgcagggattttagctgtgaccgtgtactaggaagatttaattacatgaaaatgtcttctacagaaaataaagtgaggagaaaaatgaactaagaggcacatctcagtgacactaaaatgtcatttttgatgtcaagtttaacagaaaattgtttctgaggagtggcatccaat

SEQ ID NO: 6703 - DNA, 263 bp, artificial
  synthetic oligonucleotide
ttttccatttgttgtctttttaatgcaacaatatgacatgcttgattgacctcatattaatatcagtatagtctttgaaatagttcctgatatcctattgacattaatctaattttatcaaaatatataggcctttggaaatattttcaacttgaaagaagaaaaatttctgtctgttactttatcttccttttctctgattgtattataaatgcacaaaaatgtgtcttagaacaatctgaataaagtcaatttagatgaag

SEQ ID NO: 6704 - DNA, 1092 bp, artificial
  synthetic oligonucleotide
ttctttcccttttcaaatcatcttttctgctgctactagaagcattctgattttttttctgatagtattttttatgatacttttacaaagcatttaggacataaacgtgtgtgccttctcaaattgcatcaaaacctttctttccaaacgtgttcacccaactcctagcctgcacggccaccccttttgtagagtgcactgagttagccacaatccaagttaaagcttcagtcttgtgtacctatcacatccctcactccaagtgtgattgcagtaatccattcttccattaatgaacatgaaggaaatgtgacaccatactgcatgatttggcttcctgggtggcctctgagtggctggatgatgcagtctgcaaatatggggtgttatttctgcataaggtgaacttgacaaataaaagagtaagaaagaataacccttcctcccctctccccttcccttctgaggactactcagagaagcaagctgcctttttaagctttccagagaaatccagcaacagcagtgccaaaaatacacacctgctgagagcaacctgctgtgcctcctcacaacaagtggtgaagcagaagccagctcagaaattcattgcctcacgctgcttcttacattgctttgcctttgtccccttttattcttcaccctcaaatccctggacttgccctccaaaataaagtgtcaacacattaatctggcctcaagctctgcttacacagaaccatggctaacatatatggtaaaaaataaactcaagcagtacaaagattaaacagtaaaatgtaacttttcacccaaaaaccaaaagttgttccctggatcctcattttccttccccagagttatccactattaccagtttgtgtgtgcccctctacagatagcatataatcatatacataaatattatataatggtatctatataaatatatatgaatataccatgttacacaaataaaaatagaatatgctcatcacaccttgcatttttgccagagtgaagtttgtaaaatattaatctgattatgtcaatctcaaaaggttcaggtggcttcttattatcctcaaataa

SEQ ID NO: 6705 - DNA, 558 bp, artificial
  synthetic oligonucleotide
acaaagctatgcattgacaatagcttcaatttgtcactttaaatgcatcagttattgggtaaaatcacaaaatatcggagatattaggaagaatattattccacaatcttttagtttccctgaggagggattatatctctaggcctcctgccccatcacttactcctctccacttgggtacagtgagttacctggtggatgggttttagccattggactaaaattatattagtgtgcaaataatctaaaacagtaagcattctccttctttcttcacatcgaaccagtgtgaggcagcaactctgggtaaaatgtatgctgtgcagatccaaatttaccctcaggtgcacagttccaagattgtgggggagtggagaaaagtaagccactgcctgaagtataacttagtgataaatgtcatgatttggtattctggccacaatgtttattatttaattggtgaataatatgtggtttctttgtttcagctagacatctggaaccttccttcttgaagtgagactcggtctgatttcttctccatgtgtaggacagagt

SEQ ID NO: 6706 - DNA, 1771 bp, artificial
  synthetic oligonucleotide
ccagcaaaaatagttactccaatctatctcaattctgcttttaaagttaatctcccaatatttatggcctgtaagatggggtatatacccagcactttgggaggcagaggcgggcagatcatgaggtcaggagttcgagaccagcctggccaacatagtgaaaccccgtctctactaaaaatacaaaaattagccaaccatggtggcacgcacctgtagtcccagctactcgggaggctgaggcaggagaatcgcttgaacccaggaggcggagtttgtggtgagccaagattgcaccaccgcactccagcctgggcaacagagcgagactccatcaaaaaaataataaataaagaaaaagaaaataaagaaaaagaaaaaagaaaaagattgggaatataaaaacatagggagtcttaacattctgatgtgtcttttcaaaactgaatggcatgttccttttaaacaatgccttcatataaagaaatagaatgagtgtatctttagacatttaagaaagttcaacagttatttaagttgttttaactttttttcctctcatcccaacttttccagacacagcagaaaaaaaagaacaggagctatttcaaaagtcatagcaaaaaagggggactctgttatagccacaagattatagaaccaaaataattacaaagtggtttttaagctaaggctaaatttccatcagtattccttatgaatgaggttttattgttttttgtgatttgttttttctttttttagtgttaatagctaattgtatgcatctgcagcatgaagtatgctttgttcggattcttttctattaaatggcatcactacaaagaatatgggcaagaaacaaatttcaagactatgtatcccattccatcttattgattacgtatttctgtgaattagcctgaatctcatccacaaagctgactggttaaaggaggattacaagtgaataagaaattcatggagaaggaaagatgatgtaaaatatattgaaaataatggcaaaaacctcatttactttttcatgaacctaataaatgggggcacatctgactctagaaaaacttatatccaaaatcataaagaaaagttaagatgtcctactgaaatggatgaataagttaaacattttcctacctgtatcttttagcttctaagtcatttctttcgatatcaaagctgccaaggtcatctttgactctgtgtgtgtgtgtatgtgtgtgtgtgtgcacgcgtgtgcgtgcacgcgtgcacgtatgttcatttgatagttacacattttgaaagctcaacgtatttcaagttgctaaaattccaaacagagctgtaaataaaataatcctggttgcaaagttaaacgacacagtacagaggatttcagtactgactagtactaccgttaatttttgaaggaaaatgtacgtgtcctcatatattggaatttttctctggaaaaaaataattttcccttatattgctaaaaaataataagattaaaatgcaccattcattttttttttaatttctgtattttctttgcttgggttattttccataattttgttgttgttctttggctgctagctcatcttccttatcttatagtgccacctattggtatatcagaaatagtgaggattttaaaatggacaaaagtatagaaatgtgcctaaataaagctcacttcgcttcagtagtcaagttctgatagaggagcgggatctatgcttttgcccttataattatttgt

SEQ ID NO: 6707 - DNA, 745 bp, artificial
  synthetic oligonucleotide
ttgaaataaaaatcatactgctgggttaatacttcttcaaacctgtaccttaatacacgcatttgttttgttggttcttgtaaagttacttcatcagtaataattatacatgaagaaatagttacactatctcaacaaacctaattgcaacctttgaaaagactcatttctaaaactgttgttcagaaaatcaaccagagatttctctatgctagagaaattttctgaaggctttcccatgtactgcttagagattgttcctttagtatacattgaaataagtcaggttttatttttctaaagcttcatcatctaggcagatttttttaaatagccatgttctttctctaggacttcagactacttaaatactacttaaatacacagaagaatttcaattaattggcaacctgctgacacaattattacgctgtgaaaacacatttcttccaatatttacagttatattacatttgttgaaatgctttctttgtaccctgaacccaggaaaaaaaattaacaaaataataaatagatgtgatttatttttcctcgtccatttttttcatttgcctttcaatgtaaagactgcagaattatattaaaacttgaattacacctaacttattctaagtagtgcatcctatttccagagtccttgttttctattagactaaagaaactgttttttttaatgcaagccaggctggtgtgagttaataccaattccaggaggtcaacatta

SEQ ID NO: 6708 - DNA, 1141 bp, artificial
  synthetic oligonucleotide
atatttaacagtaggcaagtaataaatatgtgttcaatgaatggattataattgaaaattcaataccatacaaataatataattaaatttgcttaacctaggtagtatgatttcagaaacatactctttgttactatgttgtacagttatatttaatagtaagcaagtaataaatatatgtttaatgaatgaattataattgaaaattcagtaccatacaaataatataattaaatttgctcatttgaagaatgtgttaactggggttaagaggtgaggtgatttgccatgatcacacagctaatacttgctaaaattacaacataatttcaagtgtgttgactgcaatttcactgttcttactcctgctccatgtcctggatgtgtattttcaaaaagaaaccatttacttctttgtaaaaccctgctaaactctaatgctttcaaaagataatcatgagcataagccatttgtagtgataaaaaccgccccttttagatacgtggcatgacagctaaacaaatttcatgatgaaatcaaagactcatggacttagctatagaatcatattgttatagctgagtaaacctaacatccttctgaaaagtgaaaacttcaaagactttgaaatatctgaatgtttttcattgtgagaccaaactgaaattttcacttttcatgtgcttgtttggcactgtggctaggtttaaggcagccttgatgtatattgccctgatctgctctactgctcttctttcttcccctccctaggccaaatactgcccactattcttgtctagaatgatattaatacgttcagtctgctaagtctgatttaacataacttaggcattgacaactatgtcctgttttttatttcgttgttttatcaaatacaaacttacatcaggaaggccaaatggaaacagttttggaaagggttaactctggtaagtatgttaagatttcattaatattttcccatcgatttaatttatttttaacacattatttatcatgctatgttccgaggcaatagactatacaattcagcaatacatccctgaattataatgaaatatcaggaaaagggcattaagacaaaaagggaaataagcaatataacaagaagtcatatgt

SEQ ID NO: 6709 - DNA, 1145 bp, artificial
  synthetic oligonucleotide
tttaaggcttattctggcactaaaaatatataacaaagcagataatgagtgccaacaatataaaaccttgaaatctagaaaagcagtaaaactaagttttgagttttcagctgtcaagaatatataacgtctgaagcaaaaatattgacaattatcttggcagcaatctgtcacaggtatatataaacattagtctactctttcaaaattcaaaaatgccatttctgtgtagcagttaaggaaatcactaattaattgtatgcacacgtacactcactcacatatacatagggatctcttttaatccgttatcttgagtttgttgtttcatttcacatgtatttttgcaatctggaagagtttatagatacacaatatattactttaaattatgatgttagtaataaactttagcaactcttaaattagcctgtgttacttccattgctaaggcataaagacaagcccatggagaagttagaaaatacataaggctaagtgaatttaaagtcagaaaataaatgctttatttattttctttaaaaaaaagctatctgatggaatttgcaggatgtgttatttaggacaagatttgacaagggacaataggttttcactgaacttaaaatatttctttttgagtaggtcactggttggtgtaatgctatttttatgtaggggctgttgagctacattctcacattttctgaggcaaaaggagtcatttagtgcgttgaagtatggatacgtcattccaatggcctgaaagattcctgcactttttgaaaacagtttagtctgtgaaactacccacacgattaacatccacagtacaatgctgtactacatgttttgtagatattattttctttaatcctagtgaaaacctttagaagtacaattgattctcgttattcagagtagttgtgttctgtaaagttaatacaaacactgaaattagtgaatacagaactattgttccaatgcagaatacagggtcagattcctgcaaacctcaggtcacaacattttcatcagctgatcaatacataacattatttatttgtgtttttgttaaaatacgctttatttcatacatattgttaattcattaacattgaactcatggccaatagcactgtaac

SEQ ID NO: 6710 - DNA, 1902 bp, artificial
  synthetic oligonucleotide
tctgagtgaataaatgaatactaaaggtagcttgaattaacagggtacatagtaaagaatgtctcatcattgttgtttggatatctttttcaaagatgttaataagtaggatttttccttaagtgccaagggcttagtatgatagaaagatttaagggacttgatactttatggctatctttattcaatttatcttaaggaaagtaatgttaaatctgttccatgtgataaatttagaagttgttgatcagaaaattgttgatcttggtatatagagcacctttctagatatctggtaaacagtaggtaaacaattgtgctattaagttaaagtatttcttatattattaggccacaaatggtcaatacttttttgtctattttttttaattgcctcttcacatcttctagtctgacaacaagctcctatatgaactgaagaactcaagctctgatatgcttcaagtcaaatttccccactgtccagaaaacattgtttttgtttttgtttttgttgtgtttgttttttagagttggggtctcactctattgccaaggctggagtgcagtgacacaaatcatagttcactgtaaccttgaacacctgggtataaggaataaaaaccattgtttttgaatgaagcttgtgtattctaatgctctctcccctcagtgaaaattcctttcaccatcagatgtcctgtaatggagacaagatggggaacaagtgacagtttttattcccccaaaagcttaaagatcacagttctgaggtacagactttctgcttcaacatgttctggtattcccttctgcaaagaaagaacaatgacaggttgatcttccagctagagactcagaatatatctgaatttgtagtgaagacacaatttagatcgctatgcgggaattctaatattcagtttactggttttataaacacataagactttgaggagagttataagtgatttctcactctaacatcactttctctcttatcccaatttagtaatttctatttttaaaaaatccttgcagagttaggcatagcaactttgcattcaatttaaaagcttgttaaatatttgtttcaaaccagattttcttatatgtttacttagttaaggggcttaaggctttggttagaatttttactaatttcaaatttaataattgataggaatatgtgatttgctaataaatttgctatttatcaatttgtaagggatagtgtctgagtaagaaataatataaaagagatgagatctctgtacctggaattatataatttttttaatgttctttatattgctttcagaagaaacaatgctctcattctcagaaggcctctgctctttcctcccaaatgaaaagtctgcaagacacatgcttttaatctccaatatcaaaaagtgaactataatcaataattatgtacatcttatatttatttactatcaatattagtttgctaggactgctagaaccaaacaccagtgactgggtggattaaacaatagaggtttattttctcacacttctgaagcaactccaagttcaaggtactggcagagggttgcagatgtctgccttcttaatgtctctaccaaatgttgtccctctgttcatgggttcccctgatgtctctttctcttcttataagaacaccagttatattgggttagggcccctttctactggtctcatttttaacctaatcattgctttaatgaccttatttacaaatatagccacattctaacatactgggggttagggcttcaatacatgattttggctggaacacaattcagcccaaaatactaccaaaggatataaggcaggcatataatattttctttttcctcacaacattctagtgatgtaagtaagacggat

SEQ ID NO: 6711 - DNA, 574 bp, artificial
  synthetic oligonucleotide
gtcaaaacttgacattccttatcaggaaatattcagagaaaatttgctttttgttctcttgtgtgaagttcctcacttcttcttccatttatctggcatatgttgaggccctttgaaacatgtcacaccattttttctagaaaatgactattttttctatctgaacggatatgaaaatttgcaaatgttcagtacttattttattggtgtttgttttaagcaaacatatttacccaaatatttgtgataacaatattcaagttttccacaagctttaaaactgattttaattgtatttgcatgattgataattgcttattgcccccaaaagtttaatgtaaatcttaataggcagtaaaattttattcaacactcttaagcaaaatatagaaaataaacccagaaataattaagtttcatgacgatatcaaagaatcttgacatacaatatcttaattgcaagtatagtaatctgcattcagacaaaggagatagtatgtctgcctattagacatctaagaactatttttgaaagacttgaaattaagttttttagctttcaatgatttacttc

SEQ ID NO: 6712 - DNA, 4174 bp, artificial
  synthetic oligonucleotide
ttctagagaaccttagtttataatctttgtaagacctcaaggaggaccatgtttcactggaatataaaatgtctggagaatccaattttgctttaggctgatgtgaggaagagatagaggatagatagatagatagatagatagatagatagatagatagatagatagatagatgatagataatagatagatagatagatagatgatagatagataatagatgatagatagatagatatagatagatagatagatagatagatagatagatagcccaaattcctacataatctagtcatgccctcagtattcctgagctaggaaggttcagagaaagatggaaacattgcttcatccattaagtgaggccaaggagactaacagtagtttgagaatgtgaacccaacttcttttcatgcctttcaggatgtgatagagttaatagaatttggaaaattttaatagaaacatcccccaaaatgacaaatatcttgaattaacctgcatttttgatgtttaatagtaatttatattaaaattttacgtcaataatttatcatattattacataatattcattgcctttagctgtcaaaagcttcccagagatactgaatctgtagtaagcagagtattctaaagcctcgtgtctctactagattctaagaactccacaaattcaaagaatgtttgtagtaggctgaataatgggcacccaaaaatatccagtacttttccctggaacgtgtaaaagtcatcttataaggaaaaaggcactttgcaggtgtgattaaattaaggcttttgagatggggggggaatcatcttggattgtccagatgggtcctagtttcaatcacaagtgagagagacagaggaaatttgacacacacagaagagaagacaatgtgatcacagaagcaggttattttagtaatgcttccacgagacaatcaagtcacagaatgctggtagacaccagaagctgaaagatttcagacttcttacctccggaatggtaagagaataaatttctattctcaaaagccagtaaatgattttgattttgtggtggtttgttcatatacaaaaatcaactcaagatggattaaagacttaaatgtaaaacctaaaactatacaaaccccagaagaaaacctaggaaataccattctgaatggtcctggcaaagacttcatgacaaagactccaaaagcaattacaacataaacaaaaattaacaagtgggacctaattaaactaaagagcttctgtgcagcaaaataaactatcaacagagtaaacagacaacctgaagaatggaagaatatatttgcgaactatacatctaacaaaggtctaatgttcaaaatgtataaggaatttaaaccaatcaacaagcaaaatatgaaaaggctttactggccattgctggttttgatgacagaggaaaggaccacgagccaagaaatgcatgtggcctcttgcaaaaagcaagaaaatggattctctccagaaaggaatgcagctctgccaaaatcttgattttagccaaatgagactcatttgatctccaggacgataagctataagttagggttgttttaagctgctacgtttgggagtaatttgttatagcagcaataggtaactgataacactatcctataagaaaaaaaaagtatgtaaaagccatctgaagacatctgcatctatattaaaaagtcttcaaagtatgccacaaataaataatacaaaatattaataatttatctgcaaccataatgccccatctacatcccttagtatcatatggtttccttttcaaatctaatgacatgtatgctatcagataaaagtataactttcatgactattaaatatcaagaactttactagtttggtggatatttaataaaaaataagatttaaatattctagttataaaaaccaatgcacaatatccagtgataatttaatcaaagtaaatataataaatgaattccttgtgtatgtgtgtgcctaatgcaattgacccaggataagaattcattaacagtgaatacaagagcacaagttttatttgtagaactgtttttccaggaattagaaacaaagattatctgcttgcattgtggtttaaaatttgatatgtttctcaaggcttgagcttgaccatttattcaaataagcatctaaacttaaacaccaagcagaaatattagctattactctagcaaacacagtagatgtaaatttcattatcaacatcctgtctcacaagattctgtaatattccagtaagcagggccaggaaatacaaaaattttcccacagatatttcactacttcgattataatttcaagttgtgtaacattttacagtaaccaaacaggctaaatgcaaatatataaaacaaaaactgtaaccagaaaatcattttatctaaaactacctctcattttttaattgcaacatcttacacggacctaaaaaaaaattgcaacatcttacttttcctaactagttttactggaataagtatatgcctaatacttgtttatttatttattcaaaatctttcctaactaatagcagatctgtgattactgggccattttagcattcttccctatatatacagaaagtgaatgctatcattatctttcagttcaatttcagatacatctccagattttcttattgctgttgctattgttattcttatgtaatatgacttgacttcatacttctctactggctttctttaactttgctttatggatttctgtcataattctattcatgtcatcaaggcactgcataatttgcctgcctcttcagaagcctttcaagggaagctatatattgatcatagtcaactacactctaattgctcaagatactgccaaacatttcatcagtctggtatatgttaaatacgatagaaccaatcctgttttaaataagttaatttttctaggcagagagctaccgagtaaggttcaccttttggtgctcaattagtaagaatcataacatgcttttgaaactcatattaaaccactcagtgttgcaatgacctattggttgacatcatgtcattatagattggaattttcaattcagcaatttgcttcaatagtgctgtcaaaaactaacaaaattgtggaaattgttctcaatgaattctcagaatgtgtattgatgcagctgatactgtcgttaaagtttctacacttatattgataagctggttggtacactaggagacaaatgccctttgttgaaggcatcagcaggcacatcaatgcacatttcatttctgattattttttctttgggctatactaaatatggcagtaaagttgaataaaattttaataattggtaggaatattatttttcaagtgtcacgagccagggaggagcacaaaataaatttttctaataaatcacaatcataataacagatcgaacagacctatgaatccccccaaattcatcattttaaagcgatcagctcatttaacactaaaatgcatctatcctcaggctgaatgataacatcggtaaagcagcacccagcaacataatgcatttaagaatatataattaagacattggaaagaattatgactattaggcctgaatcttaaaggagtcaataattgcttgcaaacagtaaagtcggataaattgcttcttaggaaaataaactaggagaggaaaatttcagaggagtacacagtaggttcccagttaacttaaaaggttaattttccagaagaataacatctatctaataagattatatagttcttgagttacataagatttgaacctcaaatacctatctgaagaggctgattcattcttatacttctctcagatcctcaatccaggagtagttcttcatacaacaggctttgtgaactatttattcaattagtaagcaatcttgatccctaaagctccatctaatcctggcctcttttgaaaaaacagaactttagagctagaaagtaattgcaaaattatttatttcaaccacgtaattcccactaaggtacaagagaagaatgtgtcttactcaaacatagtgcttaagtgatcaaattaggtctctagaacctacgtgcctttagtctcagccatggaactttctacttt

SEQ ID NO: 6713 - DNA, 1018 bp, artificial
  synthetic oligonucleotide
tttgcagtttaggatttaattcgggttttaattgtagaaagatatcacaaggcagagagacatgagaaacaaccaccattctcctaaaaatatccactgaagatcatcccagccatactaaggttcttcttatttgggatgatttgagttgaaaagttctgcgcaaaagtacaattctttcgaattcgtttttcaggccagtgaaaccttaagacaggccaacacaaaagaaagtttaaaaacttagttatagtcatggaattttatctgctattgttttgtctaaaaggatgttttaaaactacatgcctcttctcttaaaaaaaaaaaaaaaacctgtcatgctatcattaggtgatccttctaggataaattttggctgttaacttttttctccatctgtgttgtgggctgcttagaaaaacacctcgaatcagctagatgtgtatatcgaacacgatgttttttagctcttttattttttcacataagttccaagtatctcttgaaaaagacaactagttgtttcaacaattatggcctttaattctcctcactcaccgagataaggcaatttctaagcaccaaagtaaacttcacagagaagggcttcacttagggaagactctaaggagattcagggaggatctttgaagaaataacaagagggaaaactaaatggcacatggtttccactaattgtatcatgaattgtctttattttatcctctacaccacattttctatgtaaagcgtaaggggaaaataaattaaaataaaataccagtcagtgaatgaagacagaaaacattttaagagtaacaatagcaacaaaatttccacaaccatagagagctaccacaaagggcaaaaaaagaaatcctatgtataaataatggaacagtgtttaaaaaatctagacacagtagagcttcagcggtaaggcaagactgaggtttgagtggccagtctgaagtttacataagaatagcttcttaagaaaggatttcaggtaaga

SEQ ID NO: 6714 - DNA, 3606 bp, artificial
  synthetic oligonucleotide
catttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctaatttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtcaattaaaaattatttgcctttgtatctctgtcagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatata

SEQ ID NO: 6715 - DNA, 5151 bp, artificial
  synthetic oligonucleotide
ttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctgtgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacag

SEQ ID NO: 6716 - DNA, 1753 bp, artificial
  synthetic oligonucleotide
ttcttttcctatacttcagtttgtcttgttctcatattaacccatgtattgttgtgtttagcttaaccccacaataagtagcaccaatgtttaccaacaaatcaatactttttgtggaaaaacaagagtcattagggtgagctagaataagggtggtagctgattcaatttccctaaaaatctgactcagtttctttattttaaaaaaagacagggaaaaaagatttcgtgtgtgctagtgtgaacaattttgctatagtgtaccactacttagaaaagatggcaactcaatgtttaaaacccaaataaatgttatagtctgcctttataaaacacaaccaaagaaaaataaacaaaaacacttgctgtcctctagaatagttatttatgtagtaaacacacttttgccacaacagggcacattagagaataattaaactcactgggtcatctccattttgaagccaccttgatttaacactgcacagggaagtaattagatgaatttgaaaccatagtcttaggggagaaaaatagcccagaatgtattccaaggagggattgtaggcagcctcagctaccattattatacagaagattgtaaaaaataaaagtggagaacaggttgtagagtactttgtactcagtagcttccagcctggctttttagcgtctaatgtctatgcttgcaagttctgggaattctctaccctcagaatcgggaagtgcttttcagagagccaaattctaagtttccacagctgaatctctaagagagattgtaaacctggcttgatagggcattgattttaatcttttttttttttattacctttcccttcagtatcccctatgtccacactcctaactcaagtttagaatgtgtaagtggaaggataaaataagtggaaagttcacatttggaaataagcaaaactctaaatgtgtggggatagtaacagtacagtggttaagagttcaggtcctgaattcaaatagacctgggtttgtgtccctgatctactgtgtgccacttggatttatctcctacttcagctccccatttagctcctctctaagtgtcatggagagcagggggtagggtataagtaaatactaaaatcacctttttactaaaaactctaacatattggcacagaacatgacattcctagcttaagcaggtgggaacaagaagcagagatataggccattgccattaagtgacctcgtatgtacttgtagtatctgagacatgggaaaatttgaatatgggaaacttttctttctagctttctctcctccttgagggcaggggctatgtcaaatcaccctttataggcttggtagtgccttgctacagtgcctggcattcaacaagggaatgaatgaagcacagtgtatgcggcagaaagacatgatttcccaggagacagaattgggctgtgttccctgtgttctccaagacataataactgaggagtgtggggcggagtgccgctgtggaaatactacaggggtcaaagcaggttgaacccggagacaaaaatgcagttgcacgtggcactgcctattaacatacgtgctcatgattaaagtaaacatgggacaaagttcaatatgtcctagggaacatgagaaaaaaacatgcaccttctcagggagccactgtcaccttgggttctctggagcattctttttttttttttttttcatttgccccactcttccctcctggtcaattttcctcaag

SEQ ID NO: 6717 - DNA, 629 bp, artificial
  synthetic oligonucleotide
cttctagagaattccatatgagcaatttctagtttccattaggcattacaaagccaactaatcctcaactctacctcactcacatagtacagggcttccccacagatctattcactgtagctttcctcagtctaatttccatcctcataaatctatagtgttaatgatacaactgaaggagaggtttggaacagtcagtcagatgtatgcattcttttctttgaggttttacatacaaatgttttactttctgagtcctgagaaaaatcaaaacaataagttttatcataaatagtatcttcatccccagggataacacttttggcttctatgacattcaaattgatgtttctattcctaaggcatttccttgtttttacataagttgtcttttctcacaccattaaaaaaaaataactaaacctttgatgtaacttccatgctctcttatatcttctctaatagtacatatttgattattttattacacaacatcagaagactatatggctaaactcagtgctactcatattctggaaaaagtgttcatctttccaactggctgctgaagcaactctaccaagggaaaagtagttcagacttctcattcaggtattgctgtcttgcct

SEQ ID NO: 6718 - DNA, 3128 bp, artificial
  synthetic oligonucleotide
atatgaattatgtgtgtgcactgaaaggaaaatatattccatgaatattacactaatgaattaatttagaaactcagactcatctatttattaactcccgactcatcaccttatgtattttgcatgttgtagtaaatgcagaaagaaacatttagaaatattcacttgcttttccatagggatcagctcagggaataaatctgagttttataatgctgtcttaatattacatgcatactgaggaagattcttaaagattatcttgactgctcattttctgttataattatctaaacctgtaaatttcaatttattgtcttcaaagtttctttgattaatgtaatcatatacctccacttctcagatgtttcttaacatcttcattgatattgttaactacttgtcatattctactaaaatttattatttctttgttgatgtttagtgtattaaatacaagtaattgacacccttcctaaaaagtctgcataccggccgggcgcggtggctcacacctgtaatcccagcactttgggaggccgaggcgggcggatcacgaggtcagaagatcgagaccatcctggctaacacggcgaaacactgcctctactaaaaatacaaaatattagccaggcgtggtggcggacacctgtagtcccagctactcaggaggctgaggcaggagaatggcgtgaacccgggaggcggagcttgcagtgagccgagattgtgccactgcactccagcctgggtgacagagtgatactctgtctcggaaaaaaaaaaaaaaaagtctgcatacctccttaatcatcaatagcttgtgatataaatcttcagaacatacgtggctttactagtaaccagattccatttgtaattttttttttttttttttttttttttttttttgagacagagttttgctcttgttgcccaggctggagtgcaatggtggggtctcagctcacagcaacctccacctcctgggttcaagcgattctcctgcctcagcctcctgagtagctgggattataggcacgtgccaccatgcccggctaatttttgtatgtttagtggagacggggtttcatcttattggccaggctggtctccaactcctgacctcaggtgatcctcctgccttggcctcccaaagtgctgggtttacaggcctgagccactgcacctggcctctatttggaattttgtatttagaggagatggagaggtagaggttgatggtaggttatgtagcaagggacaggataattgcctggtctttataaattgttatctgcacaaaaccatcacatactacttaaatctgtaacttgatttttgcacccataattaaaggcgtgttaccatggaataaatcctttctaaaggcttttaacgcatatatggtactatatgtaatatgtgaaaggaggtaaagtttgagcaaactagggaaaatttttcacctgtttgaggacaatttagaaataattcaaagatgttaaatagacattagatgtgggagactagatgttggagaaaaaaaaaattagaagctacaaacttatatccacctgctgtatgctaacactcaagcatttatatttctatttattcaaattacatgtaagtttagtttaattcagatggtgtttatgcatcagatccacttctcttccatcaactgcaagcctttgctccatcaattattccctcttacatctgtattctcgaactctttgggtccttccactagaggtataactatgatcaaatattcccctttcaaaataccttcctttgagcctattgacattggtttgtcactctagagacttctctcctttacttcacatgcaggagtttatgaagaatatttttcacagctgtctttcacttcatcatcttcaatttaacccacatggatctagcttccattcccatcatattgctgaaacatctctgaaagaagtaattaatgacttctaaatcggcaatttcaatttcaatccctttctcacttgaccattttacaatattgctggacatgcactacatcttgaaaatctttcactggtttctgtgattaccctttcttagttctcttttgagtatttttttttggagacggagtcttgctgtgtcccccaggctggagtgcaatggtatgatattggttcactgcaagctccgcctcctgggttcacgacattctcctgcctcagcctcccaagtagctgggattacaggcactcgccaccacgcccggctaatttttttgtatttttagtagagacggggtttcaccatgttagccaggatggtctcgatctcctgacctcatgatccgcctgcctcggccttccaaagtgctgggattacaggcgtgagccaccacaccccgccttgagtatttctttttgttctcctttgttggcttttctcccttcaatgctcctttaatattggtactttccagtactaaaatatttaactcttttttttttcactctacacattgttctcgtttttgactattttttcttggcttcaactatcatctgtattctaacaactggcaatagcttaagtccagatttctattttaaattcactagcagaaattttctcttggacatcttatagccaactcagagaaatttactaaaaaaggatcttactttttccaaagcattttcttctccctatgcttcctatcttggtaaatggcagcattaatcattcatttatccaagacagaaacctgatagactccttctactcttccatttgcattatcataaacatttcaattactatagatttatatatatgtttctcaaatctcttcttacactcatcattttaatttgtgtttttatgacctctatcccacaaaatttcagtagtttcctcatttgttttaaaacttttggatttcagatacaagcacattaattagtgagtttatcaaggtcacctggaaaaagtcaagattgagaaatatttctatttctgtaaaatgataagaaattttgcaaataaaattaaaaatgtcatttaacatagcaagaaaaatcatcaagtacttagaattaaatctaatgaaagatatgacaaaccat

SEQ ID NO: 6719 - DNA, 1622 bp, artificial
  synthetic oligonucleotide
agagaataaatgatgtagcaatgagtgtgggaatcaaaggactatcaccaattgaaggcatttattggtaattaagatgaaggagcatgggttgattggaatttattataaaatgttcatggcagcaggattgctgtgaactaacatcatcaatattagagctattgctatgtctctatcataaggtagtgacagataattaataaacccaattaactatgaaattatgtctgcttaggtttttgcatatggcttgactatattttaaagtaatcaaagtgattttcaactgataaaaatacaccacaagacatctcttcttactgaaagatccattttcagtcaatttgagcgtaaaagttcttcagaagatggaataaatctatagactggtttggagattcttacccttgtttcattctcctcaccagcctacacagagagattggaagaaagcagacagacctttgtgaacatgacagcttattgctatcattacgtgctttctgttttctgaaaaaaaatttgtgaaagtaaaagaaaatatatatgtcttttctgtcactgagcttttaatcacagaagtcaaatatatggcacagaagagttgaaacattaactggaacaattttgataaatgcaattggattaaattgtacacaatataaggtagagatgtggatgtcatggtatgagaaagaacaaggaagaggccatatacattgaaagtacctcgacataaatatgtggacaattatttcttctttgattttctttttcttatccctcgaaacctttctcttttaatgtggaaatttttgtctatctctgtgtttcaagagcagcaggaggtagaacagtatgagagatatgtggaagggtcattgcatgaaaaaaaaagccaatctgagcatggaacacctactggggtcaaagagaataatgggatgtaattaaacggcttcctagggagatgaagcaagaagagcaacccacccaaagatacttttcctcatgtttgataatatagaacctctgcacatataaaagtaaatgctgttggtttatagaaagatctatatatgtgtaaacattttgatccactttcagaatggccactgattttcatctatggtggtttcattagcattccattttagatatactactttttagcttagagagtatacatgtttgcctgtgacaaaatccaattcccaacccccaaatgaataaacaaacaaacaaaataatccataaaaaatcaacgtgaagaagaatactctccaaagcctgcaaactaagtcattgtcttttatttattagcataatgaaaaaaattctcagtcgcttatggaagtacaagaataaaaatcagaaaaatcatgtgagtaattacacatagaaggaattcaaatccgtgctgtgttggagctagcaatggcttgtaaaagccaattgttaaattttcagtaattttgcaagctggttgacatcatgttggtagctgaaatcagtcatggtgagatggaaattggcaaatgctacaaatcagaactttctttgctacctgagaaagccaatttttaaacatttatttgtgtatcaccagattcaatcaa

SEQ ID NO: 6720 - DNA, 1272 bp, artificial
  synthetic oligonucleotide
aaaatacttaggcataaacaacaataataataaagcaaaacttttgaatgaagccaaaatgcctttttccagtctcttaagctgtaatattcaaggtcttcatgtttattcctgcctctacacctttgctagtgctaattactgccacccccgaaaagatcatttttttagttcaaattttctgaagttcacctgcagtttcactttgtttgtgaagacttagcatccacttgtttgctaattatttctcatattaattttggatcccaaactggttggtaaggtttttgaggggacagggatcttgctttatttatatactttgcattttccatagcacaatgttaagcatcacccattcccatctctgtgcctactatttgggttcaaaaaaggcttttgaatgacttatgaaattatttaataccttgcaatgaattattccagtattgtttaggacattgtatcatggaacaatattgctacatagtctgctggctttaatatcttgcttcattcctcttcaaaacaagatttatgatgtagaaaactatttgtgatttaaattcaaggttttaatttgaaaataacatctgtatttttttgctaagtatactattagcaacttgagctttttgtgggggtatgaggtgtaaaattgtgcttaacatgaagtgacaaaaaaaaaactcgcatcagaataagcaaaatgaagtctttaatcagttaacattttacacattttataatttcatttggtatcctaataataggccaatacactcaacaggtggaagtgcttgagggccattgggcattgaattttcctaaagtagcgcaattaaagaaacacctgtgttaaataaccaagtgctaatttactatgaaaatatgcgaagtgtttaacagtgctccaaaattgtgatttgcttttgatcgaatttgtggatttacaatgagtaaatgacagtttattgtcaggcaaacgattacactttataaattagttaaaactatccatatcctcattaaatacatatggaaacagagatgtatgcagagtgaggtctcttcaaagaagctctgtttgctctctcataaggtaaataaaaaagagagcaaacaaaagtttgccctctcttgtccatctcattagaggttttggttttaatttttaagactggattttgtaactctacctaaaaagttgcacgaaatggctaaaacttcttctagagagataataatgtatcttttatgtggataaaacaa

SEQ ID NO: 6721 - DNA, 2026 bp, artificial
  synthetic oligonucleotide
taataccaccacaatggggagtaagcttcaacatatgaattttggagaaacaccaactttcagaccatgggactggtctttattgtaataaataggcctttaagtataaagaaatattaggtttatatttaaaagtacctcaaggtgtatacaaaggtctatagaattcctttaagatttaacatccacaagaaagcttaagacaccataaattcaatgtaagttgataataatagacaccttaaaacattttaaatgttgttttaatttttaagcctatcatctaaaagcctgtgaatgggggaataattatgcattctggccagaatttacatggtatggaatcagggtctcaagattaaatcagccattctcagcatagaaaatgctcctaattcattttactattacagtaaaatggtctatggaaccagatagtttactcttgccattaaaacattaattctaatggcgtaaatggcaaatcaagttctctgacagaaattagtgggactctagtttgatatgtgcaaattataaagtcaacaacaacacataagcagctaactcaggagaatagtatttttaggaaaactcctgcctttaagcccaagcaattgtgatcactttgagaattgttcttcttggttatctgggataatcctcaccaccctgtcaaaattgactataaaaagcatcctattttgtgtgaagtttgctaattttaggatcactagaaaacagtatctcctgtctcctcgaactccgggaccccggtaaacctagtcaggaatcctaggattgtgcaactctcatgtagccaggtaggtggcagggctgtctccaaagtcctgctgtcattggccttcaatgcatctcacctctgatccctcctttgtgtgtgcctagcactttgtgtatatgtctataagtgtacttacaatattgtattctaattgtcggattgccaatctctgtcactaaatgagatgtgtcttgagggcaaggactgagtcgttatgtctcaagcaactagaatgaatctttaaataaatatttgatgactgacttaacaaattgcatatgttatgcagagatgtcttaagaatagaaatggtgccagaaaatcaagaacacttacttaacctttactttccccactgattagctggcgaataaaatcacttaattagaaattcagttattttccttttctaaaaatatccaagtactcctggtgtggctaacatataaaaacctataggtgatttttgggtaagttcagtggttctcaaacatcggggtgcatcagaatcacctggaggtattgttaaaacacagattgctgggcttcacccccagagtttctgatttagtaggtctaggatagggcctaagaatgtgcatttctaacacattctcaggtgacattgatggtgatggcccagggaacacattttaagaaccactggcttactgtaaaggaactatcagatcattaccagagggtagattttgatggctatagacagtgcaggagagtatgaaaggaggaagaaagaaggaaaaatggagaataaacatagctccaagacaagttacactttacaatttttttgacggcctgaaatagtagaaatctttgaagtgtaatgtgtagttgtggaattggcacagtgcactcaccttgggaatagaaaataagactttctaaatacaatattctttacaccttaaaaggggtatttcaataaatgggataaatgcttatttaacaatttacaaatatagcatgctttttccaagtcatttggcctttaaaatgtgtgattgctttttttgtccaacaataagaggctattttgtgctattttccccatgaatactgctgttattacttaatatttattaaatagccaccatagtggctttattcttacagaagaggtttttcttctttgaatttctgtgtgaaataggattttcctgctgcctgtcaaattgaaaccatattaaacaacacaga

SEQ ID NO: 6722 - DNA, 967 bp, artificial
  synthetic oligonucleotide
gtcaaacattgcttcaatgaagatttttctcatatctgttcttccctctccctttccagagagaatccatcaccctgtctttatttgtatcagccactgtcccatgtatgactttctatttgaacaccttaaaatgtgactacacttatttgttacatatctatctccctaaccctagactttgagctctgctcattgaggagaatgatggtatctcacccctttgtctccctagtatgtaacactgagcatgagaatttgattgtattaacagtcataaattttgatccttctcagtatccataccctttacctgtcaacctctagtattcttcaactctaattctgagcttggccatatgactaggtatggccaataagatgttagcaaatgtgatgcaaatatgggcttgaaatgtgcttgtgtgattggccagcttgttcttgcattcttccattactatgagaacatgcccatgttaatctgctggagatagagagacacaaggtcatttcagtttttctagatgagctcaccctaaataacctaagaaccagtcaactcccatccatgtgaacaaatctagctgaagccagtagaccacccagccaattcagcaaagattggtacaactgctactaagacaccctagtttcataaaaatcacttcttgttgctttgcataaattaagttttggtgttaatacttgcaattgttttgtcattagatagttgatgcaaagggaatagcacatagtatgtgcttaataattgaagtatgagtgatgtttctaggtggcacaaggaaaagggaaaatgataaatggaaaggcaaacacaaaagatatgcttgccttctaaaaccctttcacttaaaactcccaaatataaaattcaaaaatattaaaatagtctatataagataaagacaaaaattattcttggctttcagccactgggcctgga

SEQ ID NO: 6723 - DNA, 704 bp, artificial
  synthetic oligonucleotide
atatatttttcaaatgttcaataaatggttacaaaaatcttagcctaaaacatgagtttttattaagacatgaattcccaactattttcttcttctcctattaacattatgtgtcaattcactatcccaatttttaaaaagtaaactaaaggaagacttttaaaatctttagctgaactggaatctacttattttattgtattttatgtttaggtgcttatgttttcctgagcaaacatagaaacaaatgtaactattacaaggaagaaagctttccaaatgcttgtgcagtgtcatctgtcaagctatccttggggagcagccagaaaatattaggccagaccactgggcgttaaaagatccctctcttgtgtccaggtgcggtggctcacacctgtaatcccagcactttgggaggccaaggcaggcaaattgcttgagctcaggagtttcagacaggcctgggcaacatggtgaaaccttgtctcttccaaaagtacaaaataaataaataaataaataaataaaaaatagcagaacatggtagcaggtgcctgtagttccagctactcaggaggctgaggtggtaggatcgcctgagcccagcaggcagaagttggagtgagctgagactgtgccactgcgacagagtgagacccagtctcaacaacaaccaaagtttacatcccaacattgtgtcattg

SEQ ID NO: 6724 - DNA, 901 bp, artificial
  synthetic oligonucleotide
atcaatgtcagtagtttggatgaatgtaccatgattacataagatgttaaaaatcgaagaaactgagtatgggatatatgggactctttgtactatctttacaactttcctgtatgtctaaaattattccaaaataaaaactttatttaaataatggatctttttaaaactcacctataatctagctcaatttatcagtatagacgatcatgtaggaatttgagatgtaaatctcagttagaactactgcacattttcctgtacttgcttaaaaaacaaggagctgatattagatggggaattctgggtagttaaataattccttattgtatgcatctctttttcccttgggtacccatgttggacaaaggaggttgggacagaaggaacacaagtgaggaataaagatggtgatgcacttatttttacatctgcatccccctaaaaccaacatgtcaagagtgcttaatctgactgacttcatgctggttgggaaagaaattaaaaattctagaatgcactgagcactcaaagtgttaatcagcaacttggaccttctagccttggtcatcaattacactgagtatctcagctgacccagaaaatttttgatttaatacaaaatgggcagctttagaaaacttacatttgtacatactcaagtttatatagtaagttattctcattatcactttctgtgaatgagtttggctgctgttcttgaagtataccagcattacaatggaagcaaaatattctgctattaggcacatataaaagactcaaatactaaaaacatatcttttgttaaaaggaaacaacaaacctattcaggctagagatgtactccacaaatgaggtcaagataatccccatattgccaaagtattttcaaggatga

SEQ ID NO: 6725 - DNA, 593 bp, artificial
  synthetic oligonucleotide
tgtgcttttagatctctttgtgatatatatgaagaacatagaaaattccagacatttagagaattttcattgactaggatgaaagagcctggtaaacaaggcctataaaaggtaatatttcaggtaactggacctgagatcaaagctaccacaagatagtaaggccaatcatgtgtgtactgatgtgctttatgtgagcaaatctcttttccattagaagaaaataagctaggctaagagttcaaatttatatcactactttacatagtaaagagaaaagacatagtaatagcttggaaagttgtgttgggttactatttcaatttcataagaaactacatctttaaaaagtccatgaaagagaaaatttgaaccagacattcaaaattcataaaatgtctacttaaaagtcacctgtatcttccacattataaatcattttctgtaaccaataaacacattgctaatcttcatgactcattctgtcaacagccacagatttccactaaaggaagaaggcaactactagaaggtgacccttgactcttttgctatccataactttatgctacctgactggcctagaaagggga

SEQ ID NO: 6726 - DNA, 4837 bp, artificial
  synthetic oligonucleotide
caagtagcgtctgctgtagtacacaaggttttttcactattgagacagctttcataggcaaatgacattaaattgcctcaaaaaatgtatttgtgtcaggagaatatattacctgttgccattagaaacactaaatgagtggacaccacatcactaaagatttagtgattacttaggttaaaattaaaatattaactgacatcttacctcacacaggtatttaaatttgcttgcaaacccccatctccaaattccctcttccctcaaactacagtattactcagattcacacataagcagatttagtatcataatacaataatatttgcacagaggcatggttgcgctagctgttttcttacagatgcaaaacaaacaatttgaagcaaaattatttcataggcaaaataaaacatgtcttttgtctttcctagaattcttcatacagtccaaatgtaaacttttgtaatgagctctcgcacagtagtgcctactctcttgaagtccttttgaaacctgtggagctcaatctcttcgaatttggccataaaaattctgttttgctatgcactagaacaagtcaattgttgttcccaggcttgctttctctaggatatctcttggtggatataaaaaaactgatcaaatatttggcttataaataatatttggaaacactgcatgacacagtgtcagttggtttgtatttgtgatgaaaagaaatgaaagagaatctcagacaaactttccttcatcagagatccaacatttctttctgtttacaacattttattctgcaccttatccaactgttttattttcactatatcagcatcattttctcactgaaggactcgcataccagataatgtgatttagttaaaaatggagtctgaatcaattcaacaagaagatgtaacaaccctaaatatatattaacctaactccagagctctcagattcataaagcaacaactactatacctaggaaaagagaaagatagcaacacgataatagtgggggacatcaacactagacagcactagacagattactgaggcagaaagctaacaaagaaacccaagacttaaactttactctagaacaagtgtacctaacagatatttacagtacattccaaccaaaaactgcagaatatacatttttttaatcacatgaaacattctacaagatagaccatatgatatgtcacaaagcaagtctcaataaatttaaaaaatcaaaatcatatcaagtatcttctcagaacacagtagaataaaactagaaatccattccaaaataaaccctcaagcctatacaattacatgaaaattaaacaatctgaatatgactgacttttgggttaaaaatgaaatcaagatagaaatttaaaaatttttcaaaatgaataataacagtgacaagttatcaaaacctctgtgatacagcaaaagctgaattctaccataatttcaatgaagaactggtaccaagtctactgaaactattccaaaagattgagaaggcaggaatcctccttaactcattctataaagccagtatcactgtaataccaaaggcaagaaaggacataacaaaaaagaaaactacagaccaatatccctgatgactacaggtgcaaaaatcctcaacaaaataccagcaaaccgaatccaacagcacatcaaaaataataataataattcactatgatcaagtgggtttcattccagggatgcagggatggttcaacatatgtgagttaataaatgtgattcatcacagaaacagaattagaaacaaaaatcatattattatctcaatagatgcagacaaataattagataaaatccagcatcgctttatgataaaaaccgtcaacaaactgggcattgaagaaacatacctcaaaataataaaagccttatatgacaaaacttcagttgacattatactgaagcaggaaaagttaaaagcattcccctgaagaactggaacaagacaaggatccccaccttcaccatttcacttcaacatagtactggaagacctaaccagagcaatcaggaaagaaaaagaaataaggggcatccaaattggaaaagaggatgtcacactatctctgtttgccagtggtataatcttatacctagaaaacccgaaagactcctccaaaagactcctagatcagataaatgaattcagtaaagtctcaggttacaaaatcaatgtacacaaataagtagcatttctatgcaccaacaatcaagctgagaattaaatgaggaactcaatcccttttatatttgctacaataaacaaataaaatacctaggaatatatttaaccaaggaggtaaaagtactctacaaggagaactacaaaacactgctgaaagaaatcatagatgacacaaacaaatggaaacatatcctatggtcatggattagaagaattaatatcattaacatgaccgtactgcccaaagcaatctaaagattcaatgcagttcttgccaaaataacaacataatttttcacagaattagaaaaaaaaaatccaaaaaatcatatggaacaataaaagagcctgaagagccaaagcaatcccaagcaaaaagaataaatctggaggtatcacattacctgacttcaaattatactccaagattgtagtaacctaaacagggtggtactcacataaaagtagatacatagaccaacagaacagctattctattagaactcagaaataaaaaccaatacttacaaccaaccgatctttgataaaacatgcaaaaacacaaattggggaaaggttcacttcagtaagtggttctgtgataactggcttgccaaatgcagaagaatgaaactggattcctgtatctcaccatatacaaaaactaactcaagatggattaaagacttaaatcttagacctgaagtcataaaaattctagaagaaaacctaggaaaaaaactattctggacattggtgaagacaaagaatttatgattaagtctccaaaagcaaatgtaacaaaaacaatagtaaatgagacctaattgaacttaaagccttctgcacatcaagagaaataatcatgagtaaatagataacctactatatgggaaaataaatttgcaaattatgtattggacaaaagacatatttctagattctacagggcactcaaacaaatcagcacgaaaaaatatcaaattatctcattaacacgtgggcaaaggacatgaatagtcatttctcaaaagaagatatgcaaatggccaagaaacatgaaaaaatgctcattgtcacttatcataagggaaatgcacattaaaaccacatgagataccaccttacccctgccagaatggccgttatgaaattcaaaaaacaatagatattggcaaggatgtcattaaaaggaacacttatatacttctagtgagaatgtaaattattaccctttctatggaaaacattatagaaatttcttaaagaactaaaactacatctaccatttgattcagcaatcccactactgggtatctacccaaaggtaggggaaaagtcactatatcaaaagcatacctgtatgcatatgtttatcacagcacaattcacaattggaaagatagggaatcaacctaagtgcccatcaacgaatgaatggataaagaaaatgtggtatagcgagtaatactactcagccataaaaagaacaaaataatgtcttttgcagcaacttggatgaaactggaggtcattattctaagtgaggtaactcaagaactgaaaatcaaatactgcatgttctcacttataagtgggaactaacctatggatatacagggttatgcaaagcaggataatggacactggagactcaaaagcaaggagggtaagagagaaaaagggatgaaaaactgcctattgggtacaatgtacactactagggtggcagttgcactaaaatttcagacttcatcactatataattcatccttgtaaccaaaaaccacttgtacctctacagctattgaataaaaataataaataaaataagataaaataaattaaaaatggagcctgaaagcaaagtccagcaacaaaaacaggggagtcacgttggtaccaccaaatctaaaactgctagttttagacgttttactcaatgaaaagttatctagagagtaaatcttgaaactattgacccacaaaaatagtggggctgattttctgaaggggttgagtacagttgtctactttttttttttttttagctcctttaaaattcattctctgttggttaaatagaaaggacatttttaggacattaaatgaaattctttaaaactttgtgttttccaatattatttcatattgcctctatttccaaaacttgcacatctattttgtttatttttacattacaaattatgatattaatatttggtatcatatcttgtgattactgcaagttcattcttattgctttcaagaacacaggatttatataaaaataataatgaaataataatgccattttaggtagtatcatagcgtaattaaaaattaaataaataatttggcgtctagagtgtctactacatattgtgaagttaaatgcttaaggtttggaattttcttaaacagaaaaagaggttttaagctcaaaatggaagctcttttcaaattcttctcctgtatggtataacatattgccaagaggtgaaatatttgctaatcagaaaggtgagtcaggtgaggtatttcaagtataattatctaagtcatgttatggctaaccatcagcatcaacaa

SEQ ID NO: 6727 - DNA, 411 bp, artificial
  synthetic oligonucleotide
gttctgacaatattcaggagcttctagtacttatccaggaagaatatatttctagttcttatcaaaccctcaaattcaccttctcaattgcagaactcatattatgacagagtacatatcttgtagatgtttgtatgtggtcaaaggtgattggactctattcaatacatatgtatttggaaaactatagtccgttctacagtgatgatccttgtagctttgtttagatgattatgtcagctctttccccttaatatttacctcatcaccaatacaattatttggctataggcaggggaaatgaggcttctgagtggctaactcttcagtatagatacattcctgataattatatacactatttgaccacatcactatgtcccttttaacattattatttctcattcacca

SEQ ID NO: 6728 - DNA, 266 bp, artificial
  synthetic oligonucleotide
agtccagaatatccccaaatccatatctgaattattgccactgccacttcactctttttctagaatcaaggctctcctgcctgcagtccattttacttagtgctgtcaggatgaattccttaatatacctacaagcctgaatatgccccacattgacttctacatcaagaccagatagtttggccttattatcaatactctcaacaatgaggctccaacttatctgtccaaccttaccactctcttttctgctcagctctgtcttt

SEQ ID NO: 6729 - DNA, 315 bp, artificial
  synthetic oligonucleotide
ccattatcttgtgctttctttacctaagtgcctcagcacagccaatcactggcaacatggtgttcgctggcattcataatgctgatttcatggctctgtgccagtttgaaaatgccttctaaatcttcacagaaaggaattttcttcagcctaatttacttgttgtattttatcatattctaatatactgaagaatgaagcatggaatttcataagctcactgataaccttctatttcctcagccatgctgggtccaggagaatatacttcaatctctaaatacaagaatatgtggctgcctggcaatcagccca

SEQ ID NO: 6730 - DNA, 1143 bp, artificial
  synthetic oligonucleotide
cacctacctattattttcttggcaatgcttcacttacagtgagactctgtttggcagagttcacacatttcacattcaggttaaatattataacagataaccaagcttttgttctccccctccccaagccacctagcacttccttaaaaccccccacaagcataaattgttccacaagttgccaaagtgaaattggagtccctgccctaggccactacacttcaccccaaaattgagaaaagagtataaaatattcttggataagagatacaagaagctggtttcctgggtagaagtaaaacatgtctgagacagagcatagtcctgggaacatgatctcaaaagttcctcaccatgaactggctatttaaaattcatttgtaagtcacttgcatgaaagaaagaagaaaaggcagtggccctgaaacagagcccaggtctgcggaagcagcaggtcacaggataagaaaggcttggggtagtatttattaaagtgcaggtcacaaccccaagccagtggtccatgaaattgccatctccagagcttcctagctaatggagatacccagcacagagtcatgcaggagaaaggttgaaaaatgccagattaaggcctaaattgatatccactgactctggaaagaaaatactaagggataacatcagaagagggcttctggctctctggccagcacatctagctaactctgattcacgtaggacctcctcccacttcacatttgaactagagatgggtgtcacagtaaggaacaatgagaaactctgaaggagccactaaggaaaagaatactgtgatgtaaaaaggaatttgtgtaactaaaagcagaaaagcacactgaggtggaatttgtttgcagtaacagaatagaggcaaatgaaagttttctttaatttcaaaattcaattgtgttgccctctacagtacattgctagaggcagtaagaatctgattgcctccttccagattaagaggcacaaattagatattttcctagtcaaaaagagatcataatagtaatagctacttaacatttactgatggcttattatgtgccaggtgcttgaacactcacattgaatcctcacaagaatctacgaggtaggtcccattactcttatttt

SEQ ID NO: 6731 - DNA, 1572 bp, artificial
  synthetic oligonucleotide
cttagaatggaataaaaagctgcttatttccataatgttggccttcaactgtataaaaggttagataatttatcatgatatacaaaacagttttcaagaatacccaacttaaaaggagatctcggtgacttccagctctataaatttttaggtagagtgataatcaacataatttatgtttaagtgaatttgtgctctcctgaaaggtctagtttgccaggcaagacgcgtgcatctcctattcatccctagaacaagtacaaaccaaatgaagcaaggttagaatacccattgctgcctttatggcagaactcgcgttggacaggaagacatatttgaacagagaggctctgagttttggcatgcacactcacaactcagattatacacagaatatgctgccctcattaaaagctaatgtgctgtacctattgtttcacctgccatagctaagtcctctgccttcaataccacctacagagcaaccattgtcatcacatggactcaaacttcaatgcaggcagctatatgaagcccttcaaaccaatgctgcaaacattcacacatttacacccagagctgaaagataacttggagatcccccaacccaatctcttcacatattgttgcaggtttggtgtagtttggcatttgtctggaattttcagaattctctatgtcttggattctgatttccctagtaataacaggcttcaataaactaaagcttctcttttatgaggtttttaattgtttcatctgttttggtagtgatctcccctacctcagaactgcagatttctagatggttatctttgatgatacagtcacttgggctcactcacacactagagaaaactgtcctgatagagtttgctaggctcaaagagtgaggacagcaaagtgttggaaacatcacacacatttatttgatcccatatttccaaatatgacaccatgcatagccacaaacctttacaggtacggatttttctccaccttccatgatctcctcttgagggtacctggtgatcagatgtgcaaagaccaagccccggatgtcattccaacaacgcccagtgccatggtatttatagcttaccagttttataaggttttgctccatcaggccactacataatgcatagtttttgcaaaggcaggttagctttctttccatttcagaaaattattatattttttactgcaacaaagcacacttctttttctatttctaaagaattaccagtaaaggcaaaatagaatgacctagaagtgtaagcacacacatgccattagtaagtgcacaagccacacagaaaattggtgtttcatatgtagtatttgagattcgtttccaaaaagccataactaccataaaattattttgcaattttaaaatcaggcaaaatcttcactacgaaaaaaccattatttagtacgaatgccactgtgttctctcccctaagcttttaggaacaaatgttaccattagcatactccatcactcaaaagtctatacttgaaaaaatggaaatgcactaattaaagaaatgatcagaacagcaagct

SEQ ID NO: 6732 - DNA, 7969 bp, artificial
  synthetic oligonucleotide
ttcaactgtttcgatgagacactgctggaaaaaaaatgtcatgtattatcctaaattggattctaggattctagaaatgcttagacttatgtgctctatccaaatgtaagaaagggcttcagtaagaccttctaatgtgcttatcaggaaatctttttaaaaaatactgtgtttcttcttttctcccttttcctcccccttctatccctctctctctccctcccccccccatacacacacagacacacacacatccttcacacacttcaagagaaactgtaacacaatagcccacagtgacatccactggtaggaaccagatcttaatgccacaacacagtctcacattagaggaaagcatcatcaactctagaagattgctatttttactgaaacatctggatgcaaagtcttgttcctcattgggatgtttggtctccacactaccaaccaaccagatatttgaaaacatacagatgcctgatagaatttcactttatatagccagatgtttggggactagataaaaaacaagccaagaataaactaaaaaccactaatcacctgcatctccacacactcctgttctctcctccccctcatctccctttcccatcttacactcccactcccagtctctctccagagttcatcactgcaacaagacagggtagctgccaacactccctctcctttcattcagtacctgtcccaaaaacactgtgccccagacaccaagttgtggtagttggtggttttcctaaaaatatgatctctctctctctccccctccctctctctctctctgtttttcctaccataacttcatggagacagctatgcaaattttaaaatgataattgcgtttctgctcaccatcattatgtgacagaatccattcaaacactaaatgattgtcttccagcaaattgtcagatcaaaagaattgatcaacttggactgtcacaaacttttcaccctacaaaaagaagcactgcaagtatgctgcatgcatttaagtaggaaacaaaagcaccaggattttcacacagagacacagataaacacaccttattcatccaagacaaagaaagaaaacttggctttacctgcagttgtaggtccggatctctttgttgtctcgcttgcacttgattgccacgaagatcatagttacaaagaggatgcccgcaatggagcccagggcaataatgaaaatcaaggacaagttcacagagcccattgactcttgggcatcgagagcaggggacaagtagattaggacgagagcagaggcagagagagatgtcttgccgtggtcgtgagccaccacgataagctcataggaggacttggagctctccccgaaggtgcgggtggttctgacttcgccattgacctggtctatttcaaagaagccgcggtcgccctcggtcatgtcgtaggtgactcggccattttcgccctcatcgtagtcttctgccttgacaacagtcaccaggtagcctatgccagagttgcggggtatgtagacctcggcagtgccgttaatcagaggtggggctgtgatgaccggggtgttgtcgttgacgtcgaggatgatgacccgcaccgtagcgttgctttgcagtgagggaaggccgccgtccttggccagcaccttgaattcgaacgccttggtctgctcgtggttaaaggatcgcagcgcgtagatgtcgcctgagttgggattgatggagacataggtgaagacaggcatgtcccgcacctgcgacggcacgatctggtaggagacactgccgttgagacccaggtcggggtcgcgagcagacacagagagcagataggcgccaggcgtgttgttctcctgcacaatgacctggtagtagggcttggaaaagtgcgggtggttgtcattttcgtcagtgatgagcacggtaaaggacttggcactctgcagcatgggcacgccgccgtcgcgtgcctgaattgtgaggttgtattggtcgtgctgctcgcggtccagccgtccgtccaccagaatagtggagaagctctcatattcctgcagtcgaaagggcacattgcccagcaaacggcactgcacacgtccattgaggcctgagtcgcgatcagacacccgcaccaaggcgatcacgtagcccgggggggcgctctcgctgacctccacaagctcactgttgactgacagcaggttgatgaccggcggattgtcattggtgtccagcacgctgacggtgaccttgcagtgtgccgggatggaattgggccccaagtccttagcctgcacgtccagttcgtacacgtgcccctcttcgtagtctaaagcgccagtgacagtgaccaggccactgtgcgggtcgatctgaaagagctcgcgcgtgcggtcgttgacgtagccatagaaggagtagaccacctggccgttggtgccctcgtctggatcgctggcgttgaggcggatgacgggtgtgttgggaggcgagttttctggcacgctcaccgcgtaggtggactcgctaaacaccgggttgttgtcattggagtcggtcaccttgatactaaggccaacggtgcccaggcgcggcgggtcgccaccgtctagcgcagtgattcggaagctgtagtgcgactgcgtctcgcggtccaggctcttttccaccacgagttcggcaaagcgggagccgtcgccgcgcgtcttgatctccaggccgaacagctcgttgggcgtgagctcgtaagtctgcacgccaaagcttcctgagtctggatcgtaagcgctgtccagcgggatgcgcgtgccagggctggctgcctccgagatctccagctcgatctgtgctgccgggaaactgggcgcattgtcgttcaggtccttgatctccacctttatcacgcagatttccattgagctggacatgacctcgagcgagatgatgcacttggggctctggcggcacagcagatcacggtcaatcttctgcttggtgaccagcaggccagagctgggattgatgtccactaggtgtggagccgagttggacaccacgcgaaaggctgaagcctgccgggggtccagcgcgaagcccgcctctcgcgcgtctttggccacgttggcaatcaccgtcccggcgcgctgctcctcttctaccgagtacttgagattaatgagggcggcagcctgcgtccacagtatggccagcagcagcagcaccggcagcaggagcgactccatggctgcacggggctctgcctggcctcgcctctccacacccctccgagaccgacgccgtcggcgctccagcttcccgccggctcgggccgcctgttgcgcgcgccccgtggccccggaggccgcgggagaagtcccgcccagggcggcccggcggcgcgcgggggacacccgcggcggctccaatgctgaggttgcggcggacgcggcgggggctcgcgggggccccgggggctccgaggggccaagggagcgccgcgcggccccgagccccctccctccagcccggctactcagttttaccccttcaaagttagccgggcgcgactgtcggcagccgcccagggctgcgggtcgggcggcgtctgcgcggcctggaggacgcaccgctgagtccggacagtacttgaggcgaaggtaaagagggcggaggaggcgcagcctttcaggcactgcccggcccgccgcggtgcaccggcactgaggctggcgaactcgctgtctgtgcacctggcatgcgcaaagacctccccccagcgctcccagttcactgcggagagagtacccgcttggaatgcgccctccggggtctgggggggccacactggcctcttcgaggcctgttcgggagaaagggggtgtcgcagacgggagtcagttactggcaagcgccgcgggcacccggttatagggttgagtcggatggcggtcccggggccagcagaggaagggggaggggagagaggctgccagagcttgagcgcgctccctcgcgctaaggctggcttcgaagggcttgggggcgcgtctgtccaggatccgaggtgggagcggagttccccccacagagcagttgagggtctgcgggcgttttcgtctaggaaatcaaagttaacaacgcagtccgaccctccacgtcaagtttgtggaaacggggagatggcaatttgtccaagaaaatcaaagccccggtctttctaatggccgggggtggcggggaatggggaagagggaaggggaggcaacaacagtaccggccaggagaggcggggccgccgccgtgggtaccgggtgcttctcttctctccgtttgggctggggtgtcgctccaaggtccgccgccgccgccgccgccgccgccgccgcgggaggaagccctcctagctcagttgcacgtcgctggggtccgcctcagcagctgccacagtcgacgattttgtcgccgccgaagtttacttgcaggagcgtcttgatttcatcttcccggagaggcgctggccgcgctgcgttgggctcccttcctcccgggcgctcgcgcactcgggaggtctgtctcgctttctctgtctgtctcgggctgtgtgtgaatgtgtgagagagagaggaagagtgagtgtgtggtgtggggagtgtgagtgtggagtatgagcaagcaggaggcaatgggtttggggtaggaggtttaggatttcggatgaaatcgctcagccggaatgctgcggagcgcaacgcgccaagggccagcgccgggctagggacgcgggtgccagtgcctcccgggcaagccaggcatggtgcacgggagctgtgctgccgtctgtgcccgctcgtccgtctccgcgctgcgccagccgccgccgctactgctgctgctgctcctccggatgccgcaaactactggccgcggagtctggagaaagccggagaaagctcaagctgccgagcccggctacgccaggccctggccaatcagcgcgccgccagcgggctccagtcttggggcggggccaagcggaggcggggggtagcgggggggcggggccaagcggaaacttcacaccggcgggaccaagtggtaccccggcccatggagccctggcgggattcatgggaggacggacagacaggccaggcaggccaggcaggagcaatagggcaggaatgagcagggaggcggtgtgctggcgctgcggctgagcctcgccgggaactgtgcgcttctcatgtttgcagagatttcaggaaagatgaggatgatatgattgtcttatcgtgtttacctcccttacatatcttcatatcttgaatataatatatacatatatatacacatatatatatatatacacacatatatatatccctctatttctccttgtctcttcaccctaaaaaatcgtctgtttttgttttcctctcttctcattctctggtagtggaaggaagaaagggaaggagaaagcgcccctgaggtggtcattcatccagctcttagccggtgtgtcttcacatcaggccagagccacggccgccacccccccggaccgtcacccccatccttccaccccgggcagacgccgcactactctctgcgtgccgcactcccagcagggcccctggatcggttcgctcttgtctgttgcttgttaatcaaatgggatatgtggcacagagaatgagctacggagggggccggacacatttcattgcccctcaccccaccctgttggagaatttagctccctataaataaactgtacgtttgagaagagccggtggagcggacgccgccgcgccgcgccaagccagcagagctcaaagccgggcaggagctctggggcgggcacgccatacatgtccgcttaggtcgccgacagctgggagccggcgccgatgtgcagggcgccccagccttcccgcggggtctcggtcccagggggctgccagctccacttgggcggcggtggtggctgcggcatgtgccagtactgggaagcgggaggccggcgtggccagggctgacatcaagctcatcctgccttctgcactgaaggctccctgggggcagcggggcattcctccccacccgggctctgaggcttttaattaaggtcgccagcggcaaaaaaatcaaaaacgtgcccgttaaacaagtttttttttctcttagaatgtggggaagctgcttctgaattcacaattcttggaagagtaaaaatgtcttctgagtgagtcgtctcggatatttgggagtgggataagcagactcataattagcccagcgacattggctcgagcctgtgggcttcacatgagcgtcatttttgccctctaaaaagcgttaaacaagaaaaggaaaccggcatttggacacataatgggttttctcaaaactgccatcttcttgtggagagcaacccagctgctttttaaaatatttttccttccaagaagagctactttagcagcctttaccttggcggtgggagaggggaaaggcggcttcctcttacagaaagaaattatttcgcgagtgagattgcgatcccctgaatatgtagccgaggccaaagggagagcgtagggagcctgatccgctttccgcgtgggggtcgtttcactgtttcacgttaggatgtgattcggcccagaacaacagggagaaaaccgatgcttctgcaatgagtatcatttaattttggtcatttagagctgcgggtggacaccagagtggtggctcaagggagcccggtggcccgaccggttttctccagacaccgttggagaaatgggcaagtagtagagaatgacaacatggcaggcagcggtgggcgcacctcgcgggctccgcgaaaggaagggttccatttgatttatcacagttatttacctttgatgtcagagcatgggaatgaagtgcatcttggtctaattaaaaaggcctaaaaaggcatttgaaatgggtttgctatctgatcacgggatgtgaattcggcgtttggcagctttctaaaatattgcttggactatttaaacagaacaattagcagcatgctaaaatgtttgcatgctatgcttagaagcttttagctgtaaactttaaggcgatctgttccccctttaagttaaaaaaggatgatgctgcttccttgtggcgaaggctgtcaggaacccactgatcaataaaagtaaactggcgcctccacggcttgattgagcgggagcaaagagtctgagaagtagtctcggccattaacaatcccccaggtaacgagaaatggaagaattactcaggtaaaatgattaacattgtcgtagcatctgaaaagatgcacacaacaagataagaagactgcagacctcttaccttagggagtgctaatagaatgtctatattctgctgtcttttaaagataaataggagaattcaattcatgtacaatgtcattaccttcataattgcaatcacaatgtaaagacatgttctgcatttgcaaagacaaaccctctttgctaaggcgatgccaccgtgttccctgcttcctgctcgctgttcacactccaggcacccctcttttccaaggagagcatccaagtacttccagctaccaaaccacttttacacaagccaggtgctaagggaggcaggggcgtgtgcctatgctttccttctttcctattatctcctccccacccctaatctcaaagtgacagttacacagccttccccatccccacacacaaaatagctcttccatcccccagtctatttctacagataatcctaacaacagcctttgccctcagaatttctttttttctaataggcacactcgatcattatactccaagaatgccattgactaaatgagtagcccaaaacactttcatgatcaggaatttattaactaactgaataaaatcgttctgcatgta

SEQ ID NO: 6733 - DNA, 2259 bp, artificial
  synthetic oligonucleotide
aactgtctctggattactcaagcataagaacactagggaggaagtgctgtacatcataatcatctagtgacacagtgcttgagtttgccattcagaaacagccagaaatcttgtcctctttcccactctgaatcacccacccgaggaagtgggagtagtggaacaaaggagagagcctcttatgtaactcctttgatgacacaggaaaatatctccagaagaaattttaaaatttaagaaaactagactgtgacatcccaaaataagacagtgagataaaaggttaaatataaaatggcactcagaatacatcccgttggaaattgaagtgttctgattgcacatacctactagcatatgaaattcatggccaaagaggccaattacagtactaaagggagtcatcaaaattgacaaaggaaggtagtgactgaagaggggagtcttttggaaaatggtaaatactagtaaggaaggaactgctcttgtcaggacacaggcaacccccatattgacaaatccagtagaaacctctctgccctcttacataatggctcaaaaatattcaacatgcttaaacactttctctttattgatatcctttacttacttggcttgcatgacaccacactctgcttgttactccttaccagtctcctttgctgagttcttctctttttgtcctctaaatgtgatagagtgccagagtttgattctaggccttcttctcttgagaggcaataatagtatagccgttaagagaatgaactcaagccaaactgcctggttttgaatcctatctgctacttacttagtgtgaaattggaaaatttgcctaagtctatcagtgcctcaaattcctcttttgtaaagtaaggagagtaatagcacctacctcatagggttgttgttaagattaaatgaacccaaccgggcgcggtggctcatgcctgtaatcccagcactttggggggctgaggcaggctgatcacgaggtcaggagatcgagaccatcccggctaacacggtgaaaccccatctctactaaaaatacaaaaaaattagctgggcgtggtggtgggcgcccgtagtcccagctacttgggaggctgaggcaggagaatggcgtgaacccgggaggcagagcttgcagtgggccgagatagcgccactgcagtccggcctgggcgaagcagcgagactctgtctcaaaaaaaaaaaaaaaagaattagctgggcgcagtggcaggcgcctgtagtcccagctactcaggaggctaaggaaagagaattgtttgaacccggagggtggaggttgcagtgagccgagatcgtgccactgcactccagcctaggtgacagagtgaaactccatctcaaaaaaaaaattaaatgaatatatatatatatatatattcattcatattatatgctaggtgctgttctaagttatatatatatgcacatatgttttatatataaattatgtatataagttatatatgtttatatatatctaagtcatatatatataactgttttatatatatatataacttagaacagtacctagcatataagcactacatacatgttcagtattattatcattataatcatcgtcattactatcatcattattgttattgctgttattctcttttctgtccacactgttgcttaggtaatacaatttattcccataatcttaaataccattcataggcaaataacataaaatgatatcccccaactctgacctctcccttgacttctgtattagtcacagttctctaacaaaagaaaaccaataggatggatggatagataaacagataacaagagatttcttatgggaattgactcatgtgattatggagggcaagaagtcccaccatatgccttctgcaaggtggagaactaagaaggctggttgtgtaatgcagtctgagtctgaaggcctgagaaccaagggagccaatggtgtaaccccagctctaaggttaatgacccaagaattgaagggccactgatataacccaaagtccaaaggcccaagaaccaggagctctgatgtccaagggcaggaggaggtggatatcccagctcctgaaaagagagcagattctcactttctccattttttgttctatccgggtcctccatgggttgaataatgcccattcatattgggtgagtggggatcttctttactcaatatactgatttaaatgttaatctcttccagaaacaccctca

SEQ ID NO: 6734 - DNA, 1351 bp, artificial
  synthetic oligonucleotide
ttgaatattttcctatcagcaaagttataaattgtactatctccgttttaataggtatttatacacagaaaaacgacagggaatataagtaagtaattttcttctggtgactatcagtctttacaattttctaaattttcttttaaattagaagtggaccagaatttttacaagaaggccattattgtcagctacaggtttaaatacagaggtctgactcttctactttaataaatccatttttatctctcagaggataaatgtaacatgctaagcttccctaattcaggcttacctcatgtctgaaaacaaatcctacgatggcagcgaccagttcgaccaaaaaaacgagagtcagaaacattgcatactgcaggataagaaagaaagtccaagtcagcataaataagatatagcacaactgcaaagggagtcaaagaaaaaataatggtcgtcttctcaattagttcatcatgttttcattgaaaagggcagggaaaataacaacatgtctattttgaaagtggaaactggcagctgaactgttacttgataagtttccataaggaacaggaaaaattgtaaagggccatggccagttccaacaaaggaattctataacatacaaaacttttctaaaaccaagaatcaattctaatgaaaacaaggactcaccagttttagcatccatgcagaagctcggcaggtagcaaaacaaccaaaggtgcccaaaagaataatgacggtaccagtagcaatgagcacgaaggggacattggtggccttctcatttaaaagagaaaagtaattctccaggctcaccttgccccaaatgccaactgcaagaaggataacgccagtgatctatgtgggaattcagagaatacaaacagttacgcactgtgtacagcagcatcttcaaatcacaacgcatgaggtatttaaggcacaataggtgtaatatgctgggatacggcagacaagggggaagagtagaaggggttagggggggatctgcacacaagagcaggctgtggaccaggtatcttatcaaaattcttaaaattcatctttttgtgtgtaaacacaagcccatggcatatttgccctagggatcaaaacttccttaactatcttactccaaccttaggaagaaaaccttgaaggggaaaaaaaaaacgtgattttatgagttccagaaacttcccccgtcctctccaggtagggatgggcacagggtacaaaggactggtacacaaaagcaagcccaaggatagactggcgggagtggaggcataccatacttacctgcgaaacactcctctcttacgaagcagtgaaaagaaagaca

SEQ ID NO: 6735 - DNA, 1836 bp, artificial
  synthetic oligonucleotide
attacatgtctaactatacttttgtgaagggcagtgcttagagggcctgactgtactatggaggttggaggaacccagtaacagaccacacagtaaccaagcactgattgatctaaaggaactgaggaatgctccccaagtccttcccccagggctgaagagggacaagcagacagaataatgtaggaaatgttcccctttaatttcattcttatacccatcttagtattccaccatttgcaaaaaagaaaaaaaactcaaagataggcaaagaggggaaatgggaaaatggaaaggtttaaagtggcaagatggtctgaaccctttctccacacaaagcatagttggcactggtccagctacttccgcaccctgatggagactgtaattatcttattgagtcttccccacagttttcctacatcccttgtaattctggaatgatgtaaaatgcttggtggccttcgatcccacacacacagtaaaaaagctggattgcaaaagagattttggacttttaccccagttggacattatcaaaagctcttccctaatcaccatcttcagtggagtgtctgagtttggtatctagggggtcaagcagacctgggctggaatgcccactctgctgcttactagctgggagaccttggttctcttggttcctcaagcctgtttcttcggctttatattggagcacattagtagtacctaccctgctgacatgttatggtgacataatgaactaacatatgtaatgtgcttaacacagaatatgagctgagagatgttagcagtcattgtcgtagttgttcttgttgttgttactgttaccaagccacagggctctgacactcctgacactcctgttttctcttctgttaaacagtcctttgctccctgctgagcatgtcttcaaaagctggctctgtaaccggagcaggaagacctaatactttagggaatcacccacatctggcctcctgtttacaggacctataaagctttgaggctaatactgaactgaaacagctgacaaaaattccatgacccgccccccgactcccccgcacccaccaaagaaacctcccattatgggaaaaaagagagcaggggagatgaggtctgagaagaaatcaacggaagccagaagaagaactgaaatgggaaaacagaaaaaaagaaaaaggggaaaaagaaaaaatgaactctttcctctggaatgagggcaaaccaacgaggacatgatttcataaggcaaactttcaattgattcattcccttgttcaccaagttggactggtttcccaatacctcacctcccccacccctagtctgggcctgtggggaatggaggagcttcatcatctggccctctgctccgcccttcagtgcagggggccctgtgcctcttcccaagaggaggaggcgagcttgtggcctgagtatttacacaggccaaagggctccagcactaaaacccagccctgtcctggaagcacaccctctcctggaaatagggaattgtctcttgactccaaaacagctggctaccctattcctgtgcatgcattagggctcagggaggctggaaggagggcttccggaaacttcactccggaaaggaccaagttgttttccaattagttcgtattcatgaccgatttcctgccgtctggtggaacatactgtttagtctcccagacagccgcagacctgcctccactagggactgggccacttaactggatggagatagattaggaatgttctctagctcagcagctccctgttaaagttccttctgattagagaaacaggaaatttatccgaagg

SEQ ID NO: 6736 - DNA, 1610 bp, artificial
  synthetic oligonucleotide
attctgcaaggtagtcatctttacacagcatgtccataaagtctggaaacagatggtaatattttcttttaaagattgtcagtcttttgataacaacatgtatattcacctgtgtttccagactttacaaacctttgtctgcatttcagatttaattccttaagaaaggaaaattccagctctatccccagccagtggaaatacagaaaagccatttttctgatcatcctaagtcttctgatctagaaagcccagcatgggcaccctcttagcctttccttcttataagaaacaccataacttctaacttgagctcctccctgacagtgagacgctgcccaactctgaaacctccgcagcacggctacctcacctgcacctcagcgggggacaactatggtgccacctgtgaataccactgtgatggcggttatgatcgccaggggacaccctcccgggtctgtcagtccagccgccagtggtcaggttcaccaccaatctgtgctcgtgagtgaaaccggggaatggggcaagtggatgtggtgatcaggggaactttggaggatcttcctcatggacaggggtccaataacaatgtatatgatgtgggaaaggggggttctgggatgtgtctaatttaaaggccaacattcccccgtagactactcctaccccaagaagaagggtttaaaatctctaagtgttcttttaggatttcccccaagggatgggagaaacagccagagagaggtaacctgaaagactggaacacctcaagatgttaggttacctaagctgggatggaggagaaagccgtactctgactggtcacctgcttctgccctagctatgaagattaacgtcaacgtcaactcagctgctggtctcttggatcaattctatgagaaacagcgactcctcatcatctcagctcctgatccttccaaccgatattataaaatgcagatctctatgctacaggtaaggcccactcccctaaagagggcttagctcctgtaaattatcccttaccttttccaaatcagagttgttctctgcagcacaaaccttacctacttcctgaaactttttgtggatagcatttgatcagttttaccatagacatatttagcacatttaaaaaactgtttttactgaaaaggcaataaagtcactggagtggtggctgtgacttgcagggagctgggtgaaagatgggaagggagtgtggcaaagcactctgaagagacttgcaagacagctatgatcaaatgtaaatgttgggaattaagtacatttatgttttcaaggaataacagcgctaacaaacacttatgcagtaagtgctatgtagctatccagtactgatctatgggttttacacatattcatccaattctcacaacaaccctttggaggtggatactatcgttatccccattgaataggtgaggaaactgatgcatagagattaagtcacttgcccaaggtcactagctagtaagtggtggagctgggattgaacacagggagtctggctgcagaatctgtcctcttagccactaccagtagcaaaaaagaaggaaaagcgttatgatatctcaaagtaa

SEQ ID NO: 6737 - DNA, 2077 bp, artificial
  synthetic oligonucleotide
tgctgtgaaacttgaacaagacaaaagcaagcatcccagcgccccatccagagtccaactccagggacgtgaagagtcatgagaacagcggcttccgtggcggctcctttcgcagcccctcaggcagggtgtagccgatctgtcgggggcaccgacactcagcagctcctcacaaagagtcctgaccagtgtgtcctctcaagtcagcggagagctgagccagggcagaagagcgggcgcagaagaaggagggcagaagaggggattcagttcagtgcctaggtatcctagctattgctaggctgtagctatcagctggcccgctcacctgcgcgctctcaggacctttgccgagtccagggttctcaggatagctcctcggattcccccaagccccgcccccaagaccgcctggcccgggagtggagtattgtcaccaccctgtctccgaatgcagtgttgagggacagaagcagagcgcgctcgctctacaggatgaagaaaaggctggaggggctgcttctcctcggagaaactttgctagtgagaggcacgatgtgcggggcgccaacctggctggacggaggtcgccaaactcttggacgccgtctgctgccagggtcctgcctggtctgcgattccagctgcgagaggtcggcagcttcaaaaactaaggcaccgggacggcgggggcgggcgagatgggcgggacggctgcggccaaacaaaaccagccggagagttcccgggcaggcggccagccgagggatgctcgttgtggagtggcgggacaaaaaggggcttgggccgctcttcagaagcacttctgaccaccacctccagacccaggcaggagccacagctttactcctccctaggagcagcaggcccccacttctaccccgccctccctaactagttaagtgacttgcttcaacactcactctacccacgctgttaggcaggtgtgtctccctccgccgcagggtggaacctccctaggtcctattgccctccagataatatcatgaagggggaacctgggaggaatagggtcagagttttcggcggagggaagatagaacaggataaaggtcaagactcaaggtcagcccacagacactgaaagctcatattttatgccttgatttctccacttgcaaaatgaggccaggataggagctttagaatgaacttacaggtctttggttgaaaggttatgaagaggtgccaaattctaaacagactggcaaagagccaagagagagctgttagtaaaaactgagaggggtgtcttaaagagctttgaaaattacctgtattcttaagtgtaatcctccccacctcactgagcttttgttttcatatcttcatttgcataattctaaacctcagagaaaaagagaacacatctgcctcctggtaataatatagatgaaggccaggcacagtggttcacgcctgtaatcccagcactttgggaggctgaggcaggcagatcacttgaggtcaggagttcgaaaccagcctggccaacgtggtgaaaccccatctctactaaaaatacaaaaatcagctggtcgtggtggtgcgtgactgtaatcccagctactcaggaggctgaggcaggagaaaaacttgaacccggacggcagaggttgcagtgagctgagatcacgccactgcactccagcctgggcaacagagcaagattacgtcttaataataataataataataataataataataataataatgatgattatgtagcagagcctgtgccaatctccttttgctgcaggaagtcagtaaaacaaatctatgtgaggagtggccaagtagcagccaccaaaataatggcctccaggttgtcctgtcattatgttgttttttgtttttttaaggtttccatgattgctgcctcctttccccagggctgattcagggacagattcaacatctaaaggttgtcaccttctgaagcagactccgcatcttggtctgcacctatgctagcagctgggctaggaggctgctcctttctcctttccatttcatgaaggaggtcaacact

SEQ ID NO: 6738 - DNA, 3301 bp, artificial
  synthetic oligonucleotide
aactgaaaaaaaacagtaattctgggtcctttagacactttgtaaacactagtcctagatcctatgtaaatactagtcctagatcctatgtaaatactagtcctaggaagtattttctttctttctttctttctttttttcttttttttgagacagagtcttgctctgttacccaggttgggtgcagtggtgcgatcttggctcactgcaacctccacctcccaggttcaagtgattctcctgcctcagcctcctgagtagatgggattacaggcgcacaccaccacgcccagctaatttttgtatttttttggtagagacgggggttttaccatgttggtcaggcttgtctcgaactcctgaccttgtgatccgcctgcctcggcctcccaaagtgtgggattatataggcgtgagccaccacgcccgaccctaggaagtattttctaagttccagtgccatcagagcttataaaatttttagaggcaaatcagtgaacttaagcaacccactcccaaccagtctttgtctctctccatatacaccctgttcccagagatggagggaggaaagaagaaagctgcttttatcctttgctgtggcctgggactgctggggctttaaatctttgtatgtttgtgtaggagggtgaggatggggactttctgactgctattcatccacctattcattcaatttactcattcaacatatatttattaagtaacctactgtgtgctgggcacttggtaaagggatataatcttatctatcctgccagtggcttctcccaggtctctgagggtgtttggagctcataccctcttctctttaacaagcgtgacagttaaaagagtaagggctggtatggacaaaagcaggaaggtgcctggggtagtagtcattgaggtgagtcatggaggagctgtattttcctgaattattcaagatccattttgtttccccaatttgttgaggctttttctacacgtgagatctaagagggtgtgaggatgagacttaggggtgactggcagactgtcctgagcccaaaactgtaccttgagtaccagtgatgattccagaccacagtgtttcaaccctcaacacagaagcagaatcctggactggctaccgaggggcccctgccagctgctggctccaaagttggttttgtctgtgggctagatcggtgtaagttggggtccaggctgctcgctcagcagcctgattgatctccagggctcttttgtctcctcctccccagtggaagcctctccccctcttcccctctccccctctccccctctctccctcttccccctctccttgtctccttctctccccctctgcttctcaggctcttccgctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcggtctgcttgcatgtgcctttagtggaaaacttgcatttaaaaatgcccacaataaagtagtcaccatttagattcataaagaaaaaaaaaaagatgcccaagaatagaaactcaagccgatttgagcaactaaggtctaaaaatgaataagaaggaggtacacagtttgcttctttgagaaaagaggggcatttatttattttaggttctcaatagcatgctttttgtccaagggtatacttcttggcaggagggaagcaaaggtgtgtggaaagccttggctaacaagggaggagagaggaaacatgggaccttggagcaggttccctgaacaaatgagtattctggccagcagacaggacacaggagttctttgctgaagtaaaccaggctctgacctaagagcctggagctgaagggctcatctcatctctgtatttacttcctggctctgttgtttttcctgtgacatttttcccccttatcttctcccctggtttcctttctacaccctgtaatcaggaggcatctttccactcttgaaagcatagcttggagtggtttcaaatagggcttgcttctcttggagtccaacaccctatcaccttctgctctcaccacctttcccagcatcggaccaagtgccccagcctagtaagtgggcctgagactatatgggtagttaatgtttatccttcctttggtaggcaggtcgagccaggcctcacaggtgttgggtctaagcaggtggcaaggctgggctggggtggggtggagtggggtagaggagaacgtcagcagcagctgctgcctgcttccgttgaaagcatggtgcatgctgtctggaaaagaacatactttttaaaaatgttttctttttgattgtcaaaagaacaaaagccttaaaaaagctctatgtctagttcatcttaattcctgacttttccaaagaatccttgtttctagatgaaaggccctcaggtaaatcaccttttaaaaggcctgtgggaaccacaagcctcaggtgattttccttctaaggtttgcgtggggagatgatcccagagaatctcagggccttctaaggaaacctccgtgaaaaggcagtgttggaagtggcagtgttgtgtcctgtttctgaaagaagaccaagcccctctgtctctgggttggcaggcctctgtcctgtagtcttgctttctgtaaaccattgctgggggatgaaggcacatggaaagaactcctcttcctgtgagatttgtacttctaggcattcagcctcagctaagtagctctgtgctccaggtcagattacccttcaagtccaccataaaggaggggagcatagcttgaagcaatgaatttagcaaaggccctgagccagatg

SEQ ID NO: 6739 - DNA, 1043 bp, artificial
  synthetic oligonucleotide
aataaataaaaaatctgggggctgagcacattccctaacagaacatagtaacaattaaggctgggagcaggaacagattatttgaagaactagctgctaagcaagattttatcagatcagtagtaacttttagatttctcagcagaactaaaactggggcattttgttcatttccaagcctttttggtaattcctcttttatggaagaaagaatgtaagaactgaaactatttcaatgtatttgtttgataaacagacctaataaaaagtctggtgggagaaaagttagacaatcctggttgaactgggttttaattattttttaaatttacttgcatttacctaaaagactagttgtacggtattcactttaagaaaaagcatccacttttttccagcaagcactctttgatgcctgattaaattaacaggaccccttactaccattcacctctagttccatctcgctttagcagaattacaattggaattataattggctggagggcgcctggcagcatgctccaggccatgcaagtcagtacacgcctaaatgggtgttttttcaagttcgcagtctccggctgcagtttaagagactgacctccatccttatccccggggcactaagctttcaaagagaaagtttgacccctaggctttgatccactttcccttgaaaacttctcgcgaggcccaacaggtcgcaacgggtcccagccttcgcgcctcgctgtgcaggctggctggggagggctgcggggtgcaccgcggcggggtgcacactggcggggcgctgacccggtcccggccgcccggtcggccgcccgactcacccgctcctccgggaactggcgccgacaccgaaaaggctgggacctgcgtctctggtctgtgggttccggacgaaccgcgcgtgggctcccgcgcggaacgtagaggcgaacgctgggctgccggcgcctggacagtaaaagcggcgcgcgccggcccctccccgcctcgccacgcctccgcggccgcgctgcccagcggactggagc

SEQ ID NO: 6740 - DNA, 1059 bp, artificial
  synthetic oligonucleotide
acactctcattccagattttcttttctgatcgcttgttcctttcagatctgggactagatttcagaggaaatggtagactttcatagctcgggggaggggaggtggagggagaggctgctgtcccaggagcctagggaaggaagaggcaatttttcataaaagtacaagtggcccatagccccaggggaagatgccgtccctttctggtaatcggtggaagggaaacacaactacaaggtgatgagattatcgaagaagaaagagtaataaggcctggtgtgggggagggaaaggaggggggcgggccctcttctgccgcactgctggtgggaggggaaattggggacccgagttggtggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtccaagcctctcccgggtggcc

SEQ ID NO: 6741 - DNA, 584 bp, artificial
  synthetic oligonucleotide
acacacaaacacacacacttacaagccctcatgtgcacacatcaaactggtcatcaaggtctacttataaaagcctaaaaagcatgcaaatgtgattcagagacacaaagaggacaaactattattaaacattattaaaagtaatggcaaaaaccgcaattacttttgcaccaacctaatagtaaatgaattaaatctattttaaatgcaaacgtgaaatacgtcctttagcaataaaaaaatgattcaatgtcattcatctcaccactgtttattatagaaaaattcttagttccaaggtaggattacgaaagttttatgtcttttttgatcttttgtattaattttttctttcacaaataggtgttacttatgagatacataaaattaaagaagaaagaaggtctgtcaatcaaaaattgtaaggttatcatccatataagagtgtaagtccctgtaattttaatagcctgtggaaactcatttggtattacctaaatcaagttaaatgataatgaaattgtaaaagggcaaagccactctttagcataccaaaaattatcattaaggattgacaccacttt

SEQ ID NO: 6742 - DNA, 18983 bp, artificial
  synthetic oligonucleotide
aaaatgcacagatatttttccaaatgtaaaagtgtactcttttacaaactgtgattgtcctctgcatactgtgttgatatttatctgtttcatgtagtatgagagcttgtttcacatttcatcatttatatcattgggcatattttcaaatgttcactgggtattgatgttactttcatgtacattctctattgtaatcttcggcccgtttctctgttggttaaagtatcaaggatattaaccacatagctgcaatacagattgcaactattttcttccagctttttatatactttgtactcttaaattttgcaatacagatggtgttcattttattttatttttttaactcaaggatattatattatttataaaatggaacagactgacctgaactctagttgtctttgatggctcaaagcaaatccagaaggccttaccagtttcaaccagtttgtgccagttaacttcaaagaggaagcttgcataatgatttttataaacatgaaaataatatattgtaggctgttacttgcttatccaagtgatcccattttgtttttgtttttttatttttattttttaaatatatatgtattttttattatactttaagctctagggtacctgtgcacaacgtgcaggtttgttacatatgtattcatgtgccatgttggtgtgctgcacccattaattcgtcatttacattaggtatatctcctaatgctatctatccgccagccccccaccccacaacaggccccggtgtgtgatgttccccttcctgtgtccaagtgttctcattcttcaattcccacctatgagtgagaacatgcggtgtttggttttttgtccttgcgatagtttgctgagaatgatggtttccagcttcatccatgtccctacaaaggacatgaactcatccttctttatggctgcatagtattccatggtgtatatgtgccacattttcttaatccagtctatcattgttggacatttgggttggttccgagtctttcctattgtgaatagtgccgcaataaacatacgtgtgcatgtgtctttatagcagcatgatttatattcctttgggtatatacccaataatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgattttcatttctctgatggccagtgatgatgagcattttttcatgtgtcttttggctgcataaatgtcttcttttgagaagtgtctgttcatatccttcacccactttttgatgggttgtttgtttttttcttgtaaatttgtttgagttctttatagattctggatattagccctttgtcagatgagtagattgcaaaaattttctcccattctctaggttgcctgttcactctcatggtagtttcttttgctgtgcagaagctctttagtttaattagatcccatttgtcaattttggcttttgttgccattgcttttggtgttttagacatgaagtccttgcccatgcctatgtcctgaatggtattgatggtattgcctaggttttcttctagggtttttatggttttaagtctaacatttaagtctttaatccatcttgaattaatttttgtataaggtgtaaggaagggatccagtttcagccctctacatatggctagccagttttcccagcaccatttgttgaatagggaatcctttccccgtttcttatttttgtcagatttgtcaaagatcagagagttgtagatgtgtggtattatttctgagggctctgttctgttccattgatctatatctgttttggtaccagtaccatgctgttttggttcctgtagccttgtaatatagtttgaagtcaggtagcgtgatgcctccagctttgttcttttggcttaggattgacatggcaatgcgggctcttttttggttccatatgaacttaaaagtagttttttttttcaattctgtgaagaaagtcattggtagcttgatggggatgacactgaatctatgaattaccttgggcagtatggccattttcgtgatattgattcttcctatccatgagcatggaatgttctttcatttgtttgtgtcctattttatttagttgagcagtggtttgtagttctcctttacgaggtccttcacatcccttgtaagttggtttcctaggtattttattctctttgaagcaattgtgaatgggagttcactcatgatttggctctctgtttgtcttttattggtgtataagaatgcttgtgatatttgcacattgattttgtatcctgagactttgctgaagttgcttagcagcttaaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgcgggtttgtcataaatagctcttattattttgagatatgtcccatcaatacctaatttattgagagtttttagcatgaagggctgttgaattttgtcaaaggccttttctgcatctattgagataatcatgtggtttttgtctttgcttctgtttatgtgatggattacgtttattgattttcgtatgttgaaccagccttgcatcccagggatgaagcccacttgatcatggtggataagctttttgatgtgctgctgggtttggtttgccagtattttattgaggatttttgcatcaatgttcatcagggatattgttctaaaattctctttttttgttgtgtctctgtcaggctttggtatcaggaggatgctggctcatagaatgagttagggaggattccctttttttctgttgattggaatagtttcagaaggaatggtatcagctcctccttgtacctctggtagaattcggctgtgaatccgtctggtcctggagtttttttggttggtaagctattaattattgcctcaatgtcagagcctgttattggtctactaagagattcagcttcttcctggtttagtcttgggagggtgtgtgtgtccaggaatttatccatttcttctagattttctagtttatttgcgtagaggtatttgtagtattctctgatggtagtttgtatttctgtgggctcggtggtgatatcccctttatcattttttattgcatctatttgattcttctctcttttcttctttattagtcttgctagcagtctatcaattttgttgaacttttcaaaaaacaccagctcctggattcattaattttttgagggggtttttatgcctctatctctttcagttctggtctgatcttacttatttcttgccttctgctagcttttgaatgtgtttgctcttgcttctctggttcttttaattgtgatgttagggtgtcaattttagatctttcctgcttaatcttgtgggcatttagtgctctaaatttctccctacgcactgctttaaatgtgtcccagagattctggtgtgttgtgtctttgttctcactggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgatcttttacatttgctgaggagagctttacttccaagtatgtggtcaatttaggaataggtatggtgtggtgctgaaaaaaatgtatattctgttgatttggggtggagagttctgtagatgtctattaggtccacttggtgcagagctgagttcaattcctgggtatccttgtgaactttctgtctcgttgatctgtctaatgttgacagtcgggtgttaaagtctcccattattattgtgtgggagtctaagtctctttgtaggtcacccaggacttgctttatgaatctgggtgctgctgtattgggtgcatataattggaccatttagtccatttacatttaaagttaatattgttatgtgtgaattcgatcctgtcattatgatgttagctggttattttgatggttagttgatgcagtttcttcctagcctcgatggtctttacaatttggcatgattttatagtggctggtaccggttgttcctttccatgtttagtgcttccttcaggagctctgttagggcaggcctggtggtgacaaaatctctcagcatttgcttgtctgtaaagtattttatttctccttcacttttgaagcttagtttggctggatatgaaattctgggttgaaaattcttttctttaagaatgttgaatattggcccccactgtcttctggcttgtagagtttctgccaagagatctgctgttagtctgatgggcttccctttgtgggtaacctgacctttctctctggctgccttaacattttttccttcatttcaacgttggtgaatgtgacaattatgtgtcttggagttgctcttcttgaggagtatctttgtggcattctctgtatttcctgaatctgaatgttggcctgccttgctagattggggaagttctcctggataatgtcctgcagaatgttttccagcttggttccattctccctgtcactttcaggtacaccaatcagatgtagatttggtcttttcacatagtcccatatttcttggaggctttgttcgtttcttttcattcttttttctctaaacttcccttttcgcttcatttcattcatttcatcttccgtcactgataccctttcttccagttggtcgcatcggctcctgaggctgctgcattcttcacgtagttctcgagccttggctttcaactccatcagctcctttaagcacttctctgtattggttattctagttatacattcgtctaaattttttttcagttttcgacttctttgcctttggtttgaatttcctcctgtagctcagagtagttttatcatctgaagtcttctctcaactcgtcaaagtcattctccgtccagctttgttctgttgctggtgaggagctgcattcctttggaagaggagaggcgctctgctttttagagtttccagtttttctgctctgttttttccccatctttgcggttttatctacttttgatctttgatgatggtgatgtacagatgggtttttggtgtggatgtcctttctgtttgttagttttccttctaacagacaggaccctcagctgcaggtctgttggagtttgctagaggtccactccagacgctgtttgcctgggtaccagcagcggtggctgcagaacagtggattttcttgaaccacgaatgctgctgtctgatcattcctctgcaagttttgtctcagaggagtacccggccgtgtgaggtatcagtctggccctacttggggggcctcccagttagtctgctcggggggtcaggggtcagggacccacttgaggaggcagtctgcccgttctcagatctccagctgcatgctgggagaaccactgctctcttcaaagctgtcagacagggacatttaagtctgcagagggtactgctgtctttttgtttgtgtgtgccctgcccccagaggtggagcctacagaggcaggcaggcctccttgagctgtggtgggctccacccagttcgagcttcccggctgctttgtttacctaagcaagcctgggcaatggtgggcgaccctcccccatcctcgctgccaccttgcagtttgatctcagactgctgtgctagcaatcagtgagactccatgggcgtaggaccctccgagccagatgcgatatatattctcctggtgcgccattttttaagcccttcggaaaagcgcagtattggggtgggagtgacccgattttccaggtgctgtctgtcacccctttctttgctaggaaagggaactccctgaccccttgcacttccagagtgaggcaatgccttgccctgcttcagctcgtgcatagtgcactgcacccactgtcctgcgcccactgtctggcactccctagtgagatgaacctggtacctcagatggaaatgcagaaatcacccgtcttctgcgtcactcacactgggagctgtagaccggagctcttcctattcggccatcttggctccacctccgtttttcaagggttttaacttctttgctatgggtttgaacttccttctttagctcgtagaagtttgatcatctgaagtcttctctcaacttgtcattctccgtccagctttgttccattgctagtgaggagctgcattcctttggaggaggagaggtgctctgatttttagaagtttcagtttttctcttctgttttttccccgtctttgatgatggtgatgtacagatgggattttggtgtggatgtcctttctgttaattttccttttaacagtcaggaccctcagctgcaggtctgttggagtttgctggaggtccactccagaccctgtttgcctgagtatcagcagcagaggctgcagaacagtgaatattgctgaacagcaaaagttgctctctgatcgttcctctggaggtttcgtctcagaggggtacctggctatgtgaggtgtcagtctgcccctactgcccctactagggggtgcctcccagataggttactcgggggtcagggacccaattgaggaggcagtctgtccgttcttagatctcaaactccgtgctgggagaaccgctactctcttcgaagctgtcagacagggacatttaagtacgcagaagtttctgctaccttttgttcagctatgccctgtccccaggggtggagtctacagaggcaggcaggcctccttgagttgcggtgggctccacccattttgagcttcctggctccttttttacctactcaaccctcagcaatggcgggcacccctcccccagcctcgctgctgccttgcagttggatctcagactgctgtgctagaaatgagcgaggctctgcgggtgtgggaccctctgagccaggcacgggatataatctcctggtgtgccttttgctaagaccattggaaaagcacagtattagggtgggggtgacccgatttcccaggtgccgtctctcacagatttgcttggctatgaaagggaattccctgaccccttgtgcttcctgggtgaggcaatgcttcaccctgcttcagctcatgcgtggtgcgctgcccccactgtcctgcacccactgtctgacaagccccagtgagatgaatccagtacctcagttggaaatgcagaaatcacccatcttctgcgttgctcacactgggagctgtagactggagctgttcctcttcagccatcttggaaccaccaacagatggtgtttatatatatacaatcatgtgtcacttaatgatggtgataccttctgagaaaggcatggttaggtgatttttgttgttgtattgatggcagcgacatgttgtctggagtggccactgccatcatgctggttgtgctctccatggagccagtgggagcagggacaagtggaagcctggccccttcaaagttgacgtgggaacttcctatgtgtccctgcagccacccaagccatggctgtggacctagacatctctgagctcttgggcatggaagcaggcgggagccccgccctccagggcacagctgcaaccaaacaaacaacagctgcagacctgggcctcccactccagggagcaggcaagagccccaaccaccccccacgcacctgtggacgcaggcatctctgcactcttggggcccaggaaggtcctccatgccattgcaggtttggaagtgcctgctcctgctgactggcttctccctgctgttggcacccactccaatttcggagcatagttggtgctgagcccaggcactgttgcatcccagccaggcgtgcatgtgcttggtgcagtgctgacatgaaagccccctgccaccccagccctttccattctttgagcactgacaggaagctgaggggaggctgagggcagctgaggctggcctgcaggctccccttggcacctacagcctgggcactatgaatggcagcaggagacagacaggttccaagccagaagtgtgtaggtccctggtgaggctccaccttcaggccagggagggcctgaaggctgggggttgagctgccagccctgtggaccagagtgggaacttgtggtgccttttctggggctgcccatggctgcccatggaccaaacagctcacactttctcccctctgagtcccgtaaaagcctcgggctcagccagagctgagcagtcatcaggatgacgagctgcagagaggagcaccccattctaaggcctcctgtctgttgagagctgcagagatgacgggatgacctgcctgtagagatgagccacctactctagggcctcctgtctgctgagagctgcacagacaatgggacaaccagctgcagagaggagctacactctctgttgatagctgaacacttgtccagacaacttgcctagcagagaggagctaacctctatgctaggagatgaacactcattggaacaccctggttgtggaaaggagctgtcccctgtagatttcacctgagatgttctattgctcaataaagctcccctttgtcttgttcgccctccatttgtctgcatacctcattcttcctgggctcaggacaagaagtcaggacctgctgaatgaggctaaaagagctgtaacacaaacgtggctcagacatgctctgtattagtccgttttcatgctgctgataaagacatgccagagactgggaagaaaaagaggttttacagttccacatggctggggaggcctcaaaatcatggcagaaggcaaggaggagcaagtcatgtcttacatgggtggtggcacacagagagcttgtgtagggaaactctcattctgtaaaaccatcagatcttgtgatacttattcagtatcatgagaacaacatggaatagacttgcccccattatttaattacctcacaccaggtccctccgacaacacatgggaattgaagatgagatttgggtggggacacagccaaaccatatcattcctcccctggcccctcccaaatttcatgtccgcatattacaaaatgaatcgtgccttcccaacagtcccccaaagtcttaactcatttcagcattaactcaaaagtccatagtccaaagtctcatccaagacaaggcaagtcccttctgcctatgagcttgtaaaatcaaaagcaagttagttacttcctagatacaatgggggtataggcattgggtaaatacagccattccaaatgggagaaattggccaaaacaaagggactacaggcccaaagcaagtccaaaatccagcagggcagtaaaatcttaaagctccaaaatgattttctttgactccatgtctcacatccaggccagactgatgcaagaggtgggctcccacagccttgggcagctccaccactgtggctttgcagggtatagcccctctcctggctgctttcatgggctggcattgagtgtctatggcttttccaggcacatggtgcaagctgttggtggatctaccattctgagttctggaggacaatggccttcttctcatagttccagtagcgctgccccagtagggactctgtggttgtgctccacccctacatttcccttccacactgccttagcagacattctccatgaggccttgcccctgcagcaaatttctgcctgggcatccaagcattttcatacatcttctgaaatctaggcagaggtccccaaacctcaattcttgacttctgtgcacctgcaggctcaacaccacatggaaggtgccaaggcttggggattccaccctctaaagcagtggcccaagctgtaacttggcccctttagcaacgactggagtggctggaatgcaatgtaccaagtccctaggttgcacagagcaggggagctgtgggcctgccccatgaaaccatcttctcctcctagacttccaggcctgtgatgggaggagctgtcatgaagatctctgacatgccctggagacattttccccattgtcctggggatgatcattcagctccttgttacttatgcaaatttctgcagctggcttgaatttctcctcagaaaatgggactttcttttctactgcatcatcaggctgcagattttctgaatttttatgctctgtttcccttttaaaactgaatgcttttaacagcacccaagccccctattaaacgctttgctgcttagaaatttcttccaccagataccctaaatcatctctctcaagttcaaagttccacaaatctctagggcacaggcaaaatgccaccagtttctttgctaaaacataacaagagtcacctttattccatttcccaacaagtttctcatctccgtctgagaccacctcagcctggaccttattgttcatatgattatcagtatttttgtcaaagccattcaacaagtccctaggaagttccaaattttcccacatgtttctgtcttcttctgagctctccaaacagttccaatctctgcttgttacccagttctaaagttgcttccacatttctgggtatcttttcagcaatgccccactctactggtaccaatttactgtattagtccattttcatgctgctgataaagacatacccaagactgggaagaaaaaggagtttaatggacttacagttccacatggctggggaggcctcacaatcatggcagaaggcaaggagaagcaagtcacttcttacatggatggcagcaagcaaagagagagtttgttcagggaaactctcatttttaaaaaaattttactttaagttctgggatacgtgtgcagaacctgcaggtttgttacataggtacacaggagtacatgtgccatggtggtttgctgcatctatcaactcatcttctaggttcaaagccccacatgcattagctatttgtcctaatgctctccttctgcttgtccctaatcccccgacaggcccaggtgcatgatgttcccctccctgtgtccatgtattctcattttccaactcccacttatgagtgagaacatgcagtgtttgttttttctgttcctgtgttagtttgctgagaatgatggcttccagattcatccatgtccctgcaaaggacatgaactcattttttaaatggctgcatagtattccgtggtgtacatctgccacattttctttatccagtctatcattgatgggcatttgggttggttccaagtctttgctattgtgaacagtgctacaataaacatacgtgtgcatgagtctttatagtagaatgatttataatcctttgggtatatacccagtaatgggattgctgggtcaaatggcatttctggttctagatccttgaggaattgccacactgtcttcacacaatggttgaactaatttacactcccaacagtgtaaaagcatttgtgtttctccacagacccaccagcatctactgttccctgactttttaataatcaccattctaactggcatgagatggtatctcattgtggttttgatttgcatttctctaatgaccagtgatgatgagcttttttcatgtttgttggccacataaatgtcttcttttgagaagtgtctgttcatatccctcacccactttttgaaggggttgtttttttcttgtaaatttgtttaagttccttgcagattttggatattagacctgtcagatgggtagattgcaaaaattttctcccattcttttggttgcctgttcactctgatgatagtttcattttttgtgcggaagctctttagtttgattagatcccgtttgtcaattttggcttttgttgcaattgcttttggtgttgtagtcatgaattctttgctcaggcctacgtcctgaatggtactgcctaggttttcttctaagatttttatggtttttgggttttacatttaagtatttaatccatcttgagttaatttttgtataaggtgtaaggaaggggtccagtttctgttttctgtatacggctagccaggtttcccagcaccatttattaaatagggaattctttccctattgcttgtttttgtcagatttgttgaagatcagatggttgtagatgtgtggtgttatttctgaagtctctgttctgttgtgttggtctgtatatctgttttgctacctgtaccatgctgttttggttactgtagctttgtagtatagtttgaagtcaggtagcatgataccttcagctcttttatttttattttttttattttttattttttgcttaggattgtcttggctatacaggctcttttttggttccatatgaagtttaatgtagtttttttctaattctacaaagaaagtcactggtagcttgataggaatagcatagaatctataaattacttttggccgtatggccattttcacaatattgattcttcctatccataagcatggattttttttccatttgtttgtgtcctctcttatttccttgagcagtgttttttagttctccttgaaaaggtccttcacgtcccttgaaagttgtattcctaggtattttattctctttgtagcaattgtgaatgggagttcactcatgatttggctctccgcttgtcaattgttggtgtgtaggaatgcttatgatttttgcacattgatttatatccggagactttgctaaagttgcttatcagcttaaggaatttttgggctgagatgatggggttttctaaatatacaatcatgtcatctgcaaacagagacaattttattttctgtcttcctatttgaataacctttatttctttctcttgcctgattgctctggccagaacttccaatactatgttgaataggagtggtgagagggcattcttgtcttgtgccggctttcaaagggaatgtttccagctttttccctttcagtatgatattggctatgggtttgtcataaatagctcttattattttgagatatgttccatcaatacctagtttactgagagtttttagcatgaagggatgttgaattctattgaaagccttttctgcatctattgagataattatgtggtttttgtcattgattttgtttatgtgatggattacttttattgatttgcatatgttgatccaggcttgcatctcagggataaagccgtcttgattgtggtggataagcttttgatgtgctgctggattcggtttgccagtattttattgaggatttttgtattgatgttcatcaaggatactggcctgaaattttcttttttttgttgtgtccctcccaggttttggtgtcaggatgatgctggcctcataaaatgagttaaggaggagtccccctttttctattgtttggaatagtttcagaaggaatggtaccagctcctctttatacctctggtagaattcagctgtgaattcatctggtcccaggctttttttggttggtaggctattaattactgcctcaatttcagaacttgttattggcctattcagggaatcaatttcttcctggtttagtcttgggagggtgtatgtgtccaggaatttatccacttctcctagattttctagtttatttgcacagaggtgtttatagtattctctgatggtagtttgtatttctatgggatcagttgtgatatcccctatatcattttttattgtgtctatttgattcttctctcttttcttctttattagtctacctagtggtccatctattttgttagtcttttcaaaaaaccagctcctgaatttgttcagtttttgaagggtttttcgtgtctctgtctccttcaattctgctctgatattatttatttcttgtcttttgctagcttttgaattttttgcttttgcttctccagttcttttaattgtgatgttagggtgtcgattttagatctttcctgctttctgttgtgggcattaatgctgtaaatttccctcttaacacagctttagctgtgtcccagagattctggtacattgtctttttgttctcattagtttcaaagaacttatttatttctgccttaatttagttatttacccagtagtcattcaggagcaggttgttcaatttccatgtaattgtgtggctttgagtgagtttgttaatcctgagttctaatttgattgcgctgtggtctgagagactgttatggtttccattcttttccatttgctgaggagtgttttacttccaattatatggtcgattttagaatatatgctatgtgacactgagaagaatgtatattctgttgattaagggtggagagttctgtagctgtctattaggtccacttggtccagagctgagttcaagtcttgaatatccttattaattttctgtctcattgatctgtctaatattgatagtggggtgttaaagtctctcactattagtgtgtgggagtttaggtctttttgtaggtctccaagaacttgttttatgaatctgggtgctcctgtattgggtgcatgtatattttgggtagttaactcttctttttatgttgatccctttaccattatgcaattctcttcttcatttttttttttatctttgttggtttaaagcctgttttatcagagactaggattgcaacccctgctttttttgctttctatttgcttggtaaatattcttcaacatctttattttgagcctatgtgtgtctttgcacgtgacatgggtctcctgaatagagcacactgatgggtcttgactctatccaatttgccagcctgtgtcttttaattggggcatttagcccatttacatttaaggttaatattattatgtgtgaatttgatcctgtcatcatgatgctagctggttattttgcagattaattgatgcagtttcttcatagtgtcattggtctttatattttgatgtgtttttgcagtggctggtaccagtttttcctttccatatttagtgcttccttcaggagctcttgtaaggcaggcctggtagtgacaaaatccctcagcatttgcttgtctgaaaaggattttagttctcctttgtttatgaggcttagtttgactgggtatgaaattctgggttgaaaactcttttctttaagaatgttgaatattggcccccactctcttctgagttctagcgtttctgcagagatatacactgttagtctgatgggctttcctttgtaggtaacctgacctttctctctggctgcccttaacattttttccctcgtttcaaccttggagaatctgacaattgtgtgtcttggggttgctcttctcaaggagtatctttgtggtgttctctgtttttcctgaatttgaatgttggtctatcttgctaggttggggaagttctcctggataatatcctgaagtgtgttttccaaggtggttccattctccccatcactttcagggaccccaatcaatcatgtttggtcttttcacatagtcccatatttcttggatgctttgttcattcttcaatctgtgatatccttcttctgcttgattgatccagctattgatactcagtgtatgctttatgaagttcttgtgatgtgtttttcagctccatcaggtcatttatgttcctcttcaaacttgttattctagtagcagttcctataacattttctcaaggtttttagcttcctttcattgggttagaacatactcctttagctcagaagagtttgttattacccaccttctgaagcctacttctgtcaattcgtcaatctcattctccatccagttttgtgcccttgctggagaggagttgtaatcatttggaggagaagagggattctggttttttgaattttcagcatttttgccttggtttttccttatcttcatggatttgtctgcctctgatctttaagattgatgatctttgggtggggtttttgtgggcgggtcctttatgttgatgttgttgctttctgttagtttttcttctaacagtcaggcccctcttctgcaggcctgctgcagtttgctggaggttcactccagaccctgttggccttggtgtcaccagtggaggctgcagaacagcgaagattgctgcctgctcctttctctggaaacttcatccaagagtgacactggcctgatgccagctggagctttcctgtatgaggtgtctgtcgaccactgttgggaggtttctcccagtcaggaggcgcgaggttcagggacccacttgaggaggtactctgtccttagcagagatgttgcactgtgctgggagaatcctcttgtcaggatcagctgctctcttcagagccggcaggcaggaacaattaaatccactgaagctgcgcccacagctgccccttcccccaggtgctctgtcccagagagatgggagttttgtctgtaagcccctgactggggctgttacctttccttcagagatgccctgcccaatgaggaggaatctagagaagcggtctggccacagccgctttgctgctcctggcccagacctcctagcctccttagaactgtcaggggaaaactgcctactgaagcctcggtaatggtggacgccccttcccccaccaagctcagtcattccaggtcgacttgagactgatgtgctggcagtaagagcttctagccagtggttcttagtttgctgtgctctgtgggagtgggacccgctgagtgagaccacttggctcctggcttcagccccctttccaggggagtgaaaggttctgtctcactggggttccaggtgccactggggtacgaaaaaatactcctgcagctagctcagtgtctgcccaaatagcctcccagttttgtgtttgaaacccagggccctggtggtgtaggcacaccagggaatctcttgatctgcagattgcaaaaactgtgggaaaagcgtgataacccggtcaggtagcacagtccctcactgcttcccttggctgggggagggaggtcccctgctccttgcacttcccagatgaagcgacaccccaccctgcttccgctcgccctccatgggttggacccactgcctaacaagtcccaatgagatgaactgggtgcctcagttggaaatgcagaaattacccaccttctgtgttggtctcgctgggagctccagagtggagctgttcctattcggacatcttggcccctccccatcaaaactctcatttttaaaaccatcagatctcatgaaacttattcactatcatgagaacagctgggaaaagacttgcccccatgattcaattacaccccactgcatccctcccacaacacatgggtattgaaaatgagatttgggtgggaacacagccaaaccatattatgccccttgttcaccatgttgtgggccaaaagaaggaaagaagaactgtgacccttcggggagcccagacctggatgctccccaagccagggctgtgactccctcttcagggccctgtagttcctggtgtctccaagcttctgggtgccactgtgttccctggtgccagttgtggaagctgcctgtggtgtgcctggtccagctgcagcctcgtggagagccagcaccagtgctggcacccagagttgcccactccactgcagcagccagcatgtctgactgcacagtggccagaccccacacttgctcacataccccttgttgctctgagcagtctcccttgtcagatatgggatgcaggccagtagtgtgagctgagcacagcctgccagatcaagtgagcagaatgagtgcagcaggcccaagcaaaacttaggcaagggtgccaccagtcacagaggtttccggccagaaaagcaacaccccaaagatcctgtaacagtatgaacatcacagagtgtacttacacaaaactagatggtatagcctactaaacacctaggctatatgctatagcctattcctcttaggctacaaacctgtacagcatgctgctgtactgaatactttaagcaatggtaacacaatggtaagtatttgtgtatctaaacataaaacaggtacaataaaattatcatataaaagataaaaagtagtcacctgtatagggcagctctattataatctgatagaaccaccatcatatatgtggtccatcgttaactgaaacattgtgtggagagacagacagacagacagacagacacacacacacacacacacacacacacacacacacacacagaaagagagagaggagcagtaatgctcattgttaaagagaaatcctaagcaacacaacaagaatatctgtaataatatcaacttgaatagctgtaagaattaaattagataaagtatctattgattaaagtctttatgtaaatgtcaataacctttttgcaggccactttccagagagagcaacaactctgttttcacaaaagccttgcttaacacctcagggaccagctcaaccatgtgacttctacacccaggtttcctggaacaaggtttttattcctatactgaatatcatgctgagggagtatccatggggacagaattctagga

SEQ ID NO: 6743 - DNA, 2808 bp, artificial
  synthetic oligonucleotide
agggaatagccaaggagaagcaggcctcatcgtggtaagcaccgaggagaccctgtcgatctccagagtcatagatcgagtaatacctgtggggaaagcagtgaggataggctatctctgtggcctgggccccagatgagacttgaaaactcccaggctgcacgggtgcccagcctgtctcagccctccccttcctcatggtcccagggatactcactgctgcaggaattgcaggactaaatgctttagggtctcagatccagtaaagttttcctgaaatcaaaagacaatttggatctatgcggtggacaaagcctcccttacagcaacccaaatcttgcttggtccttcttcctcaccttgcagggtttcattgtctcagagctgtcaatgtcaacaatcactggtgcggataactctcggccgtcctggagaaggaaagaggaagtcagcagtggagaccaaggaggtggagctggatgatcgataagatgaacatgcccagggagacaagcatcagaggctaggtgggaaatggccctggaaattccagtgggtggctttctcatggggtgctggacatctctactatcacatgcaaatgtgtgtgtgggggggggtggcggtggggggacacattttccagggagaatattcttgtctttttcaggaatccatgcctgtaaaatggatgagggtctgatacaagcatgtaatctaggcaagacccaaaggacttgagggcaggcgtggaggtccttttcttgagtaagaggagacaatgatgacggtattatacatacttaccaggcgtaacaacttggggaaacaatcccggatggcactgtccaaaaccaaaaattgaatgaagtgactgacagttcagggttgcacagtctctctcccactccctctcacactcctccctctccttcctcctggttagcttccatctagactgtcctgactcccttttctccagtgccacaagaagcagcactgggagcccaggctccagggctttcttcctctccctccctcccctttgcccaagtcaccatggaaggctctgcagggagcaggaaatggggtgggagcccagggctctgccacctcactggctgtccatcaacctgcctgaccaggccctggccaagaccaggtcagcccttagggatggcccaggatgctgggacacggaggtgagtgaggccggactcaggaggcaggaagcggaaggcaggggggacaacaacagaaacggggtgaaggtaggggagggacggatgggtgagacataggagaggagagacaagggagaaacaggatgcaatgcaaagggaagggaaagactctctactgcggaggtggagttcagggaggagaagaggagaaaagggctcccctgctgcagccctttccctcactgctccctggctggccccggggaccgaggcaggaaaggaaaacatgcgcctgttgggctggggcccactggttgcagctggagccttcctcacctgtgtgagctcagtctgagctgggcatgggaaacagagcagccacggggacaggagaccttctcccgggaggagtgaagagtcaggccccagctcagcatggggttcagagtctggggaccccctctccagaccactgcattctcttctgatggtccctgactcctgtgcccctctgtgctgacgccttgaccgaggaatgctacccatctcgggctacccagggctcctctgagggcccaggcaggacgatgtgaggtggagaaggagggaaggtggggcagtgccctgagaggcctgtccttctgtcttctcaacctcctctgccctctgccttccactcctgcctcaggaacgtggcccgcttctggacccttgacgtaggaaacccaggtttctccccaaggagggcccagctcctggcattgggccagaggaagagatggcatgacagcagccacccggggccccagccctcagtatggggcagggaagcccccatgccagcccaggacaggtggggggacctttttggagcaagagaaggagaacccctctcgggacaggggagggaagccccatctcagcatggaggcaggaaggcctgtctcagcatgaagccccggactaaaggactcttctcggtccagggcaccagcatctgaatactgctggtcctggggaggtgggggagccccacttcctggagcacactcacagagggcacactggaggaggcttggtggagacaggcgggaaacacaccccagagcaggtgaaaaggggaccatgtcagaggaaggaaaggagacctctaagcacagatgagtgagtgacagagagagaggagagagagagagagagagtaggaagggaggtctgtggtcctcccagaggaccaaggctgcttcttcctgcagaagggcaccttcagacacagctcagtcacccagggagcaaaggtgcccaggaagggtgacaggggttgccactgaccttacataggcagactggtccgagaaggtgctgcacaacgggttcccttctagccatagctcttcgagcttcagccctttcaccttgcccaactcccacgccgactccagctaagaaagatggggaggaaactggagaaggagggccagggaaagagagacacccaggaccctgggccctgaattcccccggccctcatagtcacccacaggtgccactgcctggctgttgccattatcctgatgtgtcctgccctccacccaaagttgatctggctcccccttctcacctt

SEQ ID NO: 6744 - DNA, 629 bp, artificial
  synthetic oligonucleotide
agggcattttcacacacatttatataaagagtttgtagccagtacacaactcacgtccttcaggtttaatggtatccttatttttcctataagagggcttaacagcacaatgtgtgtatatatattttttcatataagtcatcttaaattcattggcaaattgaaaatagctatttgttttagttaattgccttcagtctagggaataataaaacatcttttatcttctttttgagcaaatggttacagccagagataaactcctggattaagcttccaaggtgccagggaggcttccctgggtgtttacatttcaaaagagatgaagttcagacccttagggagagttatttacattccaaatgttaaagactgttgattaatttggttttccaaagaaaggctcttagaaggggaagggaaattgtatatatgtcccttgtaaacagacacaatcattacagtaggtctgtcattgatcccagtgggattttagaccccaaaaaccgttatgagaactgtctaaaatgcagcagcaaaatcacccaccgagctgaaaagactcaggaaaccttatttatctttctggagagatttctagtaagctataggattgctcctaaacttct

SEQ ID NO: 6745 - DNA, 1942 bp, artificial
  synthetic oligonucleotide
acccctggtgagggttcccctaagctggccgggcctccaagagggccttctgcccagcacgtagcccaccactcctcccacacacgtgagccagccataccctggcaggccctgccaccttctctgaactgattcagcctggtaaggtgtgtgttcacgtgggtggggttatgtgcaggggtcccaatttggccttggccgggccctccacactctcaacccttgtgggcccctgtccatgcagccccctgctttcacggacctgcggggagtctggacaggttgctcttcctttgcaggcctccaagagcgctgggaacaacagacgcgcagacctgcggacagacaggagacaggggtaggggctgcgcgctcagcgggctcacagggactccgttcccttttctgagtctaggccctgctcacccaatgttttcctcccctacctcccccgcaccccagccgccatttctttccaggcctcgggcaccaaaccaggatgcttccaaactgcgtttgcctctttgtgccccttcccccggaggcaacctgtctcagcgccaccccgtttttgcggaggtcagatgtttccatgggagcggattgtgagagggggttatttccagaataagtctgtgtttcactgtcgcactgcggggtcgctacccccagccccccatttccagcactaaaatggatggagggctcagtgcaaggggcgtcgagaaggcgagccaggttcgcttcggggtgctccctcccctgcccccgccccggcccgctcagcatccccctcctccccaatctaccggatcccttctccgccccctccccaatcctactgccagccccctccacccctgtcccagggtccgccggcagcgcacgccttcacactgacctgcggggacccaggacaggcctgtgcctcctgcggctcgctgaagcccgctcgctgctcccccgccgcctgggcagctcagacagctgattctgcgcgggcgcctggaccggaccgctgggcgggcgggcgggcgcgggggctggtgcccacgtaggcgcctggtcactcacgtgagcaccgcgtcacgggagctaggccaccaccacccccttcccgcccacctcaccatccatccccgagggaccaggaggttgcggaaggtgggagagggtgtgtgtaacaaaggagtgggggtcatcaagaagaagaggaggagggggtggctttctgatctcaggtgctttacctgacgcagctcacagcatcctcgcaaggcatctctctctgatgcccattatcgccaggtgtgacagctgatcagagagggtacccgactttgccaagagcgcttagccccagaactccacagcccactttcaataccggctctgcctgactccagagcccggggggtagtggtgcctgccaggaagctgagctgccaccttgagtggcggtgttcctggggttctgtcctgggcctcctctctcctcagtcctcaagttgtctctccctgtgtgatctcattcatttccagtaaacaccgatgactcccagatctacagctccaggctgttcccttctccgtgtctcatatcagctttgccaactgtttattggacatcaccgcctgagtatccctgagggacacggtatgtaaaaaccctgtaccacaaattgatttcaaaagcccatgtaccccaaattgatttaccaacttccttcttataatctccattggcctttctccacacttgaaagttaccttccaacagttgaccagttttcatagaaagagaatgtcagacagctagaaaggaaagcattcaaacgtttttaatatgaactgcagatccacaaattcatcataacccttggttcacaacatgctcttctcattgactactcttctctcccctgctttcccttcttttccc

SEQ ID NO: 6746 - DNA, 218 bp, artificial
  synthetic oligonucleotide
gttgctttgtcctgacactacagtctcacagaacgaacttggaaatgctgaaatgagagaaaaatagattattcaacctacatgtaatatcaaatatcacaagtgacaatattctctaaccatctgacaagcaatatttgaaaccccgtaagtttaagcacaatcttgctatttgctcaacttcattcacccaataccgctttcatgatgtaccaaat

SEQ ID NO: 6747 - DNA, 335 bp, artificial
  synthetic oligonucleotide
ctgatctcaccagcaatattttctgtgtggatattccccatttttttttctactgtgttgctgcagattcttaaatgggcccctgagccctcccatgaatactttagtttgtggatagctgtctacacttgtttttttgtggcagggggtgatgaaggctgatatctcctactctgccctcttggtccttcagtatctagtttgccctattctaatgataccctgccatgtcccctaaaggaaccgtataggcttatatatcattgttattattttcaaggacataacattttcagttctgttgtacccagcctacccattcctcccactgtcct

SEQ ID NO: 6748 - DNA, 423 bp, artificial
  synthetic oligonucleotide
tggtggtagagaggacattttctgtttgacctaagagtcttatgtctgggggctacatgaatggccaggtctctcagaaggtagttatcctccaagaaagaggataaataatttatacaaggtcacataccaataaggagaagagcccaaattggaacccaggtttatccgacactacggccatatacttaaatcacttttttccttcctaaacccaaggatttgaatttcatctttgtcttattgttcaaacaatcctttaggctgtcagaaatttggtaatgtttcctcagatgacagacctaaagagcaaggctcatagttggattactttctgcatgatcaacgccttaaaaaggcatcttcacaccaattcagtttgactgtcctgacccccaagtcgtgagctgggcctgcagtgca

SEQ ID NO: 6749 - DNA, 3054 bp, artificial
  synthetic oligonucleotide
tattttatagttaatatttgtaataatgaaaagcatactgtattactagtggttctcattcttcagtccatatcattatcacctggaggagtttgcaagctataattttacagtctacctccagaatgtgggtcagtgggccttatgtggggcccagacatcagcattttcaagatgctccccagcagattctgatgcaggtgattatgtgagatacttttataataaaacatttagagtacaatcaattctctgccctgtttcttcttggaattgcttgtcataactctagagaactaaagacttgtagattattcagcgagtaacctaatttggacaaacctactagctcttagtagcaatcaaaaaatcaattaaatattaaaacacaatgtgccagttaaacacatacaagtattcatatgtgggataccaagaggaagagacagtctttgcttgttctacaggggaaatataatctctaacatttatatagtagcattctacttcaagtacatttacaaggttcttactgactttgaaagttttttttaaccacaggtcaacagaagagatggaattaaggggactgttccttagatctgttccctgcatcactttgtgcaatttatatatgttccccagcagtcttccgaaccagtaagtcaggcctgcccaggagccttcaggaagagatcatcccacgaggacaaaacctcattccttagacttagagcaaaaactgtgattacaacaggtctttgactcaaacttataccccagtccaaatcccaaatggagtcatcacatctgactcctatggagaagaagggtcttgtgattgaaaacagaagggttattttgctaagggctctgaaagaccttgtggcccaagcaaccctagagaagtcccacctgtgttaagtgtcactataaagcagagagaagctttagaagacagtgaaagttcaacctactgaggactccagggaactcggtggggttttggccctcaaggactgcagtgcatcagcagtagtggggccagcagggagcacagcactcagcagaagaggcagcagtgttgggcaggcatggcaggaaccaggggaagagacagggttcaatagcagaggactgataggtaagcccccacctctgcctactggacttgatcctgagtacaagttgcatcatgccaggccctcccttaaatattggtgcttctatagtgggttgggattccgtatgcacaggtgggaacaagatctcactgagcacagctgttactgcctcatttcttccccactgcagccctgtgaagcaaatattttccccatgaaaagactgagtcttaaacgtgtgtatctgtaataattgccagtttattcctctggctaagagatccagaggtaatttgaggtttacatttctttttaaagttctttcatcaagagtttaggtgcccccattgccctcataagctggttgcaaattatttgactcttacttgtaaaaaaaatccttaattctttttgtgtgtgagacacgtgttcattaaaaagtacatataagcaaaaagaacaaaaagaagaaaacaaataaaatttcacaccacacagaaataagcttggttaagtttgtgatatatgttatatggatgtatgtatacacacacgcacacacacaaagtttggaattttatcctacatatgtgagctgatattaaatatgctgctttgccataacctgttatgttttactttacaacatggaatgaacatattcccatgcaaatgtgtgaaagtttccaattgaaaaatagacctggaaaatgggtcaaaatccaaaatccaatgagatgctggtaccaaggaaattacctaaaacaaaatttcatcagatgattaaaagtaaaatggaggtcaaagatacatcagaaaatgctaacagaaagaaagctggggccagattttaatattaggcaaaaatgaattcaaggcctaaagcacacaggataaggacggctgcgtgaatgtctttgcttccaatgcatcatcacaaacttgtttcttactcttcttatctcttccctaagcctttcaagctcatctactcctcttatcatttcttcagggtccaaatgcctaacgggtgtgtcctctttaaatccctggccaggctgattcggccctcctctggggtttccttctgcttcctggcttacgccttcttcggaaggttgaggatttccttctgcctcctgtggtacatcctccaaagggcgatcttcctcggcctttggcatgttctgtggttttccctcattttcttcacaagacttttgcatattgagtattttttatttcctttttgaataaattaatcctagaaaacaaggaaacaaaactactagattccaggcaaacagaccagcagtcagagtatggggtcccatagcgactggccttttttgactcagtaccctaattgtcaaaagttttccaactagagaaagctggatcctcaggctcagaactcccctgactccacctcccttcgcgccccctttcgttccagctccatctttctcctcctgctcctgcccaccatcttcccagcaggccctgctacaagcctctcctaatactgaaatgggagcagtacggaagcaattaacccttctcccgcctctggtctccaacactcccgcccttcagactttcccaggccctctcaacctccagcctctcacctgagacggctggtccagtctctggcctcccctcccccttcagcgtctcttaagcctcctcctcccccgcctcatttccgctgcaggctcggcaccggcctctggcacttaatccggatggggaggggctgctgcgaccccaggatgtgctttggtgtcactcacacttccacccccacccgaagagacctgaagcaattgcacctttacaaaaactgacctgcagggattcaggggattttcctctctcttccctcacctcgatttgtgtcgcgcccaaaaaaccaaatatcctgcag

SEQ ID NO: 6750 - DNA, 584 bp, artificial
  synthetic oligonucleotide
attctcaccagggcctttttcttctccttttcccatctgtctcccaataacaaatttgaaaaggaataagaggcctgaattcatacagacattcaccatcctgcaataaccacagggctacctaccggcttgcacctgtatcactgaagcttccagcaatcctgtgggtgagcatttttatccccatttcacagaggaagacgctaggctcagagagagtgtttacctgtctcattttttggcaccttgcctttacttggaaagtagctccgggacacccctggagcaggacaccacattcactggggccaagggagtcctacttctccctgcctcatcagacagcgagggcaacttgtcccaaagcgggaacaaggcaacttggatatgggatctcttcctctctctacatcgcagagcacccgcagccacagttgagtctaaacacctgaagacgaaaccctgctctcctcaccaggccaagtcggtctccattaaaaagtcgtcatggttgtcacagtcgccaaaatgacgtcaggttactatggtaaccgcgatgcgcaggcttgtcctccacaccgaaa

SEQ ID NO: 6751 - DNA, 1838 bp, artificial
  synthetic oligonucleotide
gactgccagggaatggctggctcacgtgtgtgggaggagtggcaggctacgtggtgggcagaaggccctcttgggggccctgccagcttaggggaaccctcaccaggggtgagatgcaagtactatccagacctgcattccaccccatgccctcagtctcccatgtctcttatttgtctcctcttccctccattcccatcccccaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgcatatacagtatcagcccgtttttataaaaatgtaaatgtttgcataatgcatttgtgcacaaagaaaactctgaaagcatgtacactaaaaagcagccaatggttattcctgaatggtatccaaaaatgagttcaatcacttgctgggtaggtacctccatgccattctgctgttgttgtgcccatcctcatgtcttccctaggtgtaactacgtgagtgggcactgctaccccttctcctgggtcctttaccatcctatggctcccccataggatgcgattctttttcttttctttgctctcactcatctctaccttttcttaaaggatatgtccttttgtcataacaataattttaaaaactaaacgagaaaacaatacataaacaattgaactgttcaatgagcttatgagggtaataaagacacttaaaatttctgttgccagaacataaaatgataagtaaaattcatattacctctgagactaacagctagaggtatcaacctggcagttataacaaatccattgctgtaagggtcagtcttgccatctgtgaaatggggataatacttatctcacaggactgcccagtggatcagatgaggtattgaacatgtgagctgtccttacaggagcaggacccagcaccctgtcagacacttaaaagaagagctgaaggtaggtttcacctgtccccaggaacaactccaagcagctgagtagagggtgccatccttctc

SEQ ID NO: 6752 - DNA, 1090 bp, artificial
  synthetic oligonucleotide
ttaaagagtacctgaagtgaagactaagctgtgactgtgttggagcacagcagggaaggccaaaatagaatgagttatgtgctctgagcttgtctggattctgggaaatgcagcagcagccacagtctgcaggtggtccccattcaggccaaatggtgttcatccctcctcagcatggtgggcacgatggaatcatagcttcctagagctagaagggacctcattcatggttctaccacagccctcgcccccaccatttagggagaaaaatgatgcaaatagaggcaaggagaggggtaggaggctgccacacctccagagcctccagggagtgaatgacagcataagtcttgcccagacccaagcctggtactgtctcccttcagcccaggtctggacccaccttccctgtccttgtacgtttccaacagcttgagttgctacctggcctttcctcagagccccttccttgttactctgagcatatacagtgtgtgtgtgtgtgtgtgtgtgtgtgtgtgtttgggccccagttaggatgaggccacaggcagaaacagaaaagaggaggctcctgtcattgcttttcctacttgggaatttcccctggggcaggggtaggggaggagcccatgagagtcacaggctggacagggcctgctgcagtcaacaggtccaggtctgagagcaggtactgccattagtgccattaggaaagaatgcagaggcagcagccacagagggaacgtctgggctggagagggcagaactcctcaagtccaggcagacagggcctgcaaagtgaaaccaaggggactcgcaaagaaggagggttctgttcctgccacagaagtgcagcctccccagcaacaggaatccctggagaagaaacccaccctgggctttctcagatcccccagagaaaggccacaccccctggatactgttgtcatggcagcagctgcccagtgctaactcccttctccctttcctgcatggctgtcctgcctgcgttctgatactttcagctcctgcttcctgaaaagatctgtgctgcccaccctggcagtatgcaaacgtggctggagcc

SEQ ID NO: 6753 - DNA, 3251 bp, artificial
  synthetic oligonucleotide
ctacctccagactgaaaaatcttcctggctagagaatgtggctgtggtgatggtgggagtggtaactgtattgtgatctgtccgcatttccagtttgttgggggcaaaagacagataggtgtttcccatgtacaagaagtgggccacgaaggagagcaagctgctctcaaagagagctgtttgggggtgctacagattccagctgaaaaaaccctatggaatggacagctgaaaaactcagagctgaaggagaaacagcaatagcatgtttctttttttttttttttttttttttttgagactgagtctcacactctcacccaggctggagtgcagtggcgcgatcttggcaacctccacctcccaggttcacgccattctcctgcctcagcctcccgagtagctgggactacaggtgctcgccaccacgcccggttaattttttttttttttgtatttttagtagagacggggtttcaccgtgttagccacgatggtctcaatttcctgaccttgtgatccgcctacctcagcctcccaaagtgctgggatacaggcatgagccaccgcgcccggctgcatgtttcatttttgatacagaggtagcagtaagggagcctctgatgagagtcccctttaaacagctagatccgtagagagtaaagccaacttactatataaccagacaataattttctgttcctttcccccttactctttcccttcactctaaccgcggacaggcctgaagtcaaaattagcaagctggggaaggaagatgggcaaagagaagaaactcagtgcatccctttgctcaaatatgggaggtcacctgaagttggtgctaggcgagcagagaaggtctaactctaaatcaagttcagtggccctttattatttggaacttcgtgttctaatcactgaattcaggctcaatttgtgatttaaagtgactgtaaggtggcaggaaagccatggggcctgagagaaatgtaattttaaaagtacaatattagagacaaaagtaaagttgcattttgattgtatttcaccagtagttcttgttcaatatactgactacatttgcttggtgcgttgtttgtgatgtgccaaactcctgtggatgaatactactactgtttttgcattaattttgctacaccagctttcttttgcttagtatttgcctggtatattttttccatccttttattttgaacttttctggataattctaagtgtgcctctgagaaaaggcatgaaactagattctgtgtcttataaaaaaaaaacaatctgaggttttcttttaatatgtgagtttaatccacatatatttattattactgatctattatagatatatttctacctttttactttgtgttttctatttaccatgtatttttatttgcatgtttccctcccctcctttcctgcctcgttagaccaatggagttttctttggagttttggaatttacacattgtcatggctttaatgtgtcccccaaagctcatgtgttggaaacttaatctccaatgcaagaatgttgagaggtgggacctttaagaggtgattaggtcatggggctcttccctcatgaatggattcacactgttactgtgggagtaggtttgttatctcaagagtgggttcctgataaaaggatgagttctgctgccttcttccccaccccctgctcttttgaccttctgcttccaccatgggatgaaggccctcaccagatgatagcaccttgatattggacctcccagcctccagaaacataagaaatacatctctatttatgaattatccagtcgtctgtggtattctgttatagtagcacaaaatggcttaagacacatgttccatttttaatcttgtagtgcttatcctaagattgttttctgtttttttttttgatggagtcttgctgtgttgcccaggctggagtgcagtggtgtgatctcagctcactgcaacctccacctcctgggttccagcaattctcctgcctcagcctccctagtagctggaattacaagcacatgccaccataccgggctagtttttgtatttttagtagagatagggttttgccatattggccaggctggtctcgaattcctgacctcaggtgatccaccctccttggcctcccaaagtgctggggttacaggcgtgagccatcgcgcctggcctcttttttttttcttttttttaagttgtggttttgctatgttgccaaggctgtactcaaactggtgggctcaagagagcctcctgcctcagcctcccaagcagctgggatcacaggtgcacaccaccacatctggcagatttttctaaattatttatctaactttatattttttaaacaaaatttagagtatctccaacttctatcctgttccttatacatattttttacattttggagatatatatatatatatacacacacacacacacacacaacttatatacaaatatatatacaaaaatatatatacaacttaaatacatatatatatacaacttctgattattggcatttgtataagcaagctaactattaatcattattattacaattcatagttaataatacacttttaaatatattatctcatttgattctagaaaaagttcagctaagtattacctccataatgaattaggaagaaaaaaaggaagaaagaaagaagagacaagatggaaagagaagagagctcctcaattcttaatggtatcttctggggacctcaggctgagaactacagatcttgggaatatattctttaccctttccttttggaaagggaggaaggaaagagaattgtaatttttgaacatttattctgtgtcaaaaacttgctgtaagcaagacaaaccttacatttactaactactttccttttcaggtgtttcatgagtgtcatgcaatttatttcacaacatgcttccgtaccaatccacatacattctcctgaatgaaaacaggcttatttatgttgatgatgaagacattgataacaataataaataacagttataatagctatttgttatggacccaccttgttagctaggcactgaatgtcatgggggtaaatatactctttaaactgcccttcagttttagaagggaagccatctagatgtctggatagataaagcgacatcatctctatagtgttaaaatagagaaacttgcaaaatcaacagagtccatgtgtgaattt

SEQ ID NO: 6754 - DNA, 1871 bp, artificial
  synthetic oligonucleotide
gatactaatcagacaataggcaactccaaaccacatagcaggtcacacacatgagcttttgctgccacccactcctgcactgtcagcaacatcatcgtcagacactaagagagtgttgctttgagaactctgacttttctttcctgcccattgtcagtttctttctgtaacctttacattgcctttctaaccacacattaaatcccacgtgttctataatcccctcactttccacagcagtgtgcccactgctgagtcaaaggcaggtgctgtttcacaactgcaaatccagtacaatcagcctcaattatgggccagtttcaggaaagacaaataggatgctgaggacttgacattttcagacaagccatggcatagatccaggaagtctgctcagttgcatcaccttaagcaaaagcacttgggagaccaaattattttccgtgtacagaaccaggtatatgaaatggtaggataaagtagaagaggactatttagaaagttcactgagtagggatgaacattttagcactgcagagaaacacccaggaggaaactggaagtgagggccagggagctcagctcatcctgagctctggaggtagagaatttgaagtggctcttttctgatggctctgattctggctaaatgtttgctgagattctgttcaagataaagtagcaaccagcagcagtcagaagattcccagagaaggctaaactaaagagataagcctcagaccagagaccaaatcctggagcagctgttaatcagtgctaagaagaccagggcctggggagtcttagctcatgttaattgcattaattaaatcctggtgtaggccgggcacggtggctcacgcctgtaatcccagcactttgggaagtcgagacaggcggattatctgaggtcaggagttcgagaccagctggtcagcatggtgaaaccactgtctctactaaaaatacaaaaattagctgggcgtggtggcgggcgcctgtaatcccagctactcgggagactgagggaggagaatcgcttgaacccaggaggtggaggttgcagtgagctgagatcgcaccattgcactgcagcctggttgataagagcaagactctgtctcaaaataataataataataatcctagtgtagagctcagttcaccatagattctaatggttccataggtccctccccatttctttaccccaaaaagattcttttgaccctatgaagactggaaagtcattctagttactatgaaagagaagtttctggccctcatgtgtgtccaaattatcagagatcaggaaaatcctttgtttcaagttgatggaatacatatcaattattcaatcaatttcagtgtctttaactcctagtttgaatgtgatctactattatcggtctttcttagattcattttacagatgggaaaaagaagactaaaaactatacatctctgtcttctctgcctcacattttatactttcactctcattccaactccactttcccaaacataactaataccatgtttgcaagttggtgaaaatcaagccaaccaaaaagatagactggagcagaaataatgcaaggcttctttttgtagttagtgttctgaaaatatttagatgtgtgtctcatgtccagtttcatattcagtctttggcctctccactgctctgcatctactcagacctctactcacctgcaggttcagagtatcatcttccagagatcaactgaagtctcctgatacccaataggaatcaaggtcattctcttcatctgaagaatggggcaataggaagtatagaatgatctgttcatgagccttgattctgccatgcagctccctttgggctc

SEQ ID NO: 6755 - DNA, 698 bp, artificial
  synthetic oligonucleotide
aggtccctcccttggtgggctacaggtttttcaagccaagtgcggtggctctgaaaagagcttttgggttttggtgctcaggcgctcctgaggcagctcacttgctcctggtgtagtggagcagagtcttggagcccctggatatggcgtgcttgcccatctgccccgggaacatcaggcgaatggtggtctgcatctcgcaggaggtgatggtggtgcacttggtatagtgggccaagtggccggccttggtggcgatgtgctccaagatgtcgtgaacgaaggaatctatgacatccactgcctcgggggaaaggctgaggcccgcgtgaacctgcttcagcacccggggaaaataggtggtgaagctgtccctgcagcggctggggtgagagtgcccatgcctcttctgcttgtgggccatcgtggcattggccgctttgggctccttggtgctcaggcctttgttggaggtcatctcagaggaaggctcagccatcttggaggcagctgccagtggataggaggaacagataagctgctgatcaccagtgggagggccttttgtagtcaccacatggctgacattgtgggccaacttgaggtctgattggatgaagtgacacacagcgcagcgttcaaggtgatttggatggtcctgttgcttggcatcttatcaaccagtcacggtgggcgtt

SEQ ID NO: 6756 - DNA, 1588 bp, artificial
  synthetic oligonucleotide
tttccccgcttccccctatacaaaggtgaggaactctcattgttcacttggtttctgtcccacctcgtgtttaaggtatccggtctaaaagcccggaggagagccgaggtgtaaggggatagggagaagggaagagatgggttagcagcaaactcacggatgaaagggaaatgggcccagtccgtgcgtccgagctgctgacgccgtgccgcctcccgcgcctgtctgccgcagcccccgcccgccggcccgccggccagccggcccgctcccccttcttgctagcagtagcttcggggccggaggctgtgcggcgaggccgccccctcgccccgctgattggccgcgtcgcccggcccgtcacgctcttttgtctcagtcgccagagactgaaagcaaccgcggctgcccggagggccgaactggagggtgggcgcagccttggctgccttgggaaccgtgctgcctcgactcggctacccctcgctgggcggtcgtgcgcactcgctaggtcgggcagccccgggtcgcttagcggccgaggaggcggcagagatcccgttcccctgcagagctacggggaccggaaggcgaaacagagctgtggacgcgggagcacatgctgcccaccagtggagcacaagtaaagaaagaacgcgcgattgcccggcgcggagaggggtgggggaagccccgccaggactgggcggcgcccggcttggagaatcagtaactgcgaggcaggggatggagcactcccttggcctggttgcgctgaggaaggagttgtggttcatctggatgctgccgactggataggatttaggatttgcctggattaaggtgggtgggggtgttgtcgtaggtcgggggtgttgttgggtgtcgggggcggggtgtgttcggggaggtggcaaggggcgggaggagacgatcgcaagctgtcttgaaccccttttgcatctcctcatctcttcctgggaaggaatatgagggtgggaggttatccaacttctagtctctttctccctggcaggtcatcaaagccgaatccgaacttgaattctgtgcggcggattgcagagctggtagggcgagggtctcccggaggaaatgtaagggggatgcgcgggagggcaggaggcactttggcttgcgttcagaagatgggagagggaattttccgcctggcgacagtggaggcggtggaggggaggtatcaggttttcagatgaagctgtttccaacccttcctttccctccttcgcggcacagtcttgaggccctgaggactgggatctgcgacacccagtggacaaaagtcggccgtaccccagaggctaattttctcacggcaggcacctgttgcagaggctgcacgtaaaataaaggcgaacgctagtttccgagctcatgtaagaatctgagaaataacgggggaaacgttgacaagggggtgtgattgagacctgaggccatgaggttaatggtttcttattatcataaatctgtgacacacaaccattgagttccgttttgagggcccagtatcagctcccaacactatgtcatctagaattagaagcaa

SEQ ID NO: 6757 - DNA, 4165 bp, artificial
  synthetic oligonucleotide
aacctaaagcatgctttagaatggctgtcctgccaaattgctttttcaagatttactgacctgcactctgtcttcagtcaaattcaggcgtgctgcaagtctctctcttaggggagaaaattacaaatattcagtatttggagttgtggataaaatgcaataatatgaacgtggctcggctcagcactttgggaggccgaagaggttgctgaggtcaggagttggagacaagcctggccagcatggtgaaaccctgtctctactaaaaatacaaaaattagccgggcatggtggcacatgcctgtaatcccagctactcgggaggctgaggcaggaaaatcgtttgaacccgggaggtggaggctgcagcgagaagagatcgcgccaccgctctccagcctgggcgacagagtgagtctcaaaaaaaaaacatatatatatatatatatgaatgtacattatttctctcccccacctcccagtgcagttttctgtaatacggttgggactcgctttagggaggtttttcccattaacaacttcgctgttaaataagatagaaaaaggaaacatatgtaaaagcgcccgatggtttgttagctgaatatgactcaattcttctgtttgtgaaacagcagagaacaaccctggaaatctttccttgggaagtccgtccgtgaaaaaaaaaacaaaaaaaaattaaatgccaaaacacctttaaagcgctgtattgaaccacagtatttctgtttatcgtaaaaaggagaggtgaactctcagggagggaactccaaaccacatcggccaagcgcgccctagggaaattcttttttgctctttgccgggcgaaggctaagtacaacgaagccagaaaggtccccttaaccctactctgacctgtccaggtgccccccgccccccattccagcctggccagaaaaggcctgccccttcgtacactacgggtcggtatgaggagggctccgatgaggctagcgaaggaaaggggtcgctggctaccgaaagctcaaaagtccgccccctggttgtaaaagtgcgctccacgtggcagggcggttactagggcgaaaagagtgaggcgctcgccacgcgcgcacaatgtaaatggcgctaaaaaactcgataatcaagacaaataatattttaatgcaatattaaaacgtatcaaaattaatgcaaaaacaacccatggtgagcaaattgccaaaattttaaataaaggcgggatcccaccctgcctcactcgctttaccctagtcccgccccagtcttttacatcctccgcgccccgcccaccacgtcccccaaaaaccaagggcggaggcagcgcccgtgagccccctacgtggcttttagctccggtgaaagggtcccgggatgaactgggcgcctccggggcaagccacttaccgcgccacaacgtcgggatattgagattcatcgaaaaagttctctagctcctgcagctgaaactgcgtgaacgcggtgcggcggcggcgtttcctctctgggggctgtggtccctcagcggtttgtggcccctccgccggctgtggcccctccacggtcgtctggggcggctcctcctgctcttgcttcagctcgagcaggggcggctcctcctgctgttgctccggcttggtcaggggcggctcctcctgctgttgctccggctcgtggccgccgccaccctcacggtcttggtcgtccgaggggacggacccttccgtgccaacgttgttttccgcttctgttccgtactcaggtttggaccgtgtattctcctcgtcctctcctccccttgccatcagcgaggtcacggtaagtttctcatctgggaagggaggaaagcaaaagagacaccagggcgttggagcccacggcgcgtgggctggaggaggcaggggacccgctatggaagagcaactgcgacagccgcgcagcgtctcctccgcttgcctctcccagggaaaaattcctcttttggagttcgcgaaagctcccgtccctgtccaagcactaaccattcacttcctcgatgtcctcgccgactgccaggctgcggtagccaatatcactgtgggtgtacccgcgaagagactccatgcttcaagcgctgtcgataaagctgtgcacttctgcagactctgtgcgtggttccgcggcgatcccggggttggaactggctctgggaccaatggctcgggcgagcgcttttctggcgccgggacctctttctggcgccgtctggcacttgcgcgccctatatagcggtacggtgccttccgcaggttcaaagcgtatgcacacgcgtcggttaaacgccccctattagcattcacagtacatctagttgtgagtgcgacccccgggggacgcattcgtgtccagggcgtacgaaaaatagggcgagcgtgcgcaagcatggtgcaggtagtgaacatgctttgcggggaacagtggccccaaattgctgcttaactaactactcccaacttgagcagagacccagattggaaaaagcggctgggttgtgaaagccgatttgggggcgaggagacgagggggcgagggggcgagggggcgagggggcggggtgagacctcgcaccagcccgtggagaggtattttggcagtgttcctccgcccaaccgtctttaccccgcagcacttgggtggagcgatgccctttgcttcccccacggaaaagaccgagagatggcgttgaggaaagcgcggaaagttcagcagcccaaacatgcgaaagtgaacttgttagtctaccatgcaattgggttctgagcacgactctcccctgctagaaattagtgacaaatggataggactatctagttctgtacagttcgcgccaaagtcaggatagtgataaggtgcaatgattggctagaaggctgcttgctctggatttttgaattcagaacccaccgtgcattccgggagcgggaatttggggctgaatttgaagagcagtccgctgctcaggtgcacgctgcaagaaacccaacgtgctttttgagaaagctccaaggacttaagctttttagtaatgaacttatgtcagagtgcaagtatagaaatctgctaagtgcatagtgcatccaagaatgcttacactacgggggccccgtcttttgatgcgcggcacttgaaacgtctgctgtactaggttcctgcgcttcttattgcagcgcgctttgcagaagcccgttctgcaggctcctaaagcgcgcgtattccccgggtttgtgctgtggacctgggagagttcccgccttccccactaccccttcttcctcctccccctccctttttctagaactatcttcctgaattcttgctccatagtgatgtatcacattaaaagtcctgggctatgattgaaggctgtatggttctccctccaataagtgtttgcaggttctccaggacgtgttaatatccgtaatattataaaaataactctgtagacttagttactagggaggctgaggtgggaggatcgcttgagtccgggaggtcaaggctgcagtgagccatgatcaggatactgcactccagcctggacgacagtagaccctgtctcaaaaaataaaaaaattaaaaaaatttttaaaagcctgctaataattggccctatgcttgccactgtacacgatttatcttactttcgccttgataaccaccattatcatccccccccctttttttttttttgagacggagtctcgctctgtcgcccaggctggagtgcagtggcgcgatctcggctcactgcaagctctgcctcccgggttcacgccattctcctgcctcagcctcccgagtagctgggacgacaggcgtccgccaccgcgcccggctaattttttgtatttttagtagagacggggtttcaccgtggtctcgatctcctgacctcgtgatctgcccgccttggcctcccaaagtgctgggattacaggcgtgagccaccgcgcccggcctatcatcccccattttttaaaaaaaatacagaagactggggcccaaagagccaggcaacttgccaatggcaatacaagccagttttaactacaaaatgtgtgcatttttcactatattacggctgtcttaattcaaagga

SEQ ID NO: 6758 - DNA, 580 bp, artificial
  synthetic oligonucleotide
aagtgaatttgaacagtattaaacatcttaattctcctaatgatcctgaatgttttaaggataattaaggttaactaaaataaataggcctgctcgttcaagtgcacatggtgagcatattcttaggaaatgaaattatccatttttgtttcccaggtaagaattaatttatagaaagaatccaccagcagaaaattttttttaatactcggtttaagtaggtaccaattccttagaaattttctcagtaaccaggaagaaagttcctatattattatgccagtgtaatagaccagcatgttagtcacttaagtctagaggaaatgaatttattacagtgtaatctgtgctattaagtactcggggatcaccattaagctataaatcagtgtcactgttgattcaggggaaaaaaaaaccagtaacgagtcttcacaggtttttctcacagacccacaggaatctagaaaaaatgagaaaaacctcaaccttggggtttaatgtacatgcaatatgactgctatataaggaagaataaaagtcccttcagggtagtatattttaactccaattacatgca

SEQ ID NO: 6759 - DNA, 13223 bp, artificial
  synthetic oligonucleotide
gagttttcttcttgcttctggtaaatattcacttcccaaggacagctcttgtattgttattgtattagtccattttcatgctgctatgaagaaatatctgagactgggtaatttataaaggaaagaggtttaattgactcacagttccacatggctggggaggtctcaggaaacttacaatcatggtgcaaggcaaaggggaagcaaggcacatcttacatggtggcagaagagagagaacccacaagggaaactgccacttttaaaaccattggatctctaagaactcactcactatcatgagaacagcatggaggaaaccacccccttaatccaattatttccctccttcaacaagtggggattacaggtccctcccttgacacgtgaggattacaattcgagatgagattttggtggggacacagagccaaaccatatcagttatccatgcccctttcacaaggacttaactttaaaagctcatttaatagttctgcttctgggatggtagcataaggagctccacagatctgctccctagtgaagcaagcataactaatgaaaactaaaaccaaaaataaataaataaataaatcggaaaattgtcctaagggcatacagcaggaaatatttatttaaaaatatctaaaactcagtaagagcagttagaatctttggccctcgattcgtgatccacttcctctttcacccctccccagctcaccttgatagaagctttactccaggtggatgtggccaagaaatcaggactccctctctcctcagctccaaatccagggatatggtaatttactggtaggggcaagacaccagcatttcttatctgacccaatttggagttgaagatgctgaattcctggtgtgtggctgagaatggagggagcccttccttcatccagcccacattcatagggtagaaactctacacaaggcataggagaattagaatactggagatgcagctacccttgctctagctcactcgtagggcagaggttccatgctgggagagacaagctgagatcagaagctaacactcctgcccagtgcttggagtatggctcagagattttgctcacatggagaggagtccataagaacagacatttctgaagctttcccaaaagactttattgaagcagagtgtgaagaagttcaagcctaaaagcctctttaatcaaacaatgcagattttcgtagttaacaaataagaggatggtagctccttttatttaagaacagcaagcagaaccatagcatagctagttcactagggaaaagcaaggaaagacacagctaaaaagagccctctcggggtcagaacaaacctcaaaagactggctcaaaaactagtcctgctcaaatttagctggattaggctgtggagcaatgttgaaaacaatagagaaatcagccccaattagtggagcataacagctggatgtgatactaaggcacacagcctaacagagagattagggaaagagactaagagagccctgctaaaatcacagtcattccaggacgactgactatatgcccaaggtggtatcctctgaagaatgacaccaaaatctacacactatgagaaaaagagctttcattaaaatagcctagctaagtcacaaaacaaacaagcaagtaaaaacaaagacaagcctcagagaatggagaagggaatcaacatctagagttacaacaatggattgcctaaaatgtccaggtttcaacaaaaattacaagatatgcaaaaaagaaaaaaaacggaaagtgttacccatatgcaggagaaataacactgcaggcagcagaaactgcctggtagatggcgaagttgttatatttaacagagaagccttcagaaaagccaaaataaatatgtttaaataaactatgcttcaataagtaaaggaatccccataagataaaagctgatttttcatcagaaacaatggaggccagaggcagcaggatttaaagtgtagaaaggaaaaaaaaaaccctatcaatcaggaatcacatattcaacaaaacagtctttcaaaaatgaaggcaaaaagaaaatattccaagatgaactaataatgagtttgttgcaagaagagccactttatgagaaatactaattgagattctttagtatgaaagcaggtgaccacacaatgtagagttgtgccatggtatctgtgggggaatggttccaggattccctgagggtgccaaaatttgtggatgctcaagtttccaatatgaaatgatgtaatgtttgcatgtaacctactcacatcctcctgtatactttaaatcatctctacattattcctatagtaataactaatacaatatctgcacatcacttcattcacaaggattcaatgtagtactcagtgcatggcaaattcaaattttgctttttggaacttagtggaattctgtttttttttcctctagttattattattattattatctgagacagtttcactctttttgcccaagctggagtgcaatggtgcaattttggctcactgcaacctccacctcccaggttcaagtgattctcctgccttagcctcccaagttgctgagattacaggtgcatgccaccaggcccggctaattttgtatttttagcagagatggggattcaccatgttggccaggctggtcttgaacccctgacaggtgatccacccacctcagcctcccaaagtgttggaattacaggcataagccacagcgcccgccctcctcaaatattttaaatctctggttggttgaatccacagatgtcaaacccatggttgtggaggactgactctaatgtgaatccacatgaaaaaacaaaggtaattatgtaatttttaaagacaatataaaaatattttcctttgttctctttactgatttaaaaagcaatggtataaagtcattgttattgccttataacatatagaaatgtaacatactttgcaataacacaaatgaagtgggtaggagcagtgttgtattaaagtaagaatatggcaccagatggtaattcagatccatgagaacgggtaaataaggttaataatacaaactgtataacatatatatttcctttcctttcttctctcagcttctttagaagacataaaattatatacagtaataattataacaatgcattattgggtttgtaacatagatgtaatatgcatgacaataatacaaaaatggagaagagggaacagagctatataggactagcattcctatatatcactggaattatgtaaatataaatctgaaatagattctcataagttaagatgtatttggcaagccctagagcaaccagtaagaaatagttcaaaaatataatgaagaactcataaaaggaattaaaatgttgcacagaaaacattacttaatgcaaaagaaagcagtaaagaaggaatagtggaagaaaaagacatgagacatatagaaagcaaaaagtaaaatggcagatgtaaatccaactttacacacacacacacacacacacacacacacacacacatgcacacatacactcacatttttgcttctgtcattttggccctagggaaataggagaacgatgaaagtagaaaaaaaggaggcctaaattgaaaatttgaacttctctatgtcaattttcattgctgatgtatatacattagtctgtgtacgccagtgggtaagtagtatgctatagtggaaaaaccataggcttggaaataaggcagacaagaccataaacaagttacttaatcattctaacttctagtttcctcaactaccaaaacgagatgaaataatttacctggcaatgttgttgtgaagattcaatccgtgattcccaaacctggttgataattggaatccacaagtatttaatgaaacttaaatttgcctcccagtacagatagcaaactccctggtccctcttacaaaaaaccatcactgttgtcagtttcttttttccttttttttttattattgtactttaagttttagggtacatgtgcacaacgtgcaggttagttatatatgtgccatgttggtgtgctgcacccattaactcgtcatttaacattaggtatatttcctaatgctatccctcccccctgcccccaccccacaacaggccctggtgtgtgatgttccccttcctgtgtccatgtgttctcattgttcaattcccacctatgagtgagaacatgtggtgtttgtttttttgtcattgtgataatttgctgagaatgatggtttccagcttcctccatgtccctacaaaggacatgaactcatcattttttatggctgcatagtattccatggtgtatatgtgccacagtctatcattgttggacatttgggttggttccaagtctttgctattgtgaatagtgccacaataaacatacatgtgcatgtgtctttatagcagcatgatttataatcctttgggtatatacccagtaaaggggtggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttttcaatgatcgccattctaactggtgtgagatggtatctcattgtggttttgatttgcatttctctgatggccagtgatggtgagcattttttcatgtgtctgttggctgcataaatgtcttcttttgagaagtgtctgttcatatccttcgcccacttgttgatggagttgtttgtttttttcttgtaaatttgttggagttcattgtagattctggatattagccctttgtcagatgagtagattgcaaaaattttctcccattctgtaggttccctgttcactctgatagtagtttcttttgctgtgcagaagctctttagtttaattagatcccatttgtcaattttggcttttgttgccattgcttttggtgttttagacatgaagtccttgcccatacctatgtcttgaatggtattgcctaggttttcttttagggtttttatggtttttaggtctaacatttaagtctttaatccatcttgaattaatttttgtttaaggtgtaaggaagggatccagtttcagctttctacatgtggctagccagttttcccagcaccatttattaaatagggaatcctctccccatttcttgtttttgtcaggtttgtcaaagatcagatggttgtagatatgaggcattatttctgagggctctgttctgttccattggtctatatctctgttttggtaccagtgccatgctgttttggttaccgtagccttgtagtatagtttgaagtttgaagtcaggtagagtgatgcctccagctttgttcttttggcttaggattgacttggcgatgcgggctcttttttggttccatatgaactttaaagtagttttttccaattctgcgaagaaagtcattggtagcttgatggggatggcattgaatctataaattaccttgggcactatggctattttcacaatattgattcttcctacccatgagcttggaatgttcttccatttgtttgtaccctcttttatttcattaagcagtggtttgtagttctccttgaagaggtccttcgcatcccttgtaagttggattcctaggtattttattctctttgaagcaattgtgaatgggagttcactcatggtttggctctctgtttgtctgttattggtgtataagaatgcttgtgatttttgcacattgattttgtatcctgagactttgctgaagttgcagtttcttgtatgttcatccagcacctgaggaacttatgtaaaaatgaacaaattgtattttgtttttatttatttatttatttgatggtcttgctctgtcacccgggctggagtgcagtggtgcaatcatagctcatggcagccttgacctcctaggcctctagtgatcctcccgcctcagcctctcaagtagctgggaccaaaggtgttagccaccatgcccagctattttttaaattttttgtagagactgggtctcactaggttgcccaggttggtctcaaactcctggcctcaagtgatccacctcagcctcccaaaggactgggattatgggcatgagccaccacacccagctaaattgtattttaaaattaattttaattgtttttgaagaggaaatgtactgatatggtttgagaaaagaaaaatgaaagtataaaatgtactcagtgaaataactcccttctatctctacctagtgcaaccctctcccaacaggtaaataatatgataaatttcatgcatatttttccaaccaaatacatattattcttctcctcaacttttttttacacaaatagaagcatcctatgcatgttgttctgcaacctgtgcttctcctttaacactacaccttgcaggtacttctatatcagtacatagagtttcctcatttatttttcaagctgaatagcacttcatcatatggatgtttcatagttcatttaatcaatgtcctaatgatagataactaagttgctttttgatcaaagcaagcatttgttaaatggaaagtaacagatgcacatagtgaatatttctaagtgtaaagtgaattgtcttagttattcgtgcagtaatgctttgtaacaaccccctcctcccaacacaaggtataagtggcacataacaataaatatttatatttcttgctcacaggtctgtaagtcctttggggtttaactgagctcatttgggcttggcctaaagctatgggttgctttctgatgtgcaccaatatctcatcattctccttggacctggagctatccaggactattggtggatggcaaaagtacgagaggccaagctgctaacatcaagtctgctaatatttctttggtcaactctagtggagtgggaggtattcaaagtctcaagttaaagagtgtaaatatacaattttttcatagtgatggtgtgaagaactagaaacaataatctaatgtcccacataatacataatgaaacataaattggcctctcactcccacattgccaatcacctccccttccaacaaacaaccattattatcagtttcttgagtattcacccagaaatacctttgtatatatgagtatgtatatatctacaattttaatagatgttgtcactttgctctccagtgtggttgcactagttgacattctagataactgaatgagaatgtctatttcttcacatgctttcctacattgtatgctatcaaatatttattctttgccattatggtctaggttgcagttacttctcaatttatgtgtgcccatttgcattgtttaaacatgtagtatctattcatgtcatttgcctatttttctattgggttgattttgttttccccaattgatttgtaagaaccctttatataattttccctttgtttaaggaatttcagtttttctctcaatttataatttgccttttgaccttgtgtatggtgtttttttctttgcagaaatttgtacatagtaaaaagtatcaatctttttctttttggcttatggattttgagttttgcttagaaaattgttctccacctgtggaagtccactccttgagattctgatttaacagatctgaggcattgtcccaggagtctttaacaagatgctaaaccagtaattttggccatcagcctggtctaggaacatggatgatataaaatcaagtatgtaaggtacctggcatgcagtagacacagaataactgtttgtagtctggtctctccccttcctatcctaagaggctactttgagatttaccttgtgcagagagaataaagctcagcatactttttatttacttttttttttttgcaaagctatttatcccaattgataacatttttaaaaagtttggcctttctaaatggttaccagctcttctcaccattaatcatgagaatatatcaagtgcccaagatttggcaaactatgtaaagttctgttcttaatattattaggaagatgatatactaactctactctagtgggccatgggaattgatgtatttcttcagaagcagtaattatttcatgtaacctagggcatttttgccaaaaaggccatctgtaggtaggggcactaaccataatttgatcaaacttggtcatgaaatagattgggtctaattgccctaagcagatatgaccctggccttgttcttggtgcttatcatatgacaagatttcattattagcaattgggataattacactcactgcttcttttcctttcctgggctaggcagaattgaaagattttcttgaaaagccttctcaagtgttaatgtgcatacaaagttacctggggatcttgttaaagtgcagattctggaacagtaggtctggggtggggcctgagactgcatttctatcaaggtcacaagtgctgctggtccatggaaaacactttgagaaacaaggtgctagaccatgaggtctcacccagtcttttctaaaagttcactggttccttcctcattttcttggcatcttattcctctttggattctttatgcttactttcctgaactcctttaagatcacttttaaaaccataaaacagactggtatgattggccaaacaagcagctctctttgatgaataccaagagcccatcccccatccagaaaaaaaaatccattgatctaccatggtgcgttaagtttccaattctcgggagtcttcttaaagtttctggtgaagggtgatgtaacccaggaaagtttagtcatactagtcaggcattaatcagactggagcaccaaccatcctcagcagacagagtactgaaaaaatggtaggtacacaaaggagtaagttttgatagggtaggaggtacagaacttgatacataaaagcactgggtattagagtgaaattgggtcaaattggttgtatgtgccactgcattccagtctaggtgacagagcgagaccctagatatagaaagatgatgaaacgagaaaccaacaggacaggaagaggtttgtttttattttaaatgtattgtctacttgatgatttgcctagggatcttattggctaggatcctgaatgagctcccctcactctgactgctggctccttaacaccccaatgtaagtgaagggtcccgtggcttgatcaaatggtctcatccatggacagccctgctggtcagctaaggcccagggtccgggggctagtgccatgctaaaggccagactggaggtgccagggatccaaccagaaaggaaagacttgaccaggtggtgtccttccaccaaggggccaccccgtgttgctgcctgccgtacccagctggttggaagcacctggcagttggcattgaggaccactaacagtaaagtaggtgcggagggggttggcgggaggtggtagtgaaggttgcacagggccagccggctagcgtagggaagtttgcatgagctccgtaggcaaggagaaatggaaaattggctggctatctcccttcaaaagaattggctgttaaaaaaaaaaaaaaagaaaaaaggaaaaacagaagcagaaacggcaggacatcttctgttttaaaaatacagaccattttccccctcccatgtatataaacaacgaaaaccaggagggtagcttggtattggttcccgcccgaaggtcctttcctttcacacccgacctctctagatccccgacttaaccccgattgaagaagaaattttccaggatgggggtggggttttgctggatttgtcgaaagagatggtccacaggggaagagtgcataaacttggcgagaggcgagagagggagaataaccttaatcatgcacaggctccggccttaacagttgagtgggtggtggaccgaggccaagcggccaaataagtggagtagaaaggcgcgagtctgcgctgcgtgccacgtaccaaacgctcaattctccctcctgggccctgtatccatctctcgttcgctctctgtggctaatgcagagcgatggaacagcctcgggagaatagctggagaaagctcagagaaagacaaattaaaaggagctcagcgcagcagcaaatgctggagaacagcgctcagctgacccgttaaatgagtaattcggtaaaggtgtgttaatcagtgcggcgccccgagagcccagcgaaacactctgggaagatacctggcgtggcaacgggactcttcaacgctgcgatctagaaacgctgctagtcctgggtcgtagtccctctcccctgtctcgcttaaagagaggggttcctgggttgcaatacgttggagagcaggtgatcagatgcatggttggcgagcccctggcgcatggcagaatgattgaggccagggtcctagctgcaagcccatccctgcgtcccagtacattacctgcctgccccatgactggcggggctggagaaccctgagacttaaggatcttataggtggcaggggtggaaaagaagagttctctccggtcctggaaagctctaattgtcagaaaaactaggtggtttgcgtctttaaaagcaagttccagtctgcggggaaccaagcaggtgaactcctgactgaactagatacctgttcagcggctagaactggagactgggagagctggaaaacttttagtggctttccatacctgcactcagttgagcgctcgccccaatcctgtacgccggcctactctggtaaggacgctagacggcgctgccgggacacgctttccttctccggagaaaggtaagagagcgctttttttttttttttaaaccaggggatgggggacttggggttggcagcctttctcaatctgcctcccctccccgcgctcccaaatctaaaggggtgtggaagaggaggaggagcagaagcagctcttttcgtgacgcgccagagcgcttctctctaattcccacctcctccccggtgcaatcagtcagccaggaggctccaaactgttagcgacaaaaacgcagctctcggtcactcccactaccctcccacccgcactccaggcatattttggaggcggcagcagcggtggcaggatgtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctg

SEQ ID NO: 6760 - DNA, 738 bp, artificial
  synthetic oligonucleotide
ccagtgagtaggagtcattatatgaacctccaacctggcacttatgtagcaccagacctctgtgaagcatgtctttgggaagcagaccttttggtttgttgatttcagtagcagtagttggcatatcaggtggtaagcctagaaacattcattgaaaagccccaagaaatgttggttctcttatttgttagtttgctttgcatggcagatgtgtttctgaaaggaaaatgtggattttatttatttttaaaaaaacaggctgtattttcctaaggtctaacccagtggttctcaaacttggcttcacattgtaatcatctagatcgttttatgacatactggtacctggggccacccccattggttttgatttataataactgcgtaaggagtgtggtctgggcatcaggatttaaaaaatctccccaagtgattctaaagtttgagaaccactgatttcactcttaaagatgctgacatatcttctatttgaaggagctcttgaccatatggattgctccccagtgaggctgaaactgttatggagagaacagggttgagtccctctttgtaggagagaaaggcaagtaagaaagaatcgtgtgaagttttgctctgtggatcaaaatttaaactacagcactacttctaccaattttcatgtcttttgtcttacctcctgcaatccatagtcatatatttaataatcattttatcatgatactatacccctaattt

SEQ ID NO: 6761 - DNA, 2232 bp, artificial
  synthetic oligonucleotide
ggaaaacatgtaaaacaaaaacttggacagctcgccctctagtggtaattttatgaattgccccccaacaattgcccttttagctcacaggaaaactgatagtaaaaatgaatgggattaagtttacatagttgaaacacctggtttaacaaatgaatttgttaatcacaaacacataataagctagtatagggtacacatgcttgcatattttctcaagtgctgattagccattatacctaacaagggatttccaatttggggaaaaaaaaatccagaatcagcaattctatacatagttatatatcctgtcccccaataaataattgtacatagtcattagagtctagttttattgcactcaatgttctttttttctaaaataatgttataattgttgataataacaacttatcctcttacaggtatgtataaacttttcacagggttttgtttttacaacagatagatgcggcaggatttgccttcctggttgtactgaagaggaagtaggaggcttatctataaagaggccaaatgagtttgcttgggacacccagggcactttgcaggggactgcactaatttttactcctaggaatctcctcctggcaaaataaattgcatagatgctggcatgttcctttctagtctttagatgctccttctttggaatctttatgtcaaactccctaaacatacattggttgtacagatcagaatgaaaatgattaaaatagagatacgagttttatacaagtggctttcttcactccattataattgttttggagaactcagatattaaagcattttgtttgtttgtttgtttgttttgagacggagtctcactgtgatgcccaggctggagtgcaatggcacgatctcagcttgctgcaacctccgcctcccaggttcaagtgattctctgtcttggcctcccaagtagctgggactacaggcatgcgccaacatgcctggctaatttttgtatttttagtagagacaggatttcaccatattggccaggctggtcttgaactcatgacctcaggtgatctgcccacctcagcctcccagaatgctgggattacagctgtgagccactgcacccggccgatattaaagcattggtacccacaagactaaaccaagagtaataactttttgagccttatagaaatctaagtcaagggagtagtgatgagaatcttaaaaacctgcaattgttcttttaaatactgaaattgctattcataagacttgagtgaacagagaaaggataatataggaataggaggtgttttcaaatccagggacaagaatatttataatcatactcactgattgtgaaacaaagggcagacatacattcacttatactttcagtgggttcgttccgtagcaagcttcagtccaactgcagagtttcactattcaggggaagtagtgaaattcccttccttcaatgcctccattcacatttgtggctggtcagggagatacagttatcaaatcacctgtgggagaagccaagctatctagtcaacagtcttctcaggagccctgcaaggagcttgcttaaataggtaccactggaattgtgaacagtatagggctggatacctcctgtggattgcaggcttgtgcagatgagatcaagcgcaccagttggctccctctatgggctactcagttccactgcggccccaattgatcagtagcctgcacctttgtcagctgcatcacagatgtattcattcagtatttgccaaatatgtatggagagtctacatgcaaggggctctggaagtatggcatgtgattgcaaactcctgatgacagaaatctgacttgcatgcattacttttaatggcacttggcaaattcagttatatgtgacctttcatctcttcttgcccttttgtgactttctgacacctctaagctcttccctcttaacgtcagtgttcaatccctccatgttgactgatcacctgacttttcaggcctcttacctcagcctatacttcttagttgcttccctagtcccaaatctaaaaataaatgtgctacatccttttctacctccttttgtcccactcttggtttattaagaatagcaatccaataaaaattaatcataccaacttgttggaatctagtaggggtctaatactctaatttaggtttaaggctacaatgccttagctcatggaaattgatttctac

SEQ ID NO: 6762 - DNA, 1004 bp, artificial
  synthetic oligonucleotide
ctccttttttaaaatcttcagttatttcatctgaagtaatacagagttgcaaggcattatcactcaatcataaggatctttcaaaaattataccaccctgctatgaaagactcaatttcaaaatattaatgattacaagccagagcttctgtaaacatacatctcaactttgaatactggcaacactttcagcaagataaggatgacaagaaaatgtactttcctagcctgttttcaaagcacatacacatttttaaaaggtcaaggggagggactttgtaagaatgtattattatagctttttactgaactgatttgttttaggtatctttttgttcatatcttttatgtctccatcatagtaattgtattcttatatgatgaaaataggatgaaacaaaaccactgagaatacacacactgtctttgttcctgaaggacaaacggtgacccaagtcatgggctgctttggctttgattaaaattaaaatcttgtacagattccagttctgaacatatgtctcatactctatgtgctcacattagggtgcgttaaaaatattttatgctaacagattacagtaggtaacagtatgcctttgtttcctacaaaagaatgagtcagtaaattgttctacttaatggataaaagactagctcaagatgcaaatatatcccaatagctctaaatcccactgtaattcttcctaatttaaggcatttattaactcataacagaggctcaagctattcatatttctagcttattttatttatctttctcttattacctgttctactctaagctttgcaaatcttgaaaatcctaaaaatgtcaaaggagagacttcaccaattaaagtgtgctgcaacatagtggagagaatggaaccattgtgtggttcatattgaactgcatgatttatatgagttttctttccttcccatgatttgttgtagcaaccaacttcacatagtcatgtaaaaattagagggttctaagt

SEQ ID NO: 6763 - DNA, 1141 bp, artificial
  synthetic oligonucleotide
tccaatttggagaaccaaaggcaaactaaaaccttttggcttatatttgttagttatagatagatatggatatggatgtaggtatagatatagataaaatcagacttgagacagcattgaaaaattgaagtgtgccattattataagataccatttaataagccacaataaaaaaaatcttattacgtgattcctgtatatgtgacactgtttgccttagatacatctctatcttttgctgctatttccccatccactcatacacacatacttattttatcaatgtctcaacacctgaagtactcccacttctgcctctgtgccttgtctaatcatcgcatctccaatcagattgcctgagttcaaatgttcttttcacgacattatttgctgtgtagccttggtaagttacctaacgtctctgtccttcagtatttgtatctgtaaagcaggaaaaatgatggtacttcttcatagaattgttatgaaaatgaaaagtaatgcatgtaaagtattttggcataatcttggcaataaatgtaaactattatttttactcctttaaattatacgattaatactactgctactattttctctactgccagccctctatatactctatatttattaaatcagttcttaaataatccttctctccgtagccttcctgtattaaagaggaaagataagagctcttttctcaccccacctttgcttctgtttcgcttgcttctcattgtcttaagaaagagacttgcggggttaacagcagcatctctggctgatgtaatccaaacctcaaaagcaacatattaaaaataaagcagaacatcaaagctggttctttaataagtcctctgtttccttcgggtcccacacctaggcgacagtattttttcatactttgttcttgtcccctattccatgtcttgcagatctagctcagttttgtaaattgcaaccttttctcctttcttctgtagttagttcatttcatttgaaataaagcatttaatgatcatctagccctgtgctagggagtcaggatatgagggagagttcttaaagaaacaaaatcgtgagatactgcctcttctttcaccaaacaggaaattagatttgtataagatttatatga

SEQ ID NO: 6764 - DNA, 927 bp, artificial
  synthetic oligonucleotide
cattttgatcatgtcatcttggattaattgctatttgggctccatgctttctttgcctggattaggggacagggcttgtgcaagctcctgatcaggcctcctgctgccagcacaatactgtctcccactctcctcaaattctttatcttcacctgttctggaactctctaacaccctatgacttcagcagctgttgtctctgcccctgaatcagacatgtgttcaatagaggggtttatataactaggccctgagaaggatttttccaaatggaactaccccatatattttatttactttaggatatattgcttctgtctctgtatccttcctagtaaatatcatgtctcttaactttctggagtcatgtttataaatgcagcagatttgtgtactatgtacagaccttgctgatttgcagctcctagcaccaatccttgtgtttagtagacattcagtaattattgtttaatcaaattggatcaaatctgaaagcgtattgatgccattagaggaagaagaatccaaaaagactgtcttcctaggaaggaaacttcttcatctctttgacattttgagaactccttgtgtgagggcaacatgtgtagatgagatttagattatggtttaagactaactactaactgctggcctctatcagtaacaggaagggacagttagcaaaatggtgattgagtttctgattcagtttctattgaaaggatctaaaataatatgtatacaattcattgtaactagatgttggaggtttgaaatattccgaaaaggattctaatttaaaatattgaaaaatatgctttgaatatatacaaattcaaaacactatatgggaaaaatgaaaataaaatagaaattgtgaataaaatatattaatgttacaaaagaaagtaaaattgaatcatatag

SEQ ID NO: 6765 - DNA, 2198 bp, artificial
  synthetic oligonucleotide
cttgaactttatctcttctgactgtgatcttggcttggctgttggctcagctcttgtgtatttatgatttacttcctttttgctgcatgtgctttacttcagatcctgattgatcctgtatgtttgagcctaaaagtacaactacaagtccaaattgccccttgggcaaatgtttggcattttttttagactctactatgattcttgttaatcctactatattggctcaatcagaagtgcccaagaccgttccctttacaatataacttttgctgtacaaaaaaaaaaaaaaaaaaaaaatggggtaaggaaaaggatggaagaaaaaatgatactaaggagacattaagttaggagaacctccttaacattttgtctattctacaggaaccatcttctcttataaaatattttttggtacaggccagagaaaaacacattgcactgcatgggatggataatttctctggcccagagcgatgttttgtatgtgtatgtctggaaaggagccaggctcaataaggacagaaaatatcaatgagaatgggataggaagttgaatttgaagattatttcgggtaatgaaaaacatctgatgaccttggccgactactaaattaaatctgagttaaaagatagtttggggctttaggaacaagagtccgcaggtatatttctctgttgataactatttgtgatggaagaaatgaggtgaggaatgcctaggtgaatgtctttcacagctaaattgaaacatacagactcagacagaaatggtcatggaggtttacttttaaaaataaattcatataccagctcagaaaacatcccacaaaatgacagtatgtgaagggttatcctcttggaaaaggaattcaattttgaattatccatactacagaccttgggagtctttagtcacttcatccaatgaaaaatggagatgtttgacttagtgacagatgatctgctcaacaatgttttctttcttctattgctgcttcaattgtatatttagtgaattagttgtgattgatgatagcattttaagcacttgatatttttttctggtgaaaagatggcataatttaactatattaatagttttaggtttaagtgaagcacaatatatttttataatccttcaatagtgaagtcacaatttatacaagtggattcattctgtctttagaccacggaactctgacaaaaggatgtcatttaaagtaatgttgctcatccttcagagatgcaaaactgaaggctacattgctctgatatgaaataactttggagttttgaatgcctggcaaaatttgtatatgccactaacagtaacttaagtggtttgtacagctggagccaaatatgctctgcagagaaaaatatcaccaactgctgtaattttcacataagtaataggactaaagaaacagttttgttcagaaacaacaccttctctaaaatctgggcatgaaatgttcaatcggtgatatggattgtctgtgtctccaccaaaatttcaccttgaattataataattcccacatgtcaagggtggggccaggtggagataattgaatcatggggggtggtttcccccatactgttcttgtggtagtgaataagtctcagcagatctgatggttttataaatgggagttcccctgcacaagctctcttgtctaccaccatgtaagatgtgtctggcttcccctttgccttctgccatgattgtgaggcctccccagccatgtggaactgtgagtccattaaacctctttttctttagaaattactcagtctagggtatttctttattagcggcatgagaacagactaatacaatcagtgtcaatgtttattattaataacataattatggacaacgtaaagtgctagtaattacaacagattagagagctgctattttacctcaggtggtattatttggagtctggtatatatcagatttagggtgattaccttaaaaccttagaagaaatgatattaactaaatgttattttctacttagtctgttacttcctgcagaataatagtttatgctcttacttagtaaatgtcacagtaggggagaaaatataagagcatgcccatatacccacacagtctcctttggtgtaactaccacatcacagtatcttagtgctacctgaatgccaatagctaagttttg

SEQ ID NO: 6766 - DNA, 1229 bp, artificial
  synthetic oligonucleotide
tatgtagttatataagccaacagtttttccctcctgcttcctgagattcagatcagacaataaggatttggttcctaccagagatgtttaagggaggggagtagacacagcatcagactgactccaagtgttgcttctcccataacttgtcatcttctacaatatttaagatcttttacattacacaatcatcatcattgttgtcattgccactatcattatcatcattattattatctgtatttgtataacactctgcactttgcaaagtgctcttatcttcagaggtcgatttgcaatgaagctaatgaggcataagccttacaaaccccctccaaacctcctagagtagctttagcaatgcttttatctgactatatgtttttgtaaagctttccgaagatattttaactaaacttaacttagacactttttctcttgtctggtagcattggagtgaccatgaaaattttagggctttagttaagtaaaatttgagttggtgaaatatttaatttgggtttagtaggacattttcagtgcacagtcacctctgtatatagttagattatgctagccaccccagtatcaaatgacttccaagaaatcatcctgccacccactgtgctgactaaaccaagggccagaggccacagaaccagaagtcatttcaggataataacatgtccttaagtgattggcaacagaagtagaagtgaatgtaagagaaataagctttgaaatatagagagctaaaatcagtctgtgaaaaaatactttatatctaaaagaaaattgagagaaaactgatttttaaaatgggtaggtgttccccaaatttgacagcaattctcaaactttacatgacattagcaataacaattataaacctgaagaaaattcctaaacttattaataaaaaacaaatctcaatcaaccatgctagaggaactattgaattccctttccattctgtttatagaaaatattacgaagttgtcatatgaagagaaaaacaaagtatatgcaatacaagtataagttataaaagttattattgaagtatgtcaggcagttaattcatgaaaatatgtagggttttttttctggattttgtgatgtttgtggcatttatcatcttttaaaatgtgttacatataccagtttattttctcatcctaaaaataatcaattttatacttaattttgtatttgtaatcttgcattct

SEQ ID NO: 6767 - DNA, 1199 bp, artificial
  synthetic oligonucleotide
ttgaccatagtgatagtttcacatctgtgaatattctagaaaacaaagaattgtatacttttaatggatagattatgtggcatatacattttatctcaataaagctgtttttcttaaaaaaaaaaaaacccttgaaattaattgcctgacacagaacagattttcagaaataaataatggatatattacaaatgattctaaagtattaattgccatttgtactttgaagtttgtaattagtaacactttattaggcaattttaatttaatatttatttgaaatcaatacaactgaattcattttaaattgttatagaagatacatatttaggattactgtcaacgtatctgtgtataaaagaccttaagggtcacttttcattctacagaacaagaaactggtcccaaaatggatatgtgataggtacactagtatatagttagtagcagaagttccatcaccaaaaagctcagagatatgttttgtgatcaaaggtactaattatatgagcctaaggtaataatctccctttttgtatgtgtgactgcatgtaacttttaaaataaacagctttatcagagtataattgacatataataaatcacacaatttaaagtatgcaatttgtaagggcggattgatatatgtgtacacctgtgaaaccatcacccacaatgaagataacatattaatcacccccatgtttcctggtgcccctttgaaatccctccctcccgcccttctccaacaacagggatcttctatcactataaatcagtctgccttgtctagaattttatataagcagaatcatacaataggcacttgttttgctctggattatttcatgtagcacaattattttgagatttctcccatcttgttatatgtgtcaatagttcataccatttttattgccaaatagtattccattacgtgattatacaaaaattactcttctattcacctgttgatggacgacatttgggttgtttccagttaggactattatgaagaaatctgctaggaacattcatatacatatctttgtatgcacatatattttcttttctcttgcctgaatagctagacatggtgtgcttgaattatatagtagacataaatttaatttttagtttattctttaaataaaatttaaatcatttttaaacaaacttttttagaataatttttgatt

SEQ ID NO: 6768 - DNA, 4610 bp, artificial
  synthetic oligonucleotide
ctgaatatggtttgttcccagccaaaaaaactcacgggaaggaatgggaatacattttaattttttagcattaaaagttgctgttttactttctggaagtttcttagcttgaaaaaccgtgattttgcgctctgaggtgatccacttggtgatatctgcttaagcagtcactacctactcttaggctatgactgggttccatttctttttataaatcctgttatttctgttaggagggcttgagggctgaaagggggaagggggaactggatagctcaggggcctagctaatgccatctgatctctcttaccccgaggcttttttgcatttggctcctcttcacacaatctcaaaatatgcaccgcaccggcccttcaacagtcatcaacaagtggactctggagtcagactgcctgagttggaagccaggctcttccaattactagctgtgaggctttaggcaagttgcttcatctctctgtgcctcaatttccttgactaaacacttgggggcaataatttaaaacctagaataattgtcaacaaaattaaatgagataatacatgcaaagcacttagtctggtgcatacagtaagctcttaatcaattttagctattaaaatataccaacaattaaaagttccaaagggctaatggccttaagataacagaatggattggagaagaaggggatggtacaaatatgggacgtgtaatgttggcagagagatcgtttcagggtaaaacagtatctgagaaattccttgaccatggacagattagggttattttcataaagtttgaagtcaggaaagagagagagaaataagaacatgttggaaggaggcagggagatgatggttaatagggtgaaaggaaaagaagtcccgaagttggaaaacaaatgccctatttcaaggctgtgctcgggtcacagccccatgcctggaggccatctatttgccttctcttctgctagaggagctgaccttccccaagctggccacaaaaatccccataatgccagcttacaaggtaaagtttccatgctcttccatgccttctttctcccttgaaaataacaataaatttaaaaatctgtaagttccctgtcaagttctggtcaaacacgtagtttcccctccccgcacctggggaggggggcggtcccaagagccatgtggctaatccctatggagtctccaagtggctagcctcccacagagccttgcaactagtgagcccaatgatctagcctggattgttttcctggcctggacttgccctttagacaggctaaaacggtctttgccattaggggccacggggcattttcccccacaccccacgttcagcaaatcgtattgttaaaaaaaaaaaaaaagttttgacttatgaacagctcttccctttagcaaagattctcttcagagttcctttaaatgttgtattttttgactccgtgtcttatttctaaaaactaaatgtgtatgtaaaagtgtaattttctgttaactagttcacctgcccttctctagttaagaaatgttaatttcagactcacatttaggaagattcagtagagttttactgatcatccaggaattcttaaagtgtgttttaaaacggtttattttgtgtggtaaaattgtcaagatttgaattattggaaagtgtaatagctgaaagtgtaatttcaaatatgtatcatatttgaattatcgagaaaattcgatccagcacacccgggtttgtttttgggggaaggtagtggttggttttctctgcaaccgttaacagagaattttctttatttagcgagacccggttcctcacacaggctgtggccattacacagctcactgagacttgaaagttaaggaatgtaaagaggtcaaactctggcattgaaacagacaggaaataaacaaaatctaccaatatgtaaagatattacagaaattagaagaatgagtcagaaatggagagctctaggtcagtgggaagaattattcgtataaatcttcttagaagaggtaggtaattattaatcaaaaaataaagaaagaaacaggaaacaagtccccccacatcgctttccgaccccggagttagggtgcgcagaatgccgtctgggagctccagagaaagtaagcagtgtcgggacatttactaaagtgctctctgcagagcatgagtttagaatgcggttagtttatgcaccgactccccttcccaggaatgtttcaaggggctctttctcaaagctgaatcacgtttgtgagattcttttaagccatatgtcagtcccccagcgctttaaaggaaaacggaagcaaacaacttgggcacttggaaaagttttgcaatgaatgagcgaatgaatgaaacccggccggaacgctggaggctggaagggatgcaggaattttctccgcgcgctgcgaatacggcatatgcaaaacttaggacccagggcaggccgggctttggagacgagtcagtcttactcaaccctgcgcacctgagaacaggtgctgttctgagtgaacgactgggacctggcacgaactagcctggggccagaggagataaggcctgccgggagaagagttcccagcggctctgtccattctgctcttgccctcggctaatggctttgaaggccaagctgtgacagccccggggcgtactcggtgccttcctctgttcaaataggtgctcgcctaggactgattcccaacccatggcaagtcatttccttctgtaactcggtaggtctttgcaagaaatggagcgataaaatcagagggacagaaagagaaaacagccaactagaaaagtcagaagtgtttcttgggaagtctagggcgcgggttgtttggactgtggcagggctgtggggcccagactgggagcggcgcggagcgagaccggttttccggggctggcagctgcctggaaaaagtttcctgtggaacactcgccagcgggggcgggggcaggggcggctggcgcagcagtggacgtgggagggggcaggagggccgggggaggccgcgaagggcctgctcgcaaaccgttatagtccttcagcacctccctcggccggtggccctcctagcctgcctccccgccgggcggctgcccacctggcgacgtgacgctgcaccaatccctttcgagctgctcccgggtcccctctccttgcaccgcccccctccccaccctgaaagaggcgcaccctgacggggcagacacagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttca

SEQ ID NO: 6769 - DNA, 1234 bp, artificial
  synthetic oligonucleotide
tggatgtggacaagcagatagtctttacaggatactcaaagctgatgactaaatttctactcagactcctggaagccatgagaaggtagagaagtacttactgtcaacctcttcactctcttcttgtgggcaggggcccatctctgaggcaagggtgtttttcctgttttattgcttctactgggagccctggaaaagagggaaacaacaaaggatcaatgaaagttagtgctttgcttgtacatgattggtttctgattggtaggaattttaaaaatcaacacattaaaaaacaatttgtgtattttctaatgaatgtatttctgaaaacatgagtgaatattaaaatatgtaaaacttaggggaccctcatttgttccctgcctgagaacagagatcccagagtctgggctgaataaattacatgtaggtctaagtggctatagcttggaaggttagagggtggcagaggcagagagttaagcaggtggatggaaacagtaggggtttgcaggtgaggaggtaaatacaaggtgtgctatttaagtaaaattgttcttatattgttctcatcagatgagcatgcaggtttgaacagaaattacagctttaagactttcctggtggttaacctctacaagaattttgcaagcagctgaattcctcccacctttccacaaaacaaagtgtttcaatgacagtagaaaaccagttacaaagcttggggtggatgcctaagaattcgttagtctttagttcatgaatttctttaagggcaggaacctggactgtttcatttcaaatctactcttagaatacctagtaaagtgcattgtacatattaggcagcagggcataagggataaatggcaagcagaaatttcaatgcagactgttttgtatattttctgttgcccacactcatatactccttttattagtagtattatcattctacaagtagatgttatgagaaacattggctatgtccaaaaaatctatcttaatcacctttgtgatctctttgggactagcacaataccttatacatatgggtacttgacacaatttcttctggaactaaaacgatatgtgcaaaaatgaccccgacccctcggaatgactatttttacaggggctctctgcagatgtgccttgatggaaaggactgagtaatgacaccctgttaagccaatgctggagacaggttggcctttcaaaattataccaccta

SEQ ID NO: 6770 - DNA, 4766 bp, artificial
  synthetic oligonucleotide
ttgatatttgttaaagattagggaaatgtactgtacaaatcatacaaatctctctctgtcgaagaagatgagattgccacttgtaccactcagctttcactggccacacaggtgtcatactatgtgccaaactacgaatggtggccttttcagtgattaccaaatgctttcttcagaatagctagatgtgggtatataaatcagcttgtacttttctttcttataatatcttattttacattgactgagtgttgtttccatttagtctcagtagtatttggtcctgacagtcctgagcaaccagaataaggattctggttggcgttccagtctatatttcctggtggaatatttagattccagaacatttacagtcacacagtgctactgcctcaggctgtgatagttgagaaaattctccagcatttcattgaaattgagctaatgtcaagaagtaagcctgttttttttttcctctggagtcaattcaacttacctttgtgccctctttactcctttcagctacctcagcgcccatttcatcttcttttctctacctccccatcatttaaatgacctgttagcatcctgttctctcaaggcactgctttctgataggaaagtaaaaatggaatgtaaactgggtataagtgattgataaccatctaatgtgtgactccagagcatggcatatttgctgtccttagtacctaaaatccaaaagtataaatgacaatgcatctttggtattgttggatgagaagtgtaaagtaatgccttctggggtatggggagggttgctttgctttcccctctccaaagcagatcctataggttcccatgttcttgtatgctctatctgcaaaatgtccacccatcaagttttatgagcttgaactatcttagcattttgtttcaaggccaatgagaggaatttcaagaaatagaaataatggtaacataattgttgaaaattcctggtatcccttggaatattaaagaggggctgggataaagctaggacacctgtggagatcatgttgcttcttgcctgtattataatgcccccaaatcagcaaagtacctaagttgggtgaataaaaaattaataatggaaaatgttaaacaataagaagattacatacgacacatatataaaattgaaattatactgaggggatgtggactattcctcatcatctcctgattatttctgttttggaaacatacttagattatgttaaattgagcagcagcaactaatatttcatattagtattgatgcatggatttggttaggatacatgcctgcattgagtagtatcttttttccattgtttctgaatgctcctcaccatgcctttccgggaaaccaactttctatgttttccagtttgtacttcctgggtcaccttcgtttgtttcactttttttttttattccaaaatattaagttacgggaaaaagtattgctgagcaaactcacaggagtgcagagaaggagttttgcacagattacacaaatggcaagcttcttacaaaagataagtgaaggccaggagatttggaactcacaaagggagaaaatagggctggcctgcctgggtcagtaattggagtaatacaactttggtcaagagcagccctaaatagcctccctactaaaacatttctcttttaccggtgtcctttgttgcctggaatattaattttgtatggaaataattgtcatcagtttaactgcagaaatcctccaggttatgataattattatctcataagggatggccttccaaagtgacaattatctgataatatcctctgagttccagataacaaaattctcttcctttggtcttcctttggtgagtcttttccagagaagtaaagagagagaaagaataacttctccttgataggatgccatggggcataggttcccaaaccctgggccacacagcaggaggtgagcggcgagcaagtgagcaagcattaccacctgagctctgactcctgtcagatcagcaacggcattagattcttctaggagtgggaaccctattgtgaactaagcatgcaagggatctaggtggtatatttcttatgagaatccaactcatgcctgctgttctgagatggaacagtttcatccccaaaccaaccccctacccctaggtccatggaaaaattgtcttccacgaaactagtccctggtgccaaaaagtttggggaccactgttgtagtggctctagaaagagagaactggacacttgtaaaccaggaaccccttcagtccctagtttctgggtaggaattcaaacaatacggggacctttataccaaggccagaacatttataataatcatccaaacatcagagtatcataggttaattttgaatagatgtggtttttagtctctatcttttatagaaaagataatctgtgcctggaggagaagcgggataggatcaatagttaagcctgacacccctttcttggcaaagctgtacactagtcaacttgccttaacctggaccatattttcccctatttttgcattctccttgatattgtagatcattttaaatattctcaatgatgcttctttatagtcctacttctatcccttgtagtgtcactctctcataccccatgtctgtctttacctgagtgcattgtggctcaaatctaccccatcccatcaagaggcttattccttcaatattcagaagattccctcagatctcaacatgtgttaagaataaatcacattatttaacctaattcagactaagcccaatttaatatgtgtccaacccttcaagagataatgtgatttttaagggaggcttgctgtttcaaaggaatgagcctctaatgatgaacatttaggtagtgttatgagatataggttggagggggcagttactgacattcctgaaattagactatataggaaaccataaacagctactgttgacatagctcttgtacccaccctatgctccattcctttgtgaacttttcctttccgttaaagaaaacttacctagtctgtgtcctagctcttgacccctgaagatgttgtcagtggactaactgttgcccagatgttaataaatgacaactgcttaatattgtaccaactcccttacaataagtttaaaggacagaaactggagactgattggacatagtaaaagaataaaaagggttaaatatgatcctgatactttgtacttggagctaattctgccttcagttataaaaatgcatcttctattaatttatacccatgtaattgaaaacaaagcttggcctttaaacaattgcctttgtatagccctaataaaatcactctgtggagtttttgtctactactatgaaaggccagtttgtcactttaggtatttctgaggatgcattttgggagagaaaggatggctctatcaagagtcattaatatcaaattatccttacaagaatgacacacttgtaatgttagatgaaattgacactgtggttctccattggggattttttgcactgccaactttctttaatcaaaacacaagaggaaataagtgagacatatttaaacacttatagaaaaaaccaaatttcccaaaccaatgaggtaattaatttatatagcacatattggaataggtttttatttttatgcctgtgtgtatgaaagagagaatgaatgtccagtaatttggcacagtctcaaagtgccatagagttaacatctttgttataatatcaatagctgatatttatttagcatctactacatgtcagatacttttgaggggattttaaaaattatttaaaaaatttttgtgcatacataatagatgtatatatttatgaggtaaatacacttttacttgtaagtttctaattaatcctcacaacaattctttgaagggattcctcctgctacatttcctgtttttcaggtgaagaaaccaagatacagataggctaggtaatttgcccagtcacaaaggtagagctaggtttgaacgcagatgatcttactctagggggtgtattcttaacagttgcactatacctattttttttttctagaactctcagcttccaaaacagatgcttctaagctttctagactactaaatcattgttctttaaatattattgtactaagctagtagtctggttgaatttttcagtctgtaattacatattccaattttataactaaatacctgcaatacaaaaacatagaagtgtgcttgtttcactttcagttaacttttctagatataaattatcaactatacatttcaaatattttgtctagtttattattaatttatcctacttggtgatagtgaaacttgagaatcttatatattgcaacattgcattaaaacgagcttttctttttcttttgaaatacattcttttgtatctatttgtcccttagtgtctactcaacataatatgtgaaagatcactgagaatcccctctggaataaggagtgtgttctttagttacccttctcattctttctaaatttatctatttccctttgcagctctgtgtaaccttcaacccttggaagctctcttcgttattttgcgggaatctgctcccacagtcaaatccagcggatggtaaagatgaatgtcttaatctcctaattacattgacttgacatttttatgttagcaaagaagttttaattcatttggtcagtcctgctgcaccatcctggttggacaat

SEQ ID NO: 6771 - DNA, 1591 bp, artificial
  synthetic oligonucleotide
ttcacaaaatcccaatgacatggatattcttattgttcccattttacagatgaagaaaataaggtacagggtttaagtgccttgtccaagatcaccaaacactaagtagcagggccaggattgtaatgtaactttagtgaaacacaactccatgttaacaatgaatttttgtaccagagattctgctctgggcttcaaaaattgcttacacaaaagcaaagtgtgaactataccaggaataaacaaacttccatgcaaatgggtctaatcagaaaaaattagaatgtttgtaatacacatgcttttctaaacataaatatttatttcaatatggaagtacaacatctgcaacagtacttatgcattttttttactattttcctgtcactgaagtgttttacctcagggctagaatttcagatactacatcattaccactcactgtgccatttatactcaagctttaaatacatagtgtctgaaataaaatctagtttggtaggtggtaatgagttggcatgtacaggtagagggaaggttgttgaaggatctggggatacaaaagtaccaatattcagtgaaattagagccaaaaaggagattcctacttaaacaagtgggacaggggtgctatatatggaaaggagtctgattgggatacagaaaaagagggtctatgagatatgacatgaatgaattactttctttctccactcccagcttatacattggcaaggtggaagtatgttttcttggggggaaggtggggttggacaggcaagtttatctcttgctgtattgtcccatgcttgttcagtaacttgttcagttgtctcagtctgtaactcatccccatagtgggagttcctttattcaacctaccagtgtcagatctggcaagaactcagagaatcctactaatgggacagtgggaagggggttgagaagttcacatataagacaatgcatctgcattgttttatgtccattgatcttattggagtactgggatacgaagacctgacctgctttttagctattccccagaagacagaaaagggaaaatttttcaacccagtcaaatttattagagcaaatgagttgaggggtattctgacaaagagaaatatacaaacatagagccttcctatgctttggataataatgaattactcattgacattctgaatgctctgccataggattggcctcttccacagccaacaaagttcagccagggttcaatcttcatcccatcataagggaatgcaagtccaagctcacatcaatcacaccaggctatattatttatttatttcccattgcaatacacacgtgcaattagccaatggcctttttcccaactacgcttccgttgggttcacaactttccctagaaagagaatactccttgtgcttctctccaaaatcaacaacatgaaagatctatcaatttggataatagggtgtaggaaagtgttttcaggctgatccgaaagttcaacttcagggacagctgcagcttcagttcccttttcaccaatgtgcagcacagccttatgggcagcctgtgtggggagaacaaatcctg

SEQ ID NO: 6772 - DNA, 1199 bp, artificial
  synthetic oligonucleotide
cagggccagaagaattaaaatttcagggaattgcttatccacaaaataatgtattaattcattgcagtacaaataaggatgtagaggggctttttaatagagcttgaccagtcggatcttgaaatcgtttttagaaataagttgccaaagtaggcaagaaaaatatgtaaaagatgttctttactgagtctttattatatggtaaaggcatttctacctttgtttttcccagaaaatcacacactcttgtagtttgaatgtaaattaaacagacacatgttgccattccgctttcaactgctttaaaaatgatgatcttttcgctttaagggaattgcagtttaacttggtgatcctcttccctttgagggaaaggtccccttgctattcccatcactgggagggggcggagcctcgtcggagccgctcggaagggagctgtacccggccagtattgggggaggggcagcatttcaagaggctgcagctgacaagaagcttcaaggtaatggctgtcttaaagccagttattttctgggaatttcttcgggccttggtgttaaagtaaaaaaaaggaaagaaaagaaatagagattgttgcctgagagaggtgggaatggaatggttttgtttgaactgctgttattggaacggaattaatcctctgaatttttgtttcgcccgatatttttaaagtcctccgtgtgggaatgggcgatcaaattacagtttctaaattaagacttcggtgagacgtgctgttcgtgttaattttttacgtggcactacatatttctatctttgttacagattttattatattttgacttaaacacattattctacacaaaaaatgatagaaaaatgtaaacacacaaagagaatgacatatagggacacaaatataaatgtacatgaacatggaaagggattcagatatgccgtcgagtggtaacacttgtaaagatgtatattcgttttccttaggaagggaactagactcccgagttaacagtcagcatctctgagtgttcatctctgagtgttcagattatggaagtttttttaaaatctatttttcactacttccagcatttttagaattgtttctatttgtgcttgttttcataataagaagagcaaaataaagccaaaacagtatacccattttgtttcaaatacataaacacacatagaca

SEQ ID NO: 6773 - DNA, 890 bp, artificial
  synthetic oligonucleotide
agtcttgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcggtaagtgtttggaaagaacggcagagggttttaaaaaaaatagttttcaggagcttgcgtgaacgggaaaggaaatgaaaatgcttttgtattgttaattacaagccaggagtggtaggtagaca

SEQ ID NO: 6774 - DNA, 977 bp, artificial
  synthetic oligonucleotide
ggggaaagatttacttgttgcacctagaaacaacatgccttaaaagaaaaacaaaacagatttcttactggtgatatcaggacctttgacagaacagtggaagagtgaattccaggagatgatgtttcagagtgtccctcatcacatcatgcaagcaacaacctgttccacctatgctcaggacatgctttgagcacacaaatattcaacagtatagtaatgttaatagtcatgtaaatatttaacaatatagtaatgttaactgtaactttttagagttttagatgtatatcatatttttgcctaaatttttaatgacatatattctcagcatgacctagctaatgacctcaatatgcaatgatagtaacacaatgtagttaagtgaattcgtctctagcaataatcaatacattgacatctcccccgtggaaagaacaaagagaaatgaaaatttccttaataattcacttgctttccatttatattttaaatgactgtctcagcatcatttctcatgataaattggaactctttatttctttcagtaatgtacctgttaaagtatctgtttttccttcccctttatgaaggcagttgttaattgtaagtactctgttaactatgtgccgagcattcttctcagtgtaatcatcccaacaactgctatgaggtacatagtgtcagtatctccattttatatataagaaaactgagacacagagagattggttaaattcgccatggtcatacagctagtacgtttcaaagctgagatttgaaacctaatatcctaataattaagagtctgtgctcttaatcagtacacaatactacctctccagtgagcatatactatggaaggcactgtaaaaaatggtacaaaaatatcatcattgccctcaaggagggaaatgtagtcaggggactaatatttacgcaagtcataaaaggcagactagaaatgttaaggttat

SEQ ID NO: 6775 - DNA, 1901 bp, artificial
  synthetic oligonucleotide
tatgtttgcggactttatcgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgcagctactagattgcacccctccagacctctgccatggccagtttctcttattttcctcattgccctcctcgtcctatccccttgctccgaaggaaagtgggtgctctttctgtccccacggagtggggcagggtcctccccgagattcaccaggcctgggtgttgggcaaaaaaaaatccttcatttgcctctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtc

SEQ ID NO: 6776 - DNA, 1826 bp, artificial
  synthetic oligonucleotide
aattccagaaactttgttttctacagtttaatgccttcggctgtaaaatgataaaaagaagcaacacctttacacctgggactcacttatttgaaccaaaaaaatgctttaaacttcagataggcaaaacacacttaactgatggctgggacccgctttgaaagcacccccacccattctcaccccagtgtattgtgggaagggtagtcccatgttccagtcgcttgagcacagaaaagcgcgtaggaaactacaactcccaagaggtaaagaagcgggactatttcccagtctggcggtagcgctgtgggagggaattggcaatctctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttt

SEQ ID NO: 6777 - DNA, 2511 bp, artificial
  synthetic oligonucleotide
tctcttttccctattattaatattttcacaaatagttgttatttggtcttaaaatctatgtttgtatacatgtatgcatgcatgtgtgtgcataatacatacacatactcgcgctcatactggacgtcttagatccggcttaggttctttaaggtaatgcttatggccaaaatcacaaatatccaaaattacaaattggaaactcattaaatcacctggaaagtacagtaagcacagcacaggtatatcacgttctgcaccgtgccaaccatgagagaacaatacatttcgctttcccatcccccactatgtaaatcactactttttgctcccttgtagtctttcttgtaaattacatacttaacttggattgtattccattctgcagaggttcagtgcacagccccaaggcacagtaccaaacctcaaagatacagtccctctgctctagggttccaaacgtatcaattccactttttgcctttcaccttctaattaaattacacatattgtaaagcattccgtgttatggttaatcatcaaaggtctctatcattcttatcacccttccaagtaagtcccctgctacccattgacttcttacccaagataactctcatggcatggccacagcgactgcttaagtagagaccggggttcatttggggagctttgaaaacattttcaagagtttgttctgtgcaaccttgcccataaacacttcttccttctttcgattttcaaagcatgtataatgcgccctgtatgctgctgcgttttgtgcaggactgcgtttcttctttgctttccacacagtagcacactactgcaaaaactggtgtaattggcttgaagggatcaactgaaaacactttaaaagcaaacaccggtggagcgagaggttaagtcctcaatattcattccagcggtgtgagggcgctcgtggaccacggacccagccctccgcagtagcagggagccaaatgcactcgtgtcatctcttaagagatgtcccatcattcctaacttttcttgtctcaaaagttaaggaactccgctttccagacctttccccaggacccgcctcggtcctctacgcccctttgctagctaggcatcctccgtcggtcgccagcccctgcggacccagctgcctcagggcccgaggtttttatgcatctccttttgattactaactaagctatcctaaagtgcccgaacgtcacgagcgcgagagaaaaaccacactggtgtctttaacgcttcagacacacctcgtttcctccgttttatgagcggaacctagttcctggcgagagagccatccccctcctccgcctgcggagccggggccggttccgaggcccccaccccagccccggcccgccccgcgcggctctgcgcattcctctcgcgtccgcggcaccacgctggcaccactgcctcgggcgaacacggccgggcccgccctcgccactcacctagcagctccgcgatggcactgaagggtcgcgtgtggctgctggagttgctctggaggtagcgggggctcatctgggggcgagagaaggtcccgacccgcgtgaggcctcggcccgccgggccctccccgcgcgccccccgcagcccaggggcccgcgcgcgcgtccgccccctcgggccccggacctaccgtgctcaggcggatcccgaaggcctgcgggccgccgccgggccgggccagcccgcagcccggcgcgccagggccggcgggggcccctcggtacaggagcatttttttggccgccacggtacccgtctgctgccgccggacccctggcccggcggtccgggactagccctcgctcacttccactcgcagctggcggcgaccgtccgggaccggccctccctcgctcccactcgcagctggcggaggcggagcgcgctccagccacctgtcccgggcgggaggggtgaggccggctgaggcaagcggcggctccgccctgtcagcacctctaccgacccggcgactgcccgggctgcctctgggccgtacagaaatatggcgacctcctgacagccgctccttgatccccgcccctaattaattattggcgtatgccataggccaggccgccgagcgggaaagcgcggggggcgggggtggcgcgtggggaggggcgtgaatgaagcaagaggagggagagcatgtatgggatttctggaacctagtcccgcttaggctgcatgactaacaggcaagataagacaagtctttcaagttctaaagactacagtgttgctatctgggaagatagcaagctcgcctgatgggaaaacattctacctactctgcctcaaatgcctccagaagcacccagaactttctggaaggcaattagcaaactatctccaaagtcttgctagcatgcagggacggtgtttctaaaaggagaaattggattcacttaaataccgccaagtaggggattggtcgagttatgaagtatgcataaaatgaaatac

SEQ ID NO: 6778 - DNA, 1038 bp, artificial
  synthetic oligonucleotide
gcttagaagataagtaatgatacccaagttgctgtcctctacttaatccagttgacctgttctgagtctcatttttcttaagatgtaccttctccttagaaaccagttagagcaaaggtggtaatgatccataatggtttagcatgacctactgtgctagactgcaccgtttaatttccacaacaacctgatgagataaattctattcttcctgcttatcagatgagtacactgaggctagaggggcaaagtaaattgaacaagtcaaataaaggcactgggatttgagtccaggcttgtcatatgataccattatttcaatgacttatccaacccaaaaaactacatacacttacagatttataattctgtttcaaaattaaagattcaggtaataacaatgaaaatgtcagagtaagaatctccaagagcccatctctccacagaaagagtgaataaatgggcaaaagctatcattaactttattggagctctggaaactaatcaaaggtgtatagcaaccaggccaaggtttaatcaagatgaaggtggctgaatattgaaaggagagctttgtggcatttttattcactaactaacctaaccactaagctaacttaactgagactttaatcgccataaacaataaagaatatagactttacaaaattagtttagaagtcactaaacaaacaagagcaaccacaacaagcagcaacaacaagccatggaaataagagacaacatgatttccaaagctgccacatcataatatttaaaatgtacagttttcaacaaaaaatttcaaggcatgcaaagaaacaagacagtagagcccatacacaagaaaaaaattagtagaaacttcctgtggaatccccaacattgaacttactagaaaaaaacttttaagtcaactctcttaaatatattcaaatagataaaataatataaaaatcaaagaaaccatgataatgatgtctagcaaatagacaatatgaataaaagacagaaattataaaaaggaacaaaatagga

SEQ ID NO: 6779 - DNA, 697 bp, artificial
  synthetic oligonucleotide
ccctcccaaattcatatgttgaagcttcaattcctagtgcctcagaatacaactaatagggcctttaaagaagtaattaagttaaaatggggtcaccaggatgggaccaaaatcaatatgactagtgtccttatgagaggagattaagacacagacagagagagacaacaagatacagacatgcacagagatgaccatgtgaagacacggagagaaggtggctatctgcaagccaaggagagaggtctcagaagaaaccaaccctgcagataccttgatctttgacttctaacctgcagaactatgaaaaggtacatttctgctgtttaagccactcagcctgtgatattttgttatggcagccccagaaaacttttgtgtatatatacacaaaaagtttgtggagcttgcagtaagatgagaaagaacccacatgtaacactttactactgctgatagtatctgggaggatgtatagatatagactttctccagaaagacttttctatcaccaatcagaattaaaatacaaagctcaaagaatattaaaagtcccttgacttttctaaaacttcaggtcctactacacacttagggcatctagaaacagcatgggatctttatctctgtagtttatctgctctcccacatacccctgggcctttttctagcctgcttctcagccccagattcctgg

SEQ ID NO: 6780 - DNA, 706 bp, artificial
  synthetic oligonucleotide
accatttaaccttcccaccagcagtatatgtgagggttccaatttcttcacactctagccaacacttgttattttctgtttttgtttttgtttttgtttttttcataatagccaccttaatgggtgcgaagtggtacattgtgtggttttgacttgcatttctctaatgatcagtgatgttgaacatcttttcatgtgctcattgcccatttatatatcttctttggagaaatatctattaaaatcccttccccgttttttaattgagttgctttttttgttgttgagttgtaaaagttctttatatattctgaatatcaattctttatcaggcatatgatttgcaaatattttctcccattccatgggctgccttttcactgtgaatagtgtcctttgatacacaaaagtttttaattttgatgacgttaggattttttttaagggttaatagttggagaaggggttggactcagcatgaagtttgaggtgagaaggctgatattcaaaggaggacagtacagcaacaagcctgaaaaggatgccatgaacaggaatccttgataatccaaggatggcataaggcctctggaaaccctaggtaagaaagggcaaaagatgggagaattatgatacagagcatttgctgagacctcactaggtaccaagtattgtgctaagcccaacacatctgctatttcattta

SEQ ID NO: 6781 - DNA, 4778 bp, artificial
  synthetic oligonucleotide
cacctaatcgctatcctaaaccagacagtgcctcactggtcacccaggagccctcagatgtgcatttgtccagtgacacagttcctctcaatactctttcctgcttcaccaccccttctttattttgtttaccacaaagcagcttgaatggagcctgagcatgtgctttgagtgagcccagaaagcagcagaggagggccaatcagattcgtgagaggcatttattttagttcttaacccatgagctttattgtaataactgatacaaaccaatttgttgggacctgtgttattaatattaataaagactgaactaggtgaggctcaggagaccctggaggggatcccacctcctgagacaccaccccaagaaaatctgccagggacagtctggctggaaatattattattcatactggacagctggttcctggctccctctccagtccctggagatgggaggccaattcttccctgtttctcttcatctctttccttcagaaggattagaaataaagtctgagtcacttttctggctagccttttttttttttttttgcactagctcagtgtgtctgtggccccacatgtgactgactccatgtgtgtccctttgtgtgtgctgtgttcctcagagcatcttctcaggttgggctctgcctgtgcatttgcagggaatgttgtgtgtttctctccctgcatgtcttcactttcacttgtcatccgcttttaataattccatcagcttggtttaccagcttaggctactcccatccagatgcagggaatttccatccttttttcaaggtgggaagtgccaggaagaaagcaaaagtgtgctcagtggaccgatggccaaatctgctagtcagctactccactgctgagcccagctgtgggaagccacggagccctgtgcccggagctctcctctgtatcctggaaattccgtgcagcctaggagaacagcccttgtcccacaattgcccctcagtagccctccggcctcttctgaagctttaaccaagtgcttgaaaagaaccgaaagtgaggaaatattccaactagaatggatccctttgtgccaacagcctcctttagagttcaggaacacagaggaaatcgaggagggctgacttttcaccttagaactcacaaggcccaaatgtgccaatgtttaactgtctctccgaggtgcttctgacacccggaaattcaccatgtatttggcatcaccaggagctcctcaactccactgcttcctcctgcttctctcttccctggccttaacttcaccacccagacccactgtccagcttcccagtctctctgggtccccactgaggctgccctttttggggaaggaagagtggccttttttcttggccctcaaaactcctctgaaggggtctggagcccgctgggagaccaagagcttctcttgaatctcggctgctgcatgtttagtattcacagcatgtctctaaaaaacgtcctgagatcattcatcaggcactgtgctgtgtgcctagctgctctccttccgggtgtgtgtgtgtggccaggaccctccctccatctgctggtgaacacacatgcacacacaccttaacctttttcccttttcaccaaaccaatcgcattttctaagcagacctttgccagctggcagatcgctcccttactgaggtgggctcctggcgttgggcctgggctcgaagccgctcacactccagtgctggggagaggcgctgagagcaggagcccgagccgaaactcaaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagcgtgcccaactctggtagtcataccctccacgctcgagctgttgggtttcctgcacacacacaccacagccccatacacacacactgaaaccactgcaggggcaaatgtttgacaccttcccccagaagcaggtggcacctccacccttgcagctgcaactaaagagccccagatgacagcaaacgccgaattctgctagacctgcccctccccttggcatcttggtccaggtgcaaaaccctggagtccaccgggtggtcttagcatcctgcagctcttacggagggcggggcagtctctggactcctgccttcggaggaactgctataagcgcaaggctcccttgggggcgcccttctcgaagtggagggtgggggattctatgctgactcagagcgaagcaccaagtgagttttcccagctggagaccggggtaaatggcgaactccacctgggcctagaggacccgggatagtgtgccagttcagccacagaggccctcagcttggaggccctgcccctccctcgccttccttgcccatgaagctcactgcaggagaagcagggggaacccagctgccagcttcttgggagctaagagaggcttttcgggaagcctttgctgtttccgctgagcaaagagatcttgctctacccggggagacctcaacaagacttggccgtgcccaagcaaacatgccagcgtctacccaatttcatggcttgtttttttgtttgtttgtttttgtatttcatgtgaaaggactaattcaaccttagcagcttgtcatgaaggcacccctgaggttaaataaggcataatgtattgtggatgggggaaacaaggttgaggggagcaaggactagtgggttttactgttttaagtagagatgcggagttagaatgtagaccgtggtaaaatcgtgacggcgatggcttctacgtcagagccccttccctgctcctgcccctcccgtcggctgctcagggctcctctgggtcctctcccccgcccccttagattatttaggcggggctttgctcactgctcgggcaaatttgatgacagaatccctgccaggccaaggtgttaatagctgatagaggtttactgcttacacctcacaggtaacatttg

SEQ ID NO: 6782 - DNA, 1223 bp, artificial
  synthetic oligonucleotide
gctagatttttacccctttaggaagcccctggaaacgttaattcatcctggtggccagaatcagcttttcctaatattttggcattaactggcaagaatccacagttgccccctttgcccatcatattaaagggaaatctctcatctgggtctttgcagaccacctgccagttcatttgccttctctgtttctcactaaagtatttctcctgatttcaccaactaatgccttcactttaaccaagccagccaatgtaccatctcctcaaaaactgaatttcagttatctgctgtctgccaccacccccacaacctcagctccaggcgcagctcagggtagtccttcttccataaatactgtccctatttttctccaccactgaggtttgtgacccccagcaacatgatctgccattgacctcacactcagtgtgcaatcttctggatgcttgtgtaattattttgttttaaaatattaatatgtacttgctattatatgatcatatcaaagtgttccccagctatttcccatttgggttttataaaaagcattagacagagcatgtactctggagtcagccttaccattttgtgtatttcatatttgaatacacatttttaacatttctgaaactggaatacttctatgatccatggttcattgtagtttaattggcagcatttcttctttgttagggaaatctgagaaaatgttgcctcttacagttgatagcatcttagagtcaatgaaatgcagtactaagttacttaacctctctgagacccagttcctttatctgcaaaatacctatttcaggaggctattgttgcgagaactcaaagataatatttctatagcactcagcacagggctaagtgctatacttcccactttggtagaggctcaataaatgttagcaattgtaatccccccactatattaactgtaaaccccacaagggcaggaacatgttgtttcctcttctagcagatggtctgatatgaaggatggaaaatggttcccattctaaaaatgtctccttgctggactgccaaacagacaaaatttcaatattaatcactcctttgagttaaggcattatctccagaagacctctgttaaaatgcaaatatgtcacttgggaaggtaacacattaattcattagcatttctgatcccattagtgcagattagtttatcagattaactagctgtcaccaag

SEQ ID NO: 6783 - DNA, 765 bp, artificial
  synthetic oligonucleotide
ggcaggtccaactgggaatagatactggtcaggcagccatgctttgtagagtccagcaatagtctctgctgcctctgaagaatagaagctgctcgttttccccgtgcctgcttcagcatcacccttcacctccaggactactgacagttcagtcaacctcccagaggtgggtgtcaatcccaaagaatatgattggctaattgggaaagccaaagatctggttgtggcaagatgcgagacttatgaagggaagggaaccccagattctgtttgttctgtatcagaaatgtctgtttcctggttcttctgaactctcttggaaagaaccgcataccctgaaagaatgttccaatttagtcacgccagtgggctaggccaaccaagtaacttggtaagggggaaggaaaggggaaggcacacgaatgaagtgagcttcttgtgcatggagcttgggttcctctgctggtgagacagttcctcaggaaactgatttaggactgggcgagtctttgcagggactgcaaagactgcaggactgtgcctgtcaggattttcttttcgggagaaggggtggctctggggaaaagattgaggccaaggaaagagttcccaaacaagcatgtcccagctactgagaaggatcctggaccaaattatgtttcagttctattcagatgtagcaacagtttcaattttattcaaccacgttagaaaatatgcaggtttcttcctgggtttaattggcttcctaggttttaaaaagca

SEQ ID NO: 6784 - DNA, 3410 bp, artificial
  synthetic oligonucleotide
cattctggttctgctccagagctgtgcagtgcaactccaggcttgcctgtggttcccaggttccttttctgctctgccatcagttctagcgtttttatatccaaggggcttcaggattacaaactagtgggaaggagaggggaagggaggaggctagtggatttgtctggaaactggttttgtctggcaagaccctatatttccttacagtgtgaatttacttggggtaggagagagtagaaaagagtgcttctggaaatttgggaaattgtcttgaagctatgtttgcatagcaagcatagtactgtaatttagattgtacgtatacttggggtggcttatagggggtgagaagagcaagctaaagaccttcccaaagtctccactagttctgttgtatatctcagccatctgggcagaatacagaacccccagcttccaacaaaataaagcatccagccccatggccaacctctgctgtctgacatgagccctgtgctttctgaaatgggtgtctttggaggcctcaagtggtttctacccagacacctgcagtccttgagttgggtgggctcaagtgggaagaggagattgccattgccaataatcagaaaaccagagccaagtctgccctgctggttccattcacgtccccaaaacaatctccgaggtttaaggccaagtcatcactaactcgtgtgtcatgggcactgctgagggagaacggtatttcacagagcagagactcccacccaggtgcaggctgagtgattcaaggaagatggaatttagtgcaatcaatttgggacagtcagccaggatttcttttaagctttactttccagcagccccctcccaccttggagacagactaatccctgacatttgtctagtggctttatacttttcaaagctccttcacatctattatctccatcgaaccacacaaatactcccatgaagtaggataagaaggtgttattatccctgtttgaccaacaagaaaactgaagtccccaaaggatacatgactcatccagggtcacacagttatgtagtcaaagaactagtgattcaaatgtgtttcctaacttccagccctgtaatttttccacctccatgcagactcccctccatggaaccacaaaggtgccctgcttctagcacagtgcctagcgtaaagtagatgctagtaaatatttgctaaatgaccaggaggcagaggttgcagtgagctgagatcgtgccactacactctagcctggacaatagagacagaccttgtctcaaaataaataaatacctaaataaatatttgctaaatgaatgactgcatgaataagctggggcaaagctgaaagaaatacgagttctaaaagtgctctttttaaaattatcaaactaagaaggggcaggaaatgttgtgttatttcatcattttgaccagaaggaaggcataagatatctttctcatttcacaaatgccattgccaaggcatgaagattggggtagctcccatacagaggccatggagcttaatgtcccaacaaagctgccttccactcatcctttaaaaaggaatgggtggtgtgagtccttactccagtagcaggaaggagtcagaatcagccccatgggacgaggattctctccacgttgtctctgcaagccctgtctctccccatgtcccctaacagtggctccagaagttctgccatggaaggggtgtctgagaacactggttgcctgctcctttaggactgctgcaccgtcaccccctagacacttctagcataacccagacctcgaagactcagtgactgtctcctggaatgccacctggactgagacttcttccttttcttttttctgtctcccatagcgtctggcacatagtaggtccataataaatatgggattaatgaattgtctgaggtaaagagggatggccactccctggctctaggcactgcagtcaggatcctgcctgccagggccccatctccacaggcaaactgacttagagttgccgtttgttcccaatccagtcagaaaaaaatggggaaagtggaggtagggacacaggtattcaaatgctgctttgcaatagcacaaggtagcttttgagacaggtagcccggaatttgagatcctttggggtttaaatcagtcccaccacatattattagtgcttgtactgggggctctttgctttgctcctctgagcctcaattttattttccgtacaatggagaggatgctggaatgagaaaataatggatgtaaagcacagtgcctggcacttagtaagtaagcaagtggcagctggattgtctgcatatctatgtcctcccagcctatcccttcccaggtcccccgagtgggctggtccccggtggcgaggggaggggtcctcctgggggcgccgactgtcccgggcggcggccggattgcgggtgggtgagaggcagcagacgccgtgtttacagctctctcgctagttcgccacctcagccgcggctctagggctgagccagtcgcctccttctttaagattctggtcacagcaggggctgggtttctaaggcaggtttctaaggtgtcttcctacagacaccgctgctgctaccttgctaccttcagcgctgggcacagccaggggcagcgcgagagggaggcaacgagagggttcccgggccgggcagcagcccagccccggcccggaggggggcccgacggtaagtactgcgctctgagcagccgggttggggggcacctgaccattgaggcaggggtctgtggggttagggggtcggcagtcgagcgctagggtccttaccggcccctcaaagtgacttgagggcggcgctggcatgggcccccctccacctggtctttggagtgagttggcgcgtcggaagcagacatccatctccgtccctcaccccgagatcccaaggattcgtttgggttgcctggcagccctccggtcctttcgaggccacgaaagaggaaattggaaggcaagatacgcggggatgaagttttggacgctgttggaaaagtggcggcgcgagcgggaagttttccgctgcggggtgcgggggatcggggagataaggggcgaggggaatcagaagctgggagggaaaccacccgagtggagcaggggcggaggcggcccctctgagtgctaggaccccactctccccgccgttacgcttcggaagtgtccgggacttctagctgcctctcccacccctgcccctcagcgcctctgcttccatggggccgggataccctagctggcctgccctccggtagggcgggttggagcctcagcgttcgcgaagctccgcggggtggagaagcaagaccacccttcgaggtggtgcaccaatcacagaaa

SEQ ID NO: 6785 - DNA, 2318 bp, artificial
  synthetic oligonucleotide
tctgtaaataaagttctgttagaacacagtcatgcctatttgtttagtttacagattatctgtggctatttccacactatgtacaatggcagagttgttgtgacagagcccgtatggcccacagtgcctaaaatatttactcactagccctttatagaaaatgtgtgttgacccctggcctatatgaactacaaaatattcaactcaggctctgtgttggaatcctgggaaaaagaaaaccactgcaactttagctaacagctgagctggtttggaatcagaattgagcccaaggtaatggtgattcagccaaggaaggctaatctagttagtgatcaagttctgtcaggtcttcataatgtcccttccttttcactggaccagccaccaccctagtggaggccctaaccacctctctcctagactgttgcagtagcctcctcattggtcagagaagggcctcatttcctctgcctaattctcctatttcttaatgcctggtctgggtgacccacagccccatggctccctctttagccagtcttcagtgatctttatctggaaaccactgccctattccaaggagaatgttcccaaggctgacttcagtctgactcaaacttggtcaagccatagttaaaattacaatacagatactaggaggttttcttgaaatagtgctgattttcttgaatagcattgcctggtctctgaagcagttaaccagttaaccccaggactaatctgactgatttagagttaggaacagaagtcaacaatgtatgctagtatttcccaaggtgggttaacaacaacaacaaccttgttaccatgagattttctataaaaatagatctttgtggtctaataaattcagaaaacttagaatattaaagcctttcttttgaggtttcccagtgcacaactatatattaaagggtcttatgaattctcatagtaaaactatctgcatagtgttatttaacccaatgtcacaaacatatttgactaaggagctcttttaataagcaccaattaacaatatctcaaggacacagggaaataaaggaaaggggatagagcatgactcttttttttttttttagacgaagtctcactctgtcacccaggttggagtgcaatggcgccatcttggctcactgcaacctccacctccctgattcaagcagttctcctgcctcagcctctggagtagctgggattactggcgcctgccaccacgccaggctaatttttgtatttttagtagagacggggtttcaccatgttggccaggctggtctcgaacccctgacctcagatgatcctcctgcctcggcctcccaaagtgctgggattacaggcatgagccaccgcgccgggccgagcatgacgctctgagcagagctgcaggccagaaagactttggcccaaaaggcagagttacaacttgattccacagagattcctccatgtccagggaggtgttctgggtgttacaggggcatgtgaagatgagcaagacatagctcttgcacccaagggacttagaatcgagggtgttctaggccattctgaagtctaatctaaattcccagctttaccccgctctcccggctggcctgtgtatctgctgagccctggcaaacacaaatacagctacacagcagtcacatgaggttatataattttagtccttttcagcaaaggtggttcattaaatgtataattaaaggttgatttaattttgatacctgggtaagaggttattacaaagaaattctcaaatcagaataaactatttgtcaagccatgtgcctcaatttttggttcagacagtatggttcctttaactatgcaagtcatcttttgctagctaccatgcctctgaaaatgcatctgcctccctccttcccatgtcttcatgtttcttcccttctcttctgcagcctctggtgctgttgatggagtggcctgaagccaccaactttgcctgcctgatcgcggggtactgccgcctcttgctggattccaggaagatggtcttctccaggcctgccagccagccacttccacctccaatgatcaaggcaggtagggctcaacctcggttggtttttgctgtgccagaggccctttggaccctgaagacatggagggaagagcttctctgccttagtgctcaccccgtgccaacagtgcctgatttgccaggagccaacactgtaccactatatcctagctggcacagcccagtgggaaagacagctggccttcacatgtacttgtttcacaaaggatacctgtgacaacattgt

SEQ ID NO: 6786 - DNA, 976 bp, artificial
  synthetic oligonucleotide
agaaagtagagtattgaagtctcctactactgttgttgaattgtgtatttttcccttcaattctgtcagttttttcttcctgtatttgggagttttgttgttaggtgccagtgctgtacttttgtcatagatgtaatctctagtgaaaggcaacactggcatattgactctgtcaaactggagtttgagtggcattttgaaggcttgttttccagcatcttgaccaccatgatgagttataagggtaatggctaaaaacatgggttttgaagtctttcagacctaggcggaaatccagtctaccacttggtctatgtaaccttaggtgagtcagtttctttatccttaaaatgtgaataatgataataactacctcattgggttgttatgaagaataagtaggatcatgtatattaggaccttagcctaagttagtgcttgtttgttatctgtctgtctgctgtccgagtatattctcacagataaaatggggaagagctccaaaaacagtgagagaaggtattcacagataaagcatttgctatagataattctcagatgcacacacctaccatcattaagagcggttgacgagagcatttgccatatgtatgtgtagcaggtagggctggccctgcatgaatgcagaaaagaataaaatttgaagaattataagaatgcttcccctgccctcctcccacatatgcacatcccagcatatctcccatatactttacacattcagaccccggaattctaatatagagccttattcttttaggatccctccatcaacaggcctctttgaaatgcaaactcttcggcattatatgtagcctgtttaacaggttctgactaaagcattagtaacttgtcagatttatttccttctgctagaagagattcaagataacaagaacaacagagcactggtggaaaagctctgaaaaggggtggggacaggggtaggaacagt

SEQ ID NO: 6787 - DNA, 6254 bp, artificial
  synthetic oligonucleotide
ggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggctctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtagcagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaaccctccccccacgccccccacccccgcaaccttcctgggagtgaagacacggagtccctaccaactgtcccactgtagggaacaaagaaagccaatgtttcttctgtatagattgcttctcgtccgcctctccatatctccccatttcccacacccttgtgccctgtgtctgcctctgtttcatcactgtgtcagaggcccatgtgaaatctttcattctgatgtgagttttataaagatgtacactgtgcttaatccctgcccatccttggtagcccctagtgcaataaagtctccctgagtggtgagttctcccggcaaggaggaggggagtttcttctgcagaatccagcccctcacttccttgcttctcctcccccaggaccaagttgttgaatgggccagagatgcagccagtggggaatccttttcccctcagccactgcaagctggagtgctgatatggtcttctttttctcccaacttcgccactcagcccctgcctgtgtcattccaccgccatccttcacctctccctcagcctcatggagaggaaacattttctaatgtctgtatatagtatatatactacataaaatatataaattatatatatactaatttatgtcttgtttttcaaacaagaatgattaaatctattcatcttactatcccaataagtctttgcggtgcctctttgtgggtgtccttgtgtccttgaattgttggttggtggtggccctttgtgtgctcatcctgggcccctgctcttatgtactgggcactggtgggtgatgagagctaaggaccctgttcctcccacctccccaacacacaggggatcccctttgctcctctttgaagcctactgtttctcatgggagttggaaattgtctacctctttctcttgaccacgaggcttctggctcacctggcccccatggctgtgacctcagagctgaagggctggaggtggtgtggggggttgtgtggagaaacacagtgtgctctgtgcctagtgtatcagatggcctgggaattaggattttaggccactcctcagactggggttgggaaatggggcctctccctctgaactgtgccttcttgctctcagagtgcagcctgactgcctcgcagtttaggctatggaatcccttgcaacagcctctggccatgtagtggggtgggaaggagggattgtttccatagtatggaagcattaggaccctaatcagagctaacccttctggctcttcagagttacccaagggtgagaaattattttgtttctcctgtttcctaactttcttctggtacttacagttcttcactagcctgaggcatctttgtccaaattagaaaaaggttcttcctgctgcccatgcccccaccatgacaccctctgtgtgatgggcacatggcttggtaatttcagccctgtccagcccgacttgcctcattggctatgtatacaagctacccaactgtgtacagtgatcctacttagtcacttccaaagattgataacagactcttttttttttttttttgagacaaagtctcgctctgtcacccaggctggagtgcaatggcgtcatctcagctcactgtaacctccgcctccagggttcaagtgattctcctgcctcagcctcccaagtagctgggattacaggtgcccaccaccacgcccagctaatttttttttttttttttttttttttttgcagagacggggtttcaccatgttggtcaggctggtctcgaactcctgacctcaggtgatccacccacctcattctcccaaactgttgggattacaggcgtgagccaccacactcggcctacagactcctttttttccatgtctgcaaaggttatggctaaagaggtttggaagcaaagcattgaagaggagccaggggcagcacagtcaggggcagcacagtcaggctgggattctctgcatgttcctcaacaccaagccaaagctcctctttaaacatgggagggaaccacaggcagcagcccttggactacaggcagagctcttctgggtgctgcctgccaggcatactgtcccacagcactaaggttgggattcagtgcgagtcaatgccatgataaactgaagcccactgccactcaaaatgacccaactggacagtctgaaaactcaggagccctaaggccctgcactaactacactggtagctccttaaggtcagaaaacattcttatttagttttacaccctgggtacccacccacacagtatctggcacatagtagtattcacatatttgtagaataaatgagtgttgaaggagatgactgtca

SEQ ID NO: 6788 - DNA, 380 bp, artificial
  synthetic oligonucleotide
gaccatcacaggcttctagctgtctttcttgcctgagctctcaacacacccttccttgcttcaccccacacatacattcacctgcccatggcctttgttaaagctcttctccctgctctgtatcctcaggttaatatctttggtcttacctcacccattttctgcaagactcttcccagattctttcaatatgatcatgtttctcatgcccccattattaaccttatttctgtaagtatctgtcttgcctgcttcactcaagggaaaagatagtgtagtgttaattctctgtaggcgcaccctccagaggccctggtatataggtactcagcatatttcttttgaatgacagtatatcaaatttacagaactcaccatga

SEQ ID NO: 6789 - DNA, 1706 bp, artificial
  synthetic oligonucleotide
aaaagctccccaggtgattataatttgcagccaattttgagaaccaccctcttgtaccctggccactttcccctttccccttacctgcctaggcaggctctcaggcatttgacccctgctctcctctaaaccccaaagcttggcttccaaggctgtgccagggcggccagccctgcctgcctctccacctcctccctgcccacccctcatcccactgtagttctgggattctgaggccaaaccttcattgcctcccccactttttcccgcctccctagttagcggagcttgttttgttttcttgggcagctttgagtgaggacatgtgtcagaggcgtttggaaaatctaaagaactcacgtccttccctggtgcctcttgtccccactccagtcacccggaactcaccaggagccccaggcagggcgaagcgtcccggtcccgccctcgtctggcggccgcatggaggcccacatgccttacgctccccaagccggggccgcgtggggcgacatgtgctgccggtcacaggggagggtggccagaggcaagtgatgctgatcagcatgggcttggaagccgcctaagaaccaaccacagcgacttttccagtgggatgaggaggacggggaggagaaaaaagtgggcgggggcgggggaggagatcttacaccaaggcttactgggtaatttattattgcgtgagagcgtcttagagcagcagccctgatcaacgtccagacatagcaagtcattccaagtgaaaagaggttacaaccacaaaaagacagaacatttcgttctgagtgggagggagacagctgggcaaggccaatggaaaggccccccagccaggcttgcttttaaagtactgctaccatttcccagctattttaagcataacatcgccaatttttttcccccactgactacctgttttctctgtgaaggcggcttgaatgcagctgtgtgtgtcctctttttctcaggtgcttgcttttttcctagagattggaaaggagttaatgagattctacctagaaggtacggaagaagctgggaaataaagctgacaaatcaaggacttgattgccaaggcgatcctaattgatttagcaccagggacattttcacacttgctctccataactcatctgaggtggaggggaagtaagtgcctttggagagacctgtgggcactttggagagcaaaaaacgctgcctccggtggtgggtcaacctcaggaattccctctcttttcaagaatagctttcccggctgggcatgctggctcacgcctgtaatccctacactttgggaggccgaggcgggtagatcacttgaggtcaggagttcgagaccagcctggccaacgtgcttgaaactccgtctctactaaaaatacaaaaaattagtggggcatagtggtgcatgcctgtaatcccagctactcagaaggctgaggcaggagaatcacttgagcccaggaggcagagattgcagtgagccaagaccctgccactgtactccagcctgagcaacagagccagactccgtctcaaaaaacaaaacaaaacaaaaaagaaaagattagcttcccccttgggttttcagtggttggtgtgaactgtggcacgtggatgcctgcaagagagcaatcgaaggtggcagtgctgggctggactgagggggctgccaggagggc

SEQ ID NO: 6790 - DNA, 1756 bp, artificial
  synthetic oligonucleotide
ttagagcccagaaacaggagacagaacaaggagagagagctggggagttgggagagggggcggctgagaacagctccctcatgaagcacttgccccattttcccatgctccccacccaagcaggctcagcaacagggcacatctgactaggcagaaactgatcagataccgcaggtaggtacttattggaggctccaagctggataggggtatgtatgcccaagactttcacatagccaggagatgggcagtagctgactccctgaggcagacggcacagtgtcagggattttgttaaagtcatggaaactgggaggatagaatcataattctaaggtcaccttagagtaaattatgctggcattctggaaacatctgctgctggtatttctatattattaaagccatttacaaaagcccagcatctttctcaaggagattcttattccacatgtgtcttcccctgattccttttccacatgtgatggcctagagctacttctcaaattaccctgaggtagctgctccagagacatgtttgctgtgccaaggctgagcaggaaatgggtaacccagagcagaggatcagcagcaaaagccatttgtgctcgaaggaaacaagagcatttggaattccggtgtgcttgggtggaggggaagaggtcgttatgttgacccagacagtctttgtcccctttcttctgcaaaggagcaatgggaccatctcggaaaatgtgttggatgagagaatcacttggcgaggggttacttcccctgcgtaagctgtgtgagtacagacaccgggaaggaggtggggagagaggctcctgaggggcctagaggggaacagaactcaaggaagaaagaagagcaaatgagccaaaaatagcttttcaacagaccattcggaaggactgtaacccttactctgtaagtggttggagttcctccctttaaccgagaatggttttgctattacaagtaattgcctcatgcttgtgttctcaaatatttaaaaagtcaactgagtcaggtatgcacgagggaggatttccagtttcttccctacatcttccgtaagtgcctgcctggctggtcaggggagggaccagaggcctaggcctaggtagaattcagctactgctctgcaggctaaactggggacttcacctagacaagattttctcagttccctctacttaagtcaaccagattttcagggatggccttacacatagatggacagggtggctgcctgcgtggtatgatttgaggggataaaggtcaaaggcaccatgccccaaaactcaactctacttgccctaggctgagcctgaaatcctcactttgcttactccttttgaaggcccaggtttaaataaaattgcaacttgggaaggggagcacattcagttactacaagctgtttacacctcagctggattcatcatatcacattcgcattagcagaaagtaaggcctcaaggccatggttaagaggcaggagatcaggaaagttttggaacatgagctatcatcctatagttgagagtcctaagcagcggcggggggtagcatgaagagcttgtgctagaagggagaaggagtgagaaaagggagtatgaaaaacaaagcctacactgttcaccatctgttttctgagggatgagcttgattcctctatccaagctgaaagtggttctgatttggcagctaggtttacaacaagggagacacaatctcctctccagactga

SEQ ID NO: 6791 - DNA, 4671 bp, artificial
  synthetic oligonucleotide
gcttcaatggtgtcgaaaatgcccgaggaatacgacttgttataataacactaacgaggttagcggccctgcttgtcttgcccagaatcactggggctgggctgagcgggaggcgatggtggatttgtcttggggcaagggaggcaaacctgctcttagcattaagtgagaatagcgcctgcctttctcgattgcttttaaaatttcctatttgagcctgcttgcattctaaatattttgtaggtgctcagaatttcttatcactttgtctgggcacatcgcctgcctacagcctagaatctcagagctaaaaggaaccttggagagactagagaggtcaggcgacttgctcaggctcatacaaacaggtgaagccataacttgtactacaacccaggtctcccacagtggcgatgtctttctcttacataacctgtgttgttgagcaagaataaatcctcgcttatacactcacacacacatgttggtgccctatcctgatggcgctaaggacactaaatccatggctgggtttcctgatgttgtctgccctgcctctaaattgcctcagttgttcccagagactggttcttgccagagtgtctcaaactgaaggacagcagctgccttgggtcttcccattgtgttttttccctcccttgtcctctccttgcctccccagcaggatttctagaaagcttgaccggtacaccaatacacgcctgcaacgacatggattcatccgccctcctgccacacatagttcttgaggcactcaagatgtcctagggtgctctctggggttgcgcttagcttacatttgaaatttaacgctgtgatccatggaggaggcgaatccctcccatccagaggctcaagaaattctcacaagtctctgatttttaaaaattttcccctccccatctccctctcctaccaccagcagtttaatttgtcttgacattttgcttgccctcactgtcagtcaggggcactcagtaattttaaagcccttgtagtttcaatctgattttgcacatttgagatgggcttttgagaagggtagaacttggaactcaagaagaccccatggcagaatctccaaaggggctatggaaatgtatgcatttgaggagcgggtactttcagctacctccaaaccatctggggtctgcccaccttctaggccccagcgtccccatcagaaagcctttgcaggcagctttcagaatagggcttgcacctgccagtcctcccctcagctccgcggtactccaggcaacctcaaggtccagtcactgtagcctgagtcagacctccccagtacccctcctgaacttcctagttgccccttttgccagagatgagggtgcagcagaggctggtgggagcaaggaccgagttgccgccgtgtgccgagccacccacctgtggaagaagagcaggatggagagcatggtctggtcgatgttgcggttgcagatgccctcgttgatcaggtagcaggggtcccgcagcaccggctctagcgaatcctgccgcattatgctgttgagcttgtcggtattgaggttctcaaagaccagcttttcctgcagctgccgaaagttgctcactgtagggctgcccgggttgttgttctccccgctgctgcctcgctggagcccactccgatgggccaggtccaggcagcagttgcagcagtcgaggccgacaggtgagcggcaatcgagcttggactgggccatcttctcaggctcggaggtcgcctggcctgcgaggtcaggggcggctggcaggtgcgcgcccaccgagctggcctgaggggactccagggtgcctggaaaagacaagctgtgaggaaaagagttggaaattagcgcctaaagccagccaccttcggctcggcccccttctggctgtactgctccgggtgcgaatagaaacagctggacaaacagctccgagcggatccttcgggctcacttcctcctcttcctccttctcctccccctcctcttgaggccgggggccgcccccctgaggtgccacacgcggccccagcgcagtcccaagtttcccaagtgtgagcggggattggggcggacctgtggaggcaggaagggcgggcagcagggcagagggagagccagggcgcgcccttgctccctccctcctttgctccctccctccccggtttgcaggctctcaggctctcgggctcccctgggctgtgacggctgagcggtggcaggagctgagagcgagtgagctagttagcggtctgcacgcccgggagtcagcactgggatatgacagcatgtaaattaccctagaggggacggcggagaacggtcctccgccacttctccggctggcgggcgggggccccgagcggctggatcctgtccctccacccctcgccccaccccgcccgcacccttgtgccctggcatccacgctgccgctcgcaccctcgcccgcgctcctgggagccggcccggctctcactctctcggcgagccggacgcttcggttcaggctctttcagcgctcatggcgcatcctccgccagaaatacgcacgcagcccacccgggctgccgtgccccctcagtggcccggtctcgcggggctcgagctcggcgtgagggcaaatgtctctagtctcacctcgaatgggtccccctacagaagagacgacgccctcgagagccccaagtgttgtagccttaaactgccgccctccaaagcccccctttttctggggggggggcgtgcaaggagagcggttgcctctgcagagagtcagagagtgccaggcacacattaggagtacccaataaatgccgtaagcaaaactcagagaagcacgctcaaactctcctcagtttctgtctctttctgcttacttaacgatatcgtcacctcctttccccagctcgctgtgtcctctcttccctgaacccctcagaggcagtctctgtcccggtttccctctgccccttcgccgtctctcctcagtcctccccttccttctctctgctcttctgcttccactcattccactatttcccttattttttctcttttctttacccatttcctctactttctcccccatttccattcttttacctttctttccttatttcttttctccttttctctatttcctcatttcccctttctcccctttcctcttttctctcatttttctctcccctacccccgccatttcccttattttcccctcatttcttacttcagcaccccctctttttcctcacttcacttaccttctcctatttctccaaatttgttgtccttctccttttctgaaccttacctgccaccttagttgatctccgtctgtcgttaccctttcaatagatgtagcgattgcatgttcacaggcctgaggggcgtgccccagctctgtaagatggagggatgttctgggtgggcaagtggtgggtttccagggtttctcaggactcagagacttggaatactttaaatgtgtaggattaaataacgattagtgtctgaaaaaactaaacttttcatgacgttcagttttcacgtaaaactgacttacatttcagtcagtactccccacccccgcatcggctccttcattcacaagtctggcctttgaaatagagcagcatatactgccatctagtgtccaagacgttgaacgttctctgcctgcgtcacagaagctcggagaggcaccagaggtacctcctggtggaatccacagtgcgttggttccaagagtagcagggaagaagtgtaggaggcggagctgctacactaagagagttctgtggccaagctaataggcaggaacacgctcctacactaagagagctccagctaataggcaggaacaccaattagggccagagccgcccttttttctagtggagcttcacttggcctgagtccctgcggattggacttccatagatttgaaacttcctccgggtaccacaagcatcaggcctgtgattaagagcaaagagcggccaactattgtaactcttattcccaaggccctgtgggtcctatatgtgccctgcaacttggggaaaatggaggtggggttgtggtctctatgctgtagcagccggaaagccaaaaacaagccgtacttctcgctcttgacaggatcccaaggtcagaggtgaaagaggtgctgggggtcactgaccatacctgcaaaactgagagtatggtcctttcgttctaacagactgctgaggagtctctatttctcctctcaaaagcaaaccctttagatgtattaatttccctttttcttcttcttcgctttttttttttttaaatgttcttgggtaaaagccagaggaggtagtagaatatgaaatttcatctgcattgtgtagacttatagtctactaaattgttttgtaattacagtgtttatgttttttcctcttgtttataattatttcatgttaaacgttatagcaaaatatattagacccataaatgtttatttaagttgtgttttgtgaactgctgggacttttgtttctatatttgcctgagtccttttatctttgtgcataaccttgggatgaggccctggtagaagtatttccttcttggcatttggcaccattaaactcaagattct

SEQ ID NO: 6792 - DNA, 4360 bp, artificial
  synthetic oligonucleotide
caggagtgttgactgattactattggttccctgaagggatataccaagagatacctcaatttttctggacttgttcctatgcacaatgatgggaggcgtgtgtgtgtgtgtgctggggtgagtcttcccattttctcatttctttccccttcttctccctttttgccccaagttagaaacagagtctcttatggggcttcctgctctttccctctcccatccaccttttgagtcgggtggtggtctctgagccaatgacaggtcagcaaacaggctgattccagaccaatgggaggatgctggattccaaatggaccaattagcttattagggacctggaatagctggatagctagcatctgcctcattgtccatgtggtaacgaccctcttgttttactggtcaacaatttgaaggtacaagaaaaatcctacttttttttttcttttgatggttttaatccacctccacaacttctgcccgaggccaataaaacacagccattctttttttgtaaaaagaaagagaggttcggtttccttcaattgtctgcccttttctatctcctccactatttttgttttactctgtagttaactttgcatagagcagcttcatagggaggatctctgcggtggacccggctctctcttcttattacccgttgcaaaggcctctttcttgttctaacctgggggtttgtggggttgggggacagggggattggggagtgggagaagagtttagccatagccttccttctgcatttcacacacatttagctatctctgtcgctctgtcacacacacacacacgcacatacacaccatacacacacacacgcacacccgtccgggtccctctcggtgtgtcttccttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtg

SEQ ID NO: 6793 - DNA, 2889 bp, artificial
  synthetic oligonucleotide
ggattgctatggctgtagtatggagtatggagcaaaggtcaagggtccagggtaaaaagtgaggacaaagagaccagttagatttttactgatccagggagagatgaaggcccagcttgagacagtggcagtaggattagggaagaagggatacattcaaaacatttctaggaggtggatcagtattaattggtgatcagttaatgggtgaaggagtgagggagaagaaatactatgatgatccacagggttctggtttaggtgaccaaataggtctatggcctttaactaggttaagaaatataaaaggagttctttttagacctgcaaggtttattgttctctgggtcagaaaggcaggtaggaaatgtccagtagaaagttggctagctggatttagaggtcaagagagaggtctgggaaagggatatacttggaagtcattagcatctaagtagcacttaaagccatggagaatgtatagattgaaaagagggcctgtgacaaatctccagcccaattgtttgtcactcacaatacaataacaaactgactttccaaaaataaatagaaagacggtgttgcttttgaggagattactgaagaatgctgtgcattttgaaaattaaatatcaaagtaaattattcatttgtggaaaaaaatcaaaggtttagggtattattatcttaaagactacaataataagtaacacttactgaggatttcctctgttccagctgagtgcttaatatgtgttaactcatttaattctcacaacagctctgtgagatagacactgttaatacccctactttacagataaacagagacaaagaaatatttaagtgttttgccaagttcatgccactggtaggtaagagagtggggatttgaatacaggcactttagctctggagcctgtgcccctgaccactccattacgcgttgttttgcaagaccaaggtacacgccacttggatgtctcttgttaatcatgggtggttcctggacccattgtgaggatgacttgtagtgagcaaggggtatgggatagggatgtgaattctgaaggacagcaaaggagaaacaaagagcagtcaagagacgaggaaaaccaacaaaaacagaggatcaaaatctcagaggaaggagaggccttcaaaatgtggaagatttgatgagtcaattggagcagaagcatagaagatttcattagtcatctttgagggagaaggttctacgcaaatatgaagatggaacataaattcaaagaggtcaggaagaaagtaagttataaggaaatgcagggctgggcgcggtgactcatgcctgtaatcccagcactttgggaggctgaggtgggtggatcacctggggtctggaggtcaagaccagcctggccaacatggtgaaaccccatctctacaaaaaatacaaaaatttgccaggtgtggtggtagacacatgtaatcccagctactcaaggggctgaggcaggagaattgcttgaacccaggaggtggaggttgcagtgagccgagatcgtgccattgccctccagcctggacgacaagagggaaactctgtctcaaaacagacaaacaaacaaacaaaaggaaatgcaggttgcaagaagtttgatcacgaaggtgaagcaagaaataaggtggtagttattatcctttcgaagagcagaaaagtcagactcataaatgctctgtttgtgtattattctgctactggtgagttaacagtaggaatcactagatccactgcgttcatccacatatgcttcccttccctccctgacttggtgtccagctttatctccaacccaggacactgtagccttagtttctacaacttgcctgtcctaaaaatggtatgtacgtcctgggaggcagtgtgctgtgacagctttggagttggacagacaggagtcatgttagctgtgcaaccttgaacacatactttttctgagcctcagtttcaccatctataaaacttggactaataatacattgaagagaaaggcaatacatgtaaagtacctgctactgtgcctggcatatatagtcaaagctcaataaacggtggtggtggtaatactagtcatagtagcaggaggaggaggaggagggaaagaaggagaaagaggaagaggaggtgtaatagcaggaacagttgctagtagcagtagtactagtagtagtaattttgggcactacacattttgccagagattcctagccctgacctcaggacttccaaagctttttatcactatctctgagagtggggagaacaatcattcccaaatactcataaccaatttcaaattttacatatatcaactaaaacttttcttgggaagagggagtggtaatgaaattgcagcagcaaaaatattgggtaccttggccatgtgactccacctagcccaccagtaactctgcagatgtgatagactaaaaagggttattgtgctcaataagctgctagtttgcagttactaatttaaacaaattttatttagtaaggaaacatttactgcccttctgcaagaatatccaaaagattcttcgtgttgatacttaagtaaatttgcccattatcctgcccaaattcttcttgattactgcctttaagcaaagccaaaagaaaagttttagggagggtcacatgctttcatctctagtaattttaaaaagagagagttctataattttgtatttgcgatttaaaatgtttattagcaaaaatgttctgtgaatatttttgttagagatggaagagcaaggggagcagacttaagagctcctgagaaagatttgaactgctagtgtcttgtgaaaatgaaatacctagtttgaaaccactgtggaatt

SEQ ID NO: 6794 - DNA, 1778 bp, artificial
  synthetic oligonucleotide
ctcaactggagagcagcatatgtgtaaggttaaacgtgtagtctctagtattgcactctctcagcccaaatctcatccctgctatgtactaactgtgtaaccttaagcaagtcacttaatctctctgtgcttagttttcctcatctgtcaaatgtagataaaggtacctacctcgggactgttttgaggattgagagagccaatatatgtaaactaattagagcaatgccaggcatatagtgttatgtaaaggctagtccgaggattacattttaagaaaccaggtacgacatcattgtgtactacaccagtagccacctaaaaaagaaattataaatggcaagtgtctaagtttctagatactgtaagcaaggacccagagaaaactaaatgaatctcttagtctcagataaaggagttcgtgagctggtgagatatctgccttggaaaggtagatccaatttagggaaagggtgaggtgtctgagaaaaaaaagtagaatggctagagtgccattcagagtaaacagaagccccagttgtgacattgccctagaaaatggaaaaaagcaacataagattgtcactcagcaacagacatattttatttcagttaagtaggaaacagaaaattagccatcagtgagcttcaagtatgagagagggggtagtagggtccagtgacaggtattttgctcgggttggagaatatggagcaaccctctgaagagggatagcaattggaaatgcagccctaccttgctaatgaagcacatctagccccttgagttttgatgctctcaagtaacccattgtctgttcctcagccttctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatggaaagaaaatgcagaatggtagtttttttttttttccaaccctgactttgcagtaaagatgttttgatgtagccagtatcccaaaataggaaaggtattcagatactggacagcccaaggtgagaaatacccactaaaacacgacaactatctgaaaaatatatacacatgaatatatgtttaatgatatatttaatgtgaaaaattagaagggaacaaggaaaactgaaaatatttttgttagcacaatatattgttgtaatgttatcttaatattgtgcctgtggaggaggatactcttttcttgacatacataaatctccttaccctctttccaaaagaacagcaggaggaaagggtactggagtaaagggaattgttcagtgggaataacatgcccccatctcatctgtccttctgcccagccttccattaaccatcatgatctaccagaggcctggagagcttcctaactgtgg

SEQ ID NO: 6795 - DNA, 2089 bp, artificial
  synthetic oligonucleotide
agaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatcccctccaacagtgactctcacctcagagctccatctcatccacccattttcatggaccacatgctgaatgaacttcaccatcactcagaattgcactgaaatcataacttaaaacatgccagtttttaactataccctctacttaacaactcttttttcttatttttgttttgttttgtttgagacagagtctcactctgttgcccaggctggagtacagtggtgcgatcttggctcactgcatcctctgcctcccaggttcaaaggattctcctgacttagcctcccaagtagctgggattataggcatgcaccaccatgcctggctaatttttgtatttttagtagagatggggtttcgccattttggccaggctggtttcgaattcctggcctcaagtaatatgcctgcctcagcctcccaaactgttgggattacaggcgtgagccactgccctcggccaacaattctttttttcttcaaatacgtgtatacttcaactttgttgagactgctaaggcctgactcctatactttcttccgacctaccagctatttcctgtcttcgcttctttctttagcctatttaggatctgtgatttctcacttcagatactct

SEQ ID NO: 6796 - DNA, 868 bp, artificial
  synthetic oligonucleotide
aacatacatgtagcccccgtcaacaaaacttacaatcatcagagggagagaagcagactaacccgtcacctacccccttaccgtacccactcctatcctcctccacctcaccccttccctctggaagttgatttcccattgggatatgtttctgttctgttctacatttctgaattcactgagagctttgtagccagatttccctcccacatttatcatggtggtgggttgggggagagaatctctcaagatggcaccatgctttggctcatagtctagaccagcaaaccctctgagcactatcagttgctgactcacctccttggcagtggcagttctcttttcagatctgactgccctggttctactcactggggactggaaaggattctcctgtcatggggccatacagtcatagcagtctgcacctgcatggtgctggtgtcttctgtaggtaggcctaagggattcccttaggggtggcaaatctctgctgttgatttgagtcaggatgaacctggggttcatcctgggcctgttttgattgtttcttgtgatataactcactcagagcatgaatgaacttctatccagttcattcatggaaactcttgggattcaggaatctccactgctcaccacaccctgatgcaactccccagccagtcccaccattttctttaatggtcttttgttcaaaattgctcttctggtacaaacttctgactgggaaataatctggttgctcagaacagaaactcactcaaattagtttaaagtaaaggggatctgtgtaaagtacattttcctgtagcacaactacaggaagtgaaaagtgattgggccatcactaccctctccatctctc

SEQ ID NO: 6797 - DNA, 752 bp, artificial
  synthetic oligonucleotide
gggacatacttatgctaaaatgttactcatttatttgaaattcatatattttttcatttttatttgctaaatctaacaactctagttgagtgtctcatttctttgctacagcgggatgattgcaggtccagtgtctttttctctgcaatatctgcaagtgtctgtgtctctctgtgtttaaattgtggagggcctttttatttcccccaggctgttcgagttgtaatgacataagtttgcggtgtgcttctctctttatttactatgctttccacaaaatgctggtttaaaatctgctgaactcaaagtgttgtaaatcatgagtggatgtggtctgccagcctgttttatgcttctgaatagcatctgatatatcagggttaaggccattagtaaagaatgtgcagattgttgttggagtgttagtgttaatgcccaaccctgagcattcctaaaaatgctttctatcattggtccctaaaattggaaacagatttatcacacccttgctgacaggtttggattattcctcagtcgatggaatagtgaaaaccttcaccaattgcctttaaaagactttctcctctctatttggcttttccatatccagaaagggtgaaggtatgggtcaaaaggtgagaggaaggtgagaaagtggaaaaggaggagaaagagagcagagcagaggacagaaagcagaagagtagggaggccaggataaagtcagattgtaaggggaagaaatagagttt

SEQ ID NO: 6798 - DNA, 216 bp, artificial
  synthetic oligonucleotide
aataaaaagttgttttacaatgtctacctgctggaaaacacatcagtgggcctcataaaaggtttaaactaatcgataaagactcagtactcccacttgtctttgaaactttggtttaaaaacaaaacaaataattcagagatgataatgagggctccaggaaaccataaaaagatatgccaataaagaaaaactgttccactactcacaacactt

SEQ ID NO: 6799 - DNA, 1648 bp, artificial
  synthetic oligonucleotide
caagctttctttgtctggaatgtcctttccctgatgaatttgcttaactctcactcattttctaaggtcgagtgctgccatcagctttctttccacagcctcctttatgcctcggattgacttagatgtccctcttctattcttccttagcctcctatacagatactcatcacatactgcatcaaaattaactcttccttctctttcttcccattagactcagaattactaagatatgttgctactgctaaggcctagcacagtactggttacatggtaggtactcagtaaaggattgttaaattgacatttggatggacatataaaccagcttttaggctttttttttttctgtacccatccattcaacaaacgttaaaccttaggagaggacttattgcaaggcactatgaccagagctgtaggggatagagagatgaacattacatggactgagactttaaggagttcatttcaatagcagagagataacatgtccacaaataacaataatctaaagtagaaagtgctcagtgtcataaaggaggtataaattaaggactgtggatgtttagaagaaggagcaagtactccttgttgggaaaactgaagaagaatgattcatcaagaaaggagcatttgaggtgggatttaagggcaagtagaacatgaatgagcaaagatagaatctcctccgtatcatgtgttttattttgactgaaaagagtagatattatgaaggagtaatgagtaatgggaaacaactggaaatttacgaagtgggccttattagagagggctttaagtgccacgttgatgagtttatatttgattcctgtcaggtggaacagtcttggaagcccatggaagatgtttagcattttattgtcaacagcagagagatcctgtaacattagtctggcaatggcatatcttagtaaatcattattaactaattaattgctaagcctatagttttgctaagtagtgtggaaaaaccctaaggcctttagctcttttacatttttgcacctgtcttttctcactggaaatctagatgaggtaacagattatatgaccaattagttctgaaaaatgaaaatagaaattgacaggggaaagaaacactaccaagacagaagtgcctcataataatgtatagacatataaagtgttgtttgcttaggaaccgtgtccaaaacattgctttcagctgtctggaaaaatccagacacagtatgtgaattatattgttaatatttattcctctgggagtagtttagatcactttcagttaaacataactataatgttctaacctcagactgtctgctcttattgtcccttataaacagtgggtattgcattgtcagtttgttttatagtgtgttatataaccagagcatctggtttcttgctgccttaggccgggccttcaacactttatgcctggattgttgcaacgactttctcattggtctccttatctcctgtgcttagaatccagctttttttttcataacagcaatgtatagtgggaagaatactggatgaagagtaatattaactgggtttgaatcttgattatactgctcactagctatatgatcttgggcaagtcatatcacctctctgagactcagttccc

SEQ ID NO: 6800 - DNA, 1475 bp, artificial
  synthetic oligonucleotide
agggttcagagttcagaagtctaggattcaaattccctcttcaccaccgtaggactttgggacaaatggcatcttcaaatttcttcagctgtcaagtgaggataatatcagtgtctacttcatagggtaattatgaagactaagtaagaaaattcgagtagatcattattttcgctccttagcatgcatcagacttacgcagaggtgattaaaacacagattgctgggcttcagctccggagtttcagattcagtagtgccggctgggtctaaaaatctgcatttctaacaagttctcaggtggtactgactctacaggatcaaagaccacacttggagaatccctgttgtaaatcatttagcattgcaccttgcatatattaaatgtgcaataaaagttatttgttgttattgatgtattattattcagcaaatgattatggcttgtgcaggtttggagttcacaatctctgaaaggccctcagcattcctttatcactatgacttagggcacctctccttcttcctcattatgacacaccacaagaggaaaggagtggatggagtagcaagactggagacagggaaccccatgaggggtctatgacctcctgaagagaaataatggtgacatggactaggttcatggcagtggagacagggaaaagacatagttgagagatatttcagaggctaaaaactataaggatttagtgccatattggaactgatgagcaaaacagaggaaagtgcaaatgatgactccaatgtttcttgattgggcaaccgagtggatctctttgatgacatgagagaacttagaggaagaagagtcttgggtggaagatgaggaattcacctttggacaggtggaatttaagatgcctgggcaaacatctagggagatgtttagcacatttttcccacaaaacaggaagatttgaggaaacagagtgaggtttgttcaccaccatatccccggagatgcagtatttggtgtgcagtagacacacaaaacataattgtggggaaaatgcataattatgaaatgaatgaaaatagagaattaaatatgcactggggaatctttgagaaggccacttccaagtctcatttgctaggagcaaaatggaattaaaagaatgtcactatcctaaaaaactccttgtggccttttgagaagggggagcagagatccttgacctccagcctagaaacaaggtggcttgatttttacaatttgtctttgctttacaactgaaattctcatttcagctgatggttggggggaaatgcaagaacttaacaaactttacctcagtagccagggatctttctcctagcaatgaaatgtggtaagaaagatactaataataacacccccatgagtagaatacttaaacttcacagcagttttcttttcaccattcctttggatcatcacaatacatctgcaaggcaggcgaagggcacca

SEQ ID NO: 6801 - DNA, 2320 bp, artificial
  synthetic oligonucleotide
ataacctctatagcaggggttcccaaccctggggccacagactggtatcagtctgtggcctgttaggaactgagctgcacagtgagaggtgagcagagggtgagtaagtgaagcttcatctgtatttacagcagcttcccatcacaggaattatcacctgagctccacctcctgtcagatcagcagcagcattagattctcataggagcgcaaacactactgtgaactgcacatgcaaggggtctaggttgcatgctccttgtgagaatctaatgcctgatgatctgtcactgtctcttaccacccccacatgggaccatctagttgcaggaaaagcagctcaggactctcactgattctacattatggtaagttgtgtaattatttcattatatattacaatgtaataataataatagaaataaagcacacaataaatgtaatgcactcatatcatcccgaaaccaccccacccctggtctgtggtaaaattgtcttccatgaaaccagtccctggtgccaaaaaggttggagactgctgctctataggacctagtacagtgctggaacaagtgtttagtagagacttcctgaataaactgcttgggatacaacaggatatagagtcctctcatatttctactaattataaggctattgactggcaaatgaggaaactcatatgaagcagggaatctttagttattgctgatgatctagaaaccaggtgtcaaagagtaaaaagcctgagcaaacacaatcctgtccagccatcccagaaagctttatacttctagtccatttccccaggggttccaatttttgctgagactaatttattaaatgtatttgaggggtaaagcattaatgactgataatgtatttaatgagtgtcccaatctcagataatgacagcactcagatatcttcataggggtgaagaatgattgtcaggaatagctggggaggtctgcacttggggtttcctcatgtccttcacatccaccccaaaaatgaatagggagaaaaggaaaaatggaggagcatcaggattttttttaaccacacaaagaggtgaaatgtctgtccgaggtaagagtaagcactagagcctctgttctctccattcctctccagcgctatctgccttccacaacatccacttcctccctttcaggagtctgcagttgtataatatacaatccatgattaaaatgtcttccattgcaaagttcaaggtaggttgcagtgaagtgacatgagggacacggagcttgaaatacttcaaaatccaaataactaatctgaagctggatttattgcaatgggtcaacccccctcaggctgtggaactgtgcaaacgaaactccaggaacacagaatggcatccaagtcccatctctgttcagcaggaagtctggaggatcagagaaagcaaaacagctggccaagttgggaaactataaatttctaaacaatttccaattcgctttaatgtagctgttctctatagagtactgccttttacttcaagtctttctggtggtagtaaaggagctctgaaagctggaggcaaagattaagacccccaacaagtttctgagaaggggccgagtgagaaaacgtttctcggtgtttaaaacttccctccactacaaagtggcgaatgagcatcgggcaaacatcctgagatgaactctttatttatctcaattcctcttggccaaagtctatgaaataattaattctagcccccttgtcatcacttagatgatctagagaagttcatggacattgatgacaaggctgtcaacctctccctaaagcaccattcctttgtgtgcataggctccccttcaaatctgctcaatctcgggaggacagggccctttgtctcgaaaatccctccctccacaatacaatcaaggcttaagtgactccctgggcctgtagaaccagtcacaatgccccatgcttcctgccctgagagcccagaattctgagagcccagaattcatgaccgtgcagataaatgaattatacacttggccagagattaagcctggtcctttgtacagcaacctctgaggtctgggggaagatttgacctgtcaggatctgtgttcattctgccttgatgagaggcagagcaaagcagtcctggctgtacaatcccacaccctggggtgtgataatcagcaaattgcagacaaggaattggctattgcctgattctcattgtccggggcctaggctgaactgttcagtggctggcaggctgtttttttgactccagatggtgaacccatctcttgccagg

SEQ ID NO: 6802 - DNA, 630 bp, artificial
  synthetic oligonucleotide
gagaactgagagagcagcattgaattttatcttcacctatgcttacacccttgtctaatgttgagtactatatttcttggtattatggataatttgtatttccttctccatacatttctgtgttttctaagcagtcttcaacaagcacatataattattaagaatacaaaataatacataatattaagtgataaaagtcatccccttcaaggaagagaacttgacaggtgttgccaaagttgaaatggcatctatttggagctatggcctacttccaaacaatgtctgtttgagtgttccataaaattggtctatagtagatgaaaaatttccagacccctcaagcatggagcaaagaggctggaagcaagggaactggataagacagggaaaaaaaaaacaatagcaggagctgaacaaaaccataagaatcagaagctaaggtttcttaggaactcgccagaacaaggaggcaaagacactcagctaacaggaaatcatcactgtcctttgtcactgaggaaagtaaccagagaagccctgttggccacaaggcaatttcctgtaatgccagccctggcagtttccccaggagtcttcaattacagtgaggtgggaggagtgaaggca

SEQ ID NO: 6803 - DNA, 1783 bp, artificial
  synthetic oligonucleotide
aataattatcataatgaaactgtgatgttgggaacaattagtagcaacaatcaagtgactactatgctaagtgatttaaaactgttatctcactttttcctctaaacaatcctgagaggtgagtactattattttaccagtacaaaaattcaggcttggataagttcgaacaggtaaagtcacttgtgcaaagtctcactgctaggaagtggaaaagctggaatagaacccaggtcagtctaacattacctgctgtgctcctaacaactatggccaagagcaaccaccctacaagtcagctatgtaaaagctccattatgctacccttttaaatttaagcccctcaaaagtaataagaaagaatgggaaggcatcaggcagagaatgggttggatgacgaatgtcttgctgaaagctatgcccctctgtaggacaaaagtggtattagatgatcaagggttggggatggtcttcattttttcattgaatgactgagtagtgaaatcttctccaacaatgtcttccctaagctgggcaggatcaacccttctgtttctctcaagcagctcattccaggcttgtctcttgaagtcttccccggaatcctcctcctatcatccaggaaagagatccccgggaaggtgagaaattaaaattaaagaatttttcaggtggctattaagcagcaggtctgagggtgtttggaaagtgatcagtatgtttcctgaacgttcttatctccagagtagtgccaaaagtcctggagtcagtgaaattctctccaaacatggtctaggaggcctaacaatgaagaagccagaggaaaacatgattgcatggccactaagtcaaggacccttttatcactccttagcctccatgattttgcaccactctgttttcttgaattacctgattaatcactttcacatttattgaacacctactctgagtagaagtagtttagtgggtgcataggtaagggcatgttaaaataattcaggcactcaagagtttttttcatatagataagaaggcagacatataaaacagatagataatatcctagatgacatggtaaaggatggcctttaccatgttttccaggttagattgatgtacacttttctaaattaaataagcacatattaataacatttgctgtttggcaatagtggtttctggataaaacatgacataattgagaaatctcaaactttaagcctgtctctagtcaatttctttgcaagtaggattgggtatatcagtttaaaaataatttacccccctttcccaccaatgttatggccgtaagaacatcattaatatcatcaatcaattaatatttctttgacaactgattatcaacattttagagtacccaaagacttgctttatcccttccccagcaagactccagccattcatgacacttaggtaccccatacttccattttctcgagtgacattttcaccaagaactcaatttccatcttaaatgagtgacaaatgagttatatttttcaaagcaagcttaaacagagaatgtttacttcttaacaaaccctgcaccagcctacctaggataacaatcatttcccaagcttttaataactgttatctgtctagacatcaactcataggaagaaggcagaaatgcctgtcaaagggtaaaacaatcaacatctcaaagatgaagaatttgggcacagcaaaggtaaatgaaaaatgaataaattgcatttcaatatggtaattaatgcataaaaaagataggatcaga

SEQ ID NO: 6804 - DNA, 2665 bp, artificial
  synthetic oligonucleotide
cctccacgtataaagggtttgttagagaactggacgcaaaataagtggccggcaataactataatgtcaattacaccccacatagagagatatacggtagtacaggtgttaggtaaatgctctgaggagttacggagcaagtaagagtgcagagcaggtctctttcctatcctccatccacatctcacaaagttctacctctctctttcctcttccccttccctgtgctctggctacagtggcttagtgcttgacatagtccttcccacaatggggttgacaacaatgcctggcacatagtagtcactaaataaatattagttgaagggacgaaaaaacagtgagaaacagaaagacaaaagaagaggagacttcagaaaaatactaacttaacttcctaagagaagaacaatatgtccatctgtagagacaggaggaaggcaagacagaggatgaaaaaaacaggagaagcagaaggagtgaatatgcacgtcctgttaagccaacatcacaagtataactgtgacctaaacatcagctacatgaggacaagacaggagatggaattggatgggtaggcagggccagatcagatactccatgggtgtagggagcttccacaaatgttagagtggcatgatcaatttgtgttttagaataagctctttgctttcagagaggatggatatcaggaaagccaatgaggaggcagtgaaagtctgaaactggaacagttaggtctgctgtagggagtccggataagagatgataaaaaacttaaattaaagagatagcacagtagagtgggctttaactctgccatttgttgggtttgtgaccttagataaatcagttaatctctctgggatgagaatatttgtccctcacagggttgtcttgagcagctaacaaaataatatatgataaagtgctttgtaaacttgaaagacttgaaaacatatgttactattatggtggtgaaattgggataaagagatgagggggacaactgagaaatatggccattgtccccagggatgtccaatcttttggctttcctgggccacattggaagaaaaagcattgtcttgggccacaaataaaatacagtaatactaacaatagctaatgagctaaaaaaaaaaagcaaatatatctcgtaatgttttaagaaagtttaccaatttgtgttaggccgcattcaaagccgtcctgggccatatgcggcccttggggcacaagttggacaagtttgttctagacataaaatctacaaatgagagagccttctctgatatctccctttctctcatcttatcaaacatcaattgccaaaattgggaaatgatttttaagtctctgaggatactggggggaaaagatgggagaggaatttagcacctacctggtgcatggcatgttcacatacagcatccacaataatacctcaagaacaaagtataatatcatcatcccttttctgctgatgagaaaattaaaccctggaggaagagggtcagaaaaaaataattattgggtactaggcttagtactggggtgatgaaataatctgtacaacaaactcctgtgacacgagtttacctatgtaacaaatctgcacatatgacccccgaacctaaaataaaactttaaaaaaaaagattcatgggttcaggaaggtagaggaaaatgtgaccaggatgaggagaagaatggaagtttgtaaaatttaaaatccaaaaggaatttctagaaaagaaaaatataatatctgaaatgaaaaaaaacacacaggtggtgttaatatcagattagactctgaagaaggaaaaatcagtgaatatgaagctatagacttagaaactatccaaaatgaaatatgtgcttaccatatagcaatcatactcctggatacctacccaagagaaatgaaaacatgttcacatgaggacttgaatattcatagctttgctcatgataattaagaactgtaaacaacttaaaagtctatggactgatgaagagagaattaacatgtgatatatccattccttttattactcagcaataaaaggaatgaactactgatacttataacaacatggataaatctcaaaagtgctatgctgattacatttacatgaaattctagaaaaggcaaaactacaataataggaagcagatcagtggttgcctagcgtgcagaatgaggaggagggaattgactgcaaaaagtgtaagggaactttctgggaaataagtgtttttattacaattgtggagacagttataaaactgtatacatttgtaaaaacttaatatatgttgttggaggaggaatatggatgtggttataaaaggacagcatgagggatccttgttgactttggtatcttgactgtggcaatggaaatcccaacctacacctgtgaggacattgtatagaacaaaatacacatacaaataagtacgaggaaaatgaaataagatcagtgaatgttatcaatgtcagtatctgggttgtgatattatattatagtattacaactaggggaaaactggataagcgtacataggatctctctgtactattttttacaactgcatgtgaatctacaattatctcaataaaaatttcattgaacactcaaaaagaaaaaagaaa

SEQ ID NO: 6805 - DNA, 1833 bp, artificial
  synthetic oligonucleotide
ccagcttaagtagctagtgaaactggaaaactgcagcatctttgattatttgggtcactccatctttgtgaaattatcctagtaattccactggagatttcaatactttctgggacccattaaacttttcttgaccaaaagtcttcagaaatttctttacctgcagtccctagttgatttgatagatgacatctaaacagcctatgaaatgttaactttgatttttttttctattataacagctttatcttttaactttctggtgatgcagaaacgagtaacacgacacatcagacagaaattgaacatcacctagtggtatcagttcaattcaggtagttaaagaatccagatgttgtcacctggtactgtcaaacgactctaagcatgtacttaagtttcatttccatagcatctgcggcactttgaagttccactccttgtgctctcctcccactctcaaactagtgtgccaattcaagttcttgaagaccagggaaaattatgtttcttctgccgtggagattgatgctagtcatcttaagtcgtctggggaagaggctcagaaatgtgtgcatcttgtgtcttccacttttattttcccaacccgttacgaagttttggaagatatcttggtcccaaaaacactgacttgacactgtgctattcctctcaagaatctcattaactcccattagaaaggggagtggtgtggactccgtctcgtggtgaaactctctgcaaccccctaacataaatactagagatggggatggttagagggtcaaaggagggggacggaaaagggtcgtgagaagagactcaccgctgctgccagttcctcggtcaggcacaacgtaaccaggagcagccacaacctgaaatgggagggagggtgagtaatgggctctctaggcttcggggtcgtgcgtctgcctgtcgccccccgaacccttttggatgcctgctcccaatttctctgcagtgacagaagtaccagtatagtcccggcctggcaaagtaacccgaagtaagaaagaggaggggagctcggggcagcaacagctcacccagggtgcatgcttgcggctcctccggagctgggtcccgggagactgctaagcggctccgcggcccgtgctcatctgggctctgctgatgcttggaggctgtttccttactcagaacagagtaggtggacgaagtggcccagtttggaagaaactaaacactgcttctagataagaagtgctccaaagggaaacaggctcagcggtgcccgttacaacttgcagcactcaggagatagttccatgcagcaggagaggaaagaatggaggggaaaggggcggggctgtctgctgtcaatcatcccccctaccttgggcagccggtagtctttctcactttcaggcacctttccacacaacagccctaagtatctccacagcttcacacacagccccttagagacctatacgctaagacctaagcaactgtgcatcatatactttcaactttactgttaggttacacataaagagacataggcatactattcccacataagacagatgggcccgaaagtgcccttgcacacatgcccaaatgcatacaacactgattcaaattgatagtacactaggctattgggaaggggagacagtttctggagttgtaaatccactctgagctaagcagaacctaaggatgagtgggccctcgtgaaatagatccaaaaccttgaaagactctaaagtggttaattctaggaagatagaaatgttgtgaagaattcttcatcaaattcttgaagattctccaaggagtccg

SEQ ID NO: 6806 - DNA, 1860 bp, artificial
  synthetic oligonucleotide
cactttacagatgagaaaactacaaattacagacgttgaatacattcccagaaatccagtcatgtaggcagtaacttgtgaagctggaaaatttgaatccaggcagtttgactctagaatctttgcccttaatgactgtcctatactgcctactttgtatgtggtctatagagatttactggtgtgtaaagtatttggatctctgccactttttttggacacaggaggtgaaatggaaatgataatgggggttacatgtcttcctgctgatgttaggagaagcagcatggtgtaatggaaatagctttgggcctagaataaaaagatcagagtttgacctctgtatctgtatctagagtgagattatttaaaagcaatctaaaagcaaatgctgttgaaggttttatgattttatgtaatcacaatatgtaaacatttcaacttatataactactataatttgtgacagatgatttgttttgaaggaagatttgccttatgattatttaattactcagttactgcattaattttaagtccaccaaacttttcaggagcatgtctattgtgaaacaaccgggtatgtgtgtatggtaacacactttacttaacatgcttaatttagttttgttctttttttgtactaatttgcctacctatcatatccaattttattcacaaactatatagatatatatctttagtcttatgcatatatctatatatgtatctgtcccatggcagtgtaagagtttgtattttttcatgtgtttttatttaccttttgatgtctatacatgtaagacatgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttct

SEQ ID NO: 6807 - DNA, 2316 bp, artificial
  synthetic oligonucleotide
gactaataggcacagagaaaaaaaaaatcaatgcaaccagcacagattacgaggttcttaatcttattttcattatacatgtgtaaacagtacacaccaaagaacaattaccaagagctacctaatggaaaattgctgattcttagtgaaagatgtttgtttacctaattagcagtaaaaaaagccacaaatatttgaatgtatttattgttattcaaaataaatagtccttttcaaattgttaagaaagaatcaaaagaggtaatagtataccccatgatatctggctgttgagaatggcaggacattttttcatcttataaaattaaaaaaaataatttttcaagattatttttagggagccatttgtttctacctgaattgattctctagtttcttactccactgcaaactcattatttcatagaaccatagaatgtcagatctagaagggacctaagttttacctatgtcgaggagaaattatccacaagacagattttattcaggactattgcagtagagtagaaactattgcagtaggagagagactgagctcaacttcaaatacaacaaagaaaagtgattatttacagccaaggagcagagtgagagggccagtaatggaaaattactaagaggagacatcaagggtagagaggggtgggttcttgttaaactggcccaacaggatttttgccagaaacaggccaaggatttagacatcaaaggtgggagatcaggaacttgatcagatatcggggtgaagggactctctctaaaccgatttagcaggattattgatgtaaatggatttggaaggccaaaaagtaggcccaaggatgaggcctaattgagaggagggctcagaggagcctgtctaaagtttgatcaaggaatctttgtcacatatgaaaaaatggaggcccaaagaggttaagaaacttgctcagggtaatactgttagttagtggcataactgggactctgacttaaggctccccagtgatcaattaggtgtctattctacagggagcagactgttcgctgcatccactttcttgttttctgttacctcaaaagctccgtcaacacctccatcaaccagattgcttcttgtgttcttcttaaatgatgtcatcaaaaagattaagacagtgcatactatttaactatcactaagataaagcaaagactagggggttactttgaagtaatgttgagtcccaccttatctgacctacatagaattttgccactttgattactgctaaactctactgttagctaggagatttctatcttctgagttactataatatattcaaagaagaaaaagaaaagtagccacattcctttaaaagaaatttaacaatttattatttacaaaatgtgctctaaattgcatagttgttggaacttggtctctgtgatgttttcttctttgcaagactacaaccttaagtggaaactgaatttaaaatataccagtcaattcatcagtatacctttagtaattactacttatggacaatattttaggtttttgttttgttttctttttcagtttaactttgttacacagttgaaaaataatggattgtggacctcatacaaaaaaaaattgacttggcatatagctcattaaaatgttgctttttaaaatagagtcttagaagttttgctatgatatgatccacagttttccttgctaattactcaggctgaaatgtcatatttcaatgaaatattttgctgagagttcttgttattggtccctctatatcaaacacatatataaaatgtctttactcaaaccttgagttgtcttagttgggaattctaatttatttaactaattttgtggccagactctgctctaagtattgtcttgagttaatttgctgtctgtgatttagaaacaatttaaataaacagaagccaatatttagctttctgaatttcaaagtatcaaatgctttgaaagttttattaggagataatgataatgttttctatttatatgacatgccacaatttacatcatataatgtacttttattgtaagcatcttaagggcagagtttgagtcttgctcatctttgtgtttcctgtagcaccttgcacatggcagacattaggccagtattttacaacttgaatttgatctttaaaacattcctgtgagggaggttagggcagataccagtattcccattttacaggtaaaaaaccatactcagaaagattgaattgcccaaagtcatatagttattaagtagcagagtcaaaaatagatcctaggtcttccaactc

SEQ ID NO: 6808 - DNA, 1729 bp, artificial
  synthetic oligonucleotide
gttccccaaaacatgggctaaaatcacatttatgtaatcttaatcatctatttctctgttagtggactgcatacccaacacctgaccctacaggataacaaattgcttacataataccaatttatgccaaatatcttctgtttccccctctaccatcacatttcatcctgctttctgccccagagggttcctgagccctctggcttctgattgggttcaaccagttggaagtcccagcagaataccagaggaggggacaagagttgggttagggtatttattttcatggctctttctctatgaggttacctcaggttggtttgtgactctcaattgaatgtccctactgctctcaagatgacttactattcctaattatcttcctttctggttctactaaccccttctcatgttttcaggtctaggtgtgatgggtatggtgacaagtctgctgttgctgtgctgctagacctggattcctgaacaaccatttgtgattccccctccacaccatctatatatttctaattaaactctcctcagattatcctaatttaagtgtgttgtacttttgttgttgatactccaacgaatactcaacacttctagtttccaaaatctagagaaagtgctttatttccatatgtgacaaaatgagggtgaattgataaaactgacatgcatgattaagcatgcatctttgactttgaactaagggatgggccagcagaaatatgacttaacaccacttaatctaagacctagtttatcaagagttattggaagctgtgttccagggtacttatggtgaaatgaggcaaaatatgttccttatgatcctaaattatttatctttttccaattagtgtcccactggatctctaaagaatgcacttttatttcccccaggtagtcatttgtcttcctacatcttaacttcaaataattaatttgttaactcattagcagactagattacaagtaccaataactcatctctgaaagctccaaagagaaactcccggtagtattacttcaaccagaggaatctgctaagccagatatacctgcttgcagtcagtgaaaagccctgaagtgttactagctgagaaatgagtaatttattagtggttttctagcctcaagagcatctgtaaaagtaagcctgcagaagttcttcacatctgcttcccttctgttcaagggtaccagagtgaatgcttatactagggattatggaagacaggtcatgttctaaagccaaagacagcctgagaatactgtacttggtaatttcaaccagtcccacaccgaacctaccaagaagccaacatactctctcttcaagcaaaatagtttcctggttgattttcatagggccagcaaagtgcttgctgttgccagtctatcataagctacaatggtaacccccgatgtcagatccttgtgtctctctgacacaataatttgacctttgcttgggctgcaagcaaggctacctctaacacctcagtagtaataagactaacaccttatatgtatgtagttcttattaaaatatcatcctttacacatttcatctgagtctcaacaactctgatgtactcaagcagtgcaaggattagtctccaatatacagatgtggaagctgagccttggaatggttaactgaccccaaaagtcacaagttactaagttcttttcactccaaatctaatcgtcacttttg

SEQ ID NO: 6809 - DNA, 2660 bp, artificial
  synthetic oligonucleotide
ctttcctataacacctacaccagcattaagtgaatgtttggtaacttaataaaaagtgacaaataattgtgtaatttcatgtttacttcacaaaatacatttgtcaattcttgattaactatgctagtagaaaggaataatgttatcccaaacaggataatcccaaaataatttaacttgcttttgaaatgcattatgggaacttgagccacagatttgcctttataatcctattttacttaggccaatattaaaatgagtttacattcccggggcacattccaaagaacagcgtaaggaagcaactcagaagcttgctgggtggcaaaggaaagcaattcgagattaaaacttggttgtgaacagtctgcaaaatgaatattaaagggctaaaagtcataccttagatttgtctcccgttcatttttatgtgatttcaccatcagcaaggtaaatggtgatgcttgtaataatgtggtctgttttggatgtattattcccatttgatactgacaggttataaatacttaccttattgtatattcttattttcccaattaatcaaaggtcttttaaacaacaagttaatttcaccctttttaatgggtggtatactcttcaggtaatttttctctgtaatatagaaaacctcagtggactctgatgagtcaaaatatttccctactcctcctaccaaaatctggcagggaacttttttttctcaaaaacaaatgaagtaaacttttctgtttcgagttatataatgatataaacctgaacattaatctttaatacgctaataatgcacagatgacttcaatatccctggaaatttgtagggtgagccaagtaggcagttcctccagggtatttcagacctctttatatgaatcataaatatgcctctattacattttgaagtccgaaacagcagtatttcctctgctcagagaaaggtgaacctataacaatatattgttattctctcattctcttttccctttctgcaaacttattgtcttagttatcttttcagctccaattttcctggagctcaaaaatgtttttcaagggtttttgcaaattcctcactctgttcatttgacaacatgctatccctgcacccctgtgatcaactggagctcacataagcaggggcaaccaagtaaagcaccaaaaaaaaaaaaaaaaagggaagcaaagaaagatatgttgaagcatacatgccaaagatgaatgtataataatgcaattatattagttagcttagcattgtctctggagtatatgtaggtttttttgttttttctcaataagaaaggatcatcatacttttctgtgccctgtgattgtagaggaggatgactctctaggacttgataaaattaagtgctattgctcaaggctaaaaactagtaataatcgctgctagtctttacaacaccaattataccagactattatctccttcatagatcggatgataaaatacctttgttcccacaatggcaatagttttgggacagaatgctcaaaagaatctgtaagggaaatgtatgacacttgtaaacccccatctcctcaaaggtcagctcaatcgttttacacctgccctttgttagcaggccctgggccacttatgcatgtgcattccagtcttgagtatctggatacaaactctatggagatcagctacaggattttcatggtaggtcagcttctccactacttcccaacacacacatgggccacttcactctgctgcctagttactgccaacttaaagaatgcaagttactagaattctaatataggcagtttcaaatttacaaaacagacatattccaaggtcattgtttagttgaaactcagaataaattatcttgtagaaacaatgtcataaattaatggtggataggtttatagctttgtctagatatgcctatatttaacctatgcaactcctgaactaacagagaactattttgactatacccagtcatcatttctgagggaagatgtatgtgaagtttcagtttgagactccaggaatatatgtcttccagccatggcaataggaattgtgtcccccatactcaaccagttggaagagtcggaggcagggtgacagccgaagggaaactatggtaaaagctgcagcaacaataaggacttcatcatggaggtgggtgggggcacaggactctgagtgcgaggacaaggttggtaagctttcaagactggaggcataaaactttaaaaagcaagagtaaaaaatcacatttgctggtcagactttcaagggccccatggatacacatgtgagcaattttcaagattaattgtgagatggaaacttcactgttattctaagtttcaagtctataagtaggaaattattaatcataggagaaaaattatataaattgtcaaaactagctaaagtgactacaatatatagggaattagatattcggtaaatccagaaggtgtggctggcatcaaacatattgtgatcaatccaaccatgaaaatagctttaaacaccggcccagctgcttctgtgccaagtgacagtagggcaggcagcacagccttggatctgtacaacaaggatccctacaaggaaggttgcctctgcaagctaagtgcaagaaggc

SEQ ID NO: 6810 - DNA, 7959 bp, artificial
  synthetic oligonucleotide
ccctggagtcaggtcttcctccagccttatcttgctttccttgatttcccataagatatatgaattaaatgttttaactgctttttaaacctttgaaataatattcatatccattctcaagttgtcaccacaccctcttttagaagggtggggggttaaaagaagaaaatgaggcacagcaaatgtgacttgcctgtcattactagtgacagagaaaaggaacactcaaggtttctggaatttatcctgtgtaaaaacaaaaagaaaatcaacacacaaacacattccagagccaaatactgtcttcttttaatcacctcctgttttggattatttatgttttgttccccccagacattcacgttaacaattgagatttaactttcttggtaaatcacagcaaactagcacaacaacgactgctctttaaaaagtaactttcagaggagaaaattatcctccctaaacataaatagttgattattactgcttaatagtctgtgctcttattaaattcctacacttaaatatgggcatttgcagaaaagcagcttttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacataattagaaaaggctgactgtctgggttcagcaattatgccccacgaatctggtagtccttgagtagagggagctggtgtattgctctctcttttagtgaagtccatgttgacgtagtcactagagctgtcagcttctctctgctcatgtgtgggcttttgtggttttggcttgattttatatccttttgtaataaaagaaagtcggttaggtctcttagctttattctttgggggctcatgatctgaaggctttgaaggtgatcccccatctccaggctttgagaatgatccctcacctgaaggctttgaagctgcatctttggggtcccagttataggagacttctttgtctaggcccctccccaggaactttccaggtaacattggcacatactcactgttgtcattctgtcccaaaggtgagctccgaaaagggtttggtagagagaagtaggagctccaacttttggaggaagagccaccctgaggatttctggggttttttggaattgcaccggctccaggagccataaacatgtagtcactctcactgtcattgtcctttgagtcatcctctttattagtatcaggtgcttttggaggactcggagcaggtggtgggctcactctgggaaacatcatcatgtaccctcttgaatcttcaaaaggggatcgagagtggcgcttttttgaagcagagacattttgaggagccattggcatataatcactggagcttacaagaggggtggccacccctggcctcattggcacgtatgggtcatcctcatcttcatcaaaagctctggctctgtggggacctcgagctgcaccttctgggatctctgcatctttcacttctttggcttctttgcattctttcgtggctcctctgtcaacacaaaaataaagtctgaatcttcccccagacttcccttttccaccagttcctccagctggtgggggtggaggaggaggtggtggaggtggtggcatttgctgttgcttgctttgagttaatttgccaaaataggatcttttcttcagagattttccacgttcaccatcaccatcggatcctttcccacttcctgagcctttgccccccccagagttcttgccaccacctgagccatggccatctccaggtccctggccaccacctgagccatgcccacctccaggtctctggccaccacctgaaccgtgcccacctgcggtgccctggccatctctagagcactggtttcctcctgagccctggccatttgagccctgaccacctcgggatccctgtccctcgcctgaacactggtttcctcccgagctatggctactggagccttggccatttgagccctggccacctcctgagccccggccatttcctgagccccaattgttcataggcatgtagtcacctccgcttccttcctgatcttctttgccctggggattgccttcctccccaaagttgccagagccagaaccagacacttcagaagacaggcgagctccattgttcggggcttctgcagggtgccggggacgtgctgggctgggtgctaagcggcgaaaaaagctggccggcactgaaaccgctctccttgacctgcgccctctgggcaggtgcagtcttcctcgcctggagtgggccacaggctcgctgggtgttacgaagcgcctggtgaaaagcatctcgtcttccccgtcgccgatggccctgaggtggcaaaactgctcaaagcgggaccttctgagccagcctcccggctcgagcggcaccaagcccaggtgcctcctagcggacagcagggttaacaggtgggcgccgatgctgatgctgtagctgcggcagcgggctctgtattcgtctgcacacaaggctctcatcttctccaaaaacagctcatgcatgttttgggcaaccacacagtcatcgacctgcatccagagctctcccggaccgatgacagtggacctgcctacttccaagaagaaatactgctccgagtgtccacagcgacggatgctcaggagctggacgaccacgctggccacttcggtgttcagcctcacaaacacgacctcctcgtcggttagacacagccggaacacgccgctcagctcttttctgtgccccagccccctgggtttgactattacctgccacacatctttatagaagggtggctccgccgccgctgccgccgccagcgcggccggctctccgtccggctgcgcgccgagcgtgccgcagcggcggcgcttgctctcgaggatgaggcggctgagcagcaagtaccagctttcctgctccgactcgttctcggccaccatcgcgaagtattcgtcttgggtgaaaagagcaatgaggtgtcggtaccttgcatctgctcgctggctcacggaaaagcactggtatagggtgatcacgcgccgcggtggaatgagcggggggatcgcggcgccagaggcggccgccgctgctgcagccgccgcggcgcggacactgtgccggaacttcctggcattttcgtagtattccagccgagctggggcgtcagcagtctcgagtttgagcacgaagtagcgcctgtgcccatgcttctgtttccgcaggtagccgcgtttgcagacttcctccccgacgggcaggtcctcctcttcggactcggagtctgaccgggagccagtggccgtggagagccacatggctcccggacaagacgacccggtcccaatgagtgcggtcggggttcccgaggaaagaagcggggtggtcaccactgctgctagagctgccgctgccgccgctgctgcacctcttagtcttcttgtcgcttggtcgcgagtgaaggagcaactcgccatggtgatgcacgatggttttaaggtgagcgaggaggagggggaattcaggaaagggagggttgggggaagaggctgtctaccctcgtctgcccgccccagccccctcctgccttggcccgcgcccccgcccactccactctgagcgcacgacagcgggcaaaacaacacgtgaccacagcctcacgcggcggccgctgcggatcctgctaccggcgcaatggaggggcgcgagcggccaccagtagaggtgagcaagggaggagacggcgggctcgggaggcggagccacctccggctgtgccaaatcctcccggtcaatctccaggcctgtgggccaagggaggaccgagaggaggaggcgggctctctggccaagctgattctaacagggagtccaggaaggcatgagggggcgggagaaggcctggaggggcggaggagaaagcggccggctatcagggtcgggagagggcgccacagtcggggccccattggtgggaggtggtgggagggggcgtagcgcaagcagtgcctgcctgcggcgccagggtgcagagcgggcacagtcgcgggacagtttgtttgtttatttgggaagcgggagccaggtgaaactgttgcaaggctctgattggttgggataggagccaatgggagggtccggcaagaaggcagccccgaaatcattagtttggcgggagggaggggtgagaggggagaggggagagggggcgtggctggggtcccaaagtggcttcgctgtcggcttgtggcgctctcaggcggtaaacaaccttacgcaaatagctgttaatggtggtggtaaactcgtgcaaatcccagagccgtggtgacccgggatggagtcgggtgccctggtactccctgtcaatcacataaattctctgttcctgtcacagtctggttcattctttccagccgcacaaggcggcggatcgagcttcttgggagaaagtgtcggcaccccctgaaaacgggttgacgaccagggcgctcagaactgcttcccaccgctctgcaggcactcccgagcccgctgcacccctgacagaagcccgcgactctgaggcacacgaataacagcgatgcattcaaaatgaacatgatctttattaatcagaatgcacttctagcccacgaaacacaggttccctaaatacagtgtttctgcctatttgattaacgatgactatgaaagcacaaatttgggggcctgcaatgtatacagccatattggaaaaaattggactcgattcttactgaaataaccagtgttgggctgtgaaggtatttttctgtgggaaatgctttggaaggtgcctttaaaagaatctcaaaatattgctttcctttccttgagcgagaccgaaaaactttagaaaaagaaaagctcatacctagaacaaaggaccacgctgaatgcatattctagagcacatttcacatccctcgcgtcaacaagaagaagaagaggagctttgatgcatttcagtctacaagttgacatcacaaaagtaagaactactgcctccctcatttctggaaaaactgccggagtgtaagtgcaacctcctcaagtctctctctctctctccctctccttctccctttccctctccctctccctctctcccccaccaccccagttattacttgactaggattttagactcttaatggtggagatgggtcgtgaattatcaaaggagtgaccaggtttgcaaagaggaatggagggagaggaggagagaaatacagcatttctctctgaaagaatggaatgtcagttcacccttgctctagggttgatatggcaaagggtactatttataaaatccaacagtaaactaggcaatatgtatatcataaaaataaaccatatttctgccctcttaagaatttgctctgttagaaacagaacacacgtatttgaataaatggctcctttttgatgctataatttaagagaaaaagaaattggtttgggttgtcccccagatattacaaatattcaataacattccctctgctgccaatggtttataagtgcaatatattcacaggtgctggaagcagccgtggtttcggaagggagctagaggcagaacgagtgtggatgctgagagatccctgactgtgactgctacatatttcagctgcgtagtcacatatatacaagattccctgcacttacaaccaaaatgataacaaatgctctcatttgggattttgtttgatagtcattaggatattttataagtctttccaagcacaaggtttttttctttttttttttaaagagaaatgtgacaaataaggcaacatatttgaaagtgctttgagtaataacatgacattgaaaatatcaaaatgaatattaaatgaaatgggaaaatactggagatttttaaatcctcatgtcctttttcctgtacatatagtttttacatagagcagtaggcttacaatttatataattttgcatcctgttcttttcactgaacattatacaatatttccccatattattatgcatcagcataaatatcatttaaaatacaacatattatccaacacaatcgatgaatattaatgtaattaatcatctgctttggggcatttaggttgttttcatttttttcagtattataaataacatgtcaatgaatatcttctacctacagccttttaaaattcccattgggtaaaaactgagcactggaattagtaggctaaaagatatgaatatttaatacattatttttcaaaaatattatattagtttaccctgtcaccagactgattgtcagcattggacattcttatttttaaaaaattagagataagatgggtgaaacggtattccactattctttttttttttttttttgagatggagtctcatcctgtcaccgaggctggagtgcagtgacgtgatctcagctccctgcaacctcggtctcccgggttcaagcaattctcctgcctcagcctcccaagtagctgggattacaagtgcccgccaccatgcccagctattttttgtatttttagtagagaagggttttcaccatgttggccaggctagtctcgaactcctgaccttgtgatccacctgcctcagcctcccaaagtgctgggattacaggcctgagctactgcacctggcctccactattctttcaatgtgctttttttttttaactagtgagattaaacatttatatatattcactgacattata

SEQ ID NO: 6811 - DNA, 241 bp, artificial
  synthetic oligonucleotide
tcatttctatagtttgttcattacttatttttaaacatttctcatttttgtaatatattaagtatacttgctttatgttctctgtcttataatttcaagatttgaactttagttttgttttttttttttggtttgattctcttgtttcttttctgctgtcttttatggtgctttcttcttaaccatttgagcatagagacttttgactatcagtcacttacttgctttgaatgttcatcag

SEQ ID NO: 6812 - DNA, 1889 bp, artificial
  synthetic oligonucleotide
agctttaccccaaatgattcatagaaagattccttgacattgttcagcaggccaaagctggggagataagggaacagcttttatttacaaaccattagaagtacatttaaagggaactttattggaaagtcacttgaaatgctgaacagggtcatgaagctatttccaacaactattctgaatttttatgcttttcagctcatacaaacaccatgcatgggaaagaacacaaggattcattagcagagtctactgaatggggtgaagctactggattcaataatagtgatgcatacctggcaactttcaaggcaaagtcagatgaaagccgttgccttcaaatttcaaagggaaatgtcctatggactgttggaggtgagaatatgatttctattttacactttaggaagatgaccatgtccaggtgcccccctttattcccccaaatgccaaattaacatgatattttaatggtggcataatcaaattgtatgtgatgcagacacagactaatatttttcagaaaaatatttgttcttttgttttctgctttaaaatgaagctaagctgcattctaagtgtgtttttgttcatattgaggctcttatcttttctgtgggtatattcactttagactctaaaatgtaaatcaacaggaaaatgggattttgtttacaaatttatgcttacaagaaagcatggataaatctgtcaaatgaccaaaggaatttataaaagagtacaacaaaggtagttaagtatacaaattgaagaattactgaccaatgaaattatttggcatccccttttactatacattttcttaaatgagctatatctaatttctggaggtagtcctatgcttgggctttaggattagaatcagagacattctgagtagaaagggaacttagagtttacctagtccagtaattttttccaaacttattttctttaaatttcttcaatcaaaatcttgtttgaaaactcaatacagagacctggtaataggggtgagtttctaattaaagtcggggttgaggggcttgaagcctacctaatccactcccttatcactacttccctacattttctgactgaagtctacagaaactaagtgacttggccaagtttgcccagtgaatgatagtggatctcctattttttctttaattttctttatttccattttctattctctttcacctccaataacacacacacacacacacaaacacatataacacatgcatgcacacaccattctaggtagtcagaagaaacttctgcctctcataagccactaatatctcattgagaacatttgcattttcaaagagaaaagtcagaaggaggcaatgttgaagctaatgaaatgagtcactaaagatagcatgacagaattacggcaaattttgctgtgtgtgggctttctcaaatcatactttgtaagcatcctcatctttgtccaatatttaaggatagctctgctgacttatttaaaaataatggccttggaaaaaacctcagtagcaatttgcatttagaccatcattgtcttgagagttgaacaagcagaatgagggtgaaaggtgttcctatgcttatctagcaagcttccactttactgcacttctttctgaatcggtgcagtgttccagaatatattgctttgtttcctctatggctaggagataggcctaggagacaggcctagtgagtaagtgtggtgtgagaaagagacagagacacccatggaaagagataaacacacaaagacacaaacacagacataaatagatgcacactcatatatagagacacacagtgagaggcacataaacatacagagagggagataaacatattcatacacagagaaagaagag

SEQ ID NO: 6813 - DNA, 1822 bp, artificial
  synthetic oligonucleotide
gactccaattaaatgtgaactccacttacccatctttgtccactggtgggggcacaggaaggggcttcatgaagccttttttcccaatcagccagaaggtttcctctgtgcctttgcccttattatagaaaacataaaaaatcttaagcctgctataatcaattttccaaaagaatataagcattcaggttggctcagaaattgcctcaccactccctggagtcttcctccctacggggctgagccagagcagccagatgaaaagtgaacactatatcaagctgtcatccagatgttttgtctaccgccaccatacagcttcatcattgggaatgtgtggatgtttggcttgacagcaaccaaatgtctggatgctcagttgaagattttgcttatcatttgtgccctgatcttttggcattaggtaagccattgtcttctgtatctagagtacatatattcagattctacctacccgcttaccgtctcattcaatggctctcaccaaacccaaaaagagagtagaaatggaaaacaggctgttaaattttaagcctaaattatcctggctattttgagaggtctacatttgtgcagtgttcttttcttccagccaagggactcttacaggtagggtaagactccaggttggcctccatctataggtcagttacttggttgtcaagaaccacaagtctcagaagagaaaaggagtgtaaactcaagctagtcaccccagggcctgagtgatgacctcagaggagtcaaattttctgcctctgttctgcctttctctctttccagtaaactttcctctcaatgtgcttctctctcctcctttcaattctctttcatctgttctctcatttcctctaatccataagaaaaaaatgtgtttaccaagactgagaaaagtaatgggatgtgtttccaactcattaatctgaaatatggtctcactcacagcagctctcatttggagcagttctgaattgtttaacttagaaattccaattagatttacccctttaaatatcaagtccactgttccctattttatatcacatatatttatcccttaacaataatgacaaaaaccataataattagcacatttaattggagaatctcaaagcattttgcaaatatttgattcaaggcttgaacaagccttctatgaggcaagtagaaagagcataccactatagtccaacctccattaactggcatcagactctccctaagcctcaaatagttcaaataattggactatttgagcccactctgttttcagaagaggtaagcaacttgaaaatatattccatcactcattctttcatttattccactcctcctgtactagggctgggaatacagagatggttccatccttaaggaactcacagtacagttaaacacaaccattaggccatgttataggttctaaacacatgaagcccaactcctctgattccaaagctttttctttttacacagtacctagtgtagtgtcttatacagacagttgcccagtaaataatcagactgtttcattaattgaaactctcagcccttgtgcacttggaatactcaagacaccactggatcttattttggaaaaacatgctattaaagttcaaactcaagggccccccaccctcagccatatttgactgtttgtcttgagatctagaggctaacagaacagcatgccaatccccaagggagctttgtagagggattgtccaaagatttgggtgggtcttaggacacactgggatgccaaaactaatggttgcaaaagaggatagaagtgttatgg

SEQ ID NO: 6814 - DNA, 1675 bp, artificial
  synthetic oligonucleotide
gaacctaacctgctgcctcttggagctctcaacagttcaggggccgtccacagcagctctaaaaagaaagcattgtgtaatgaatgcagggaggattaactgacaatatctgcaatgccctcaagggctcagagggtactgttttattgactgccttatatttttattagacagactgccatgctagtgccccccatcccccagggtctgaatctattcttctaaggaattatgaacagagaaaacatactactctctccaccccaggaccacgcaggcagacacagcagcgatgtgggaaagggcacagaagctcaaagtatagaaattctctggtgcttgctttcttgagcctgcaagtagcagttggcaggtttccagggaaaggcaagtgtgctaccacactggttgccatggatttgctgtttgctgagatctatatgtgtctggtaatttgattgtgctggggctaagagattcacaagttgctttctccaggtctcctctaaaaggattagagttaccccagccttcctattccttgcagtgcaaaaaggtgcaacaattccttcaactcagttctgcaaatatttattgatggtctactatgtaccatgccctgtgctaggcacagaggtggtgctagagatgaatcaaacttgaggagttcacagaccagtcggaaacacagacatatgcacccctaactgcaataaaagagagggaatgatgagggccactacatagtaaagggaaatgaatccattaaaggtcaaagttaaacacccattgtgtgctctgctgcatttcaggccccgtcagggacaaaacattatttctgcattcagagtttatggcagtgagaatgtcagaaatttttcttgggtggggggcactgtaagcaatgtataaagaaatataatttaacaatagaaatacagtactcaaaagctggaagaagagtgttttagattgaattatataaagttaccatttctgtgaatcaaaaacagttagatattggcaatttcatcaggttcaaactaaaaaaaaaactgagctgatcaaattaatccaggaagacttcctggaaaagttaaattttaaatgtgcttgttaggaaggtcaaggatgcaactttctggagctgagaaggtaagggcttttttctccctagaaagaacagcatgtgcaaaagaacaagaggcagaaaggagcaaattgcgggtggggggatgccgggtggtggtaagcagattagcttgactgaagagaagggctctgttaaggaataatgagaaatgagaagtggggttgatgaagtgggggagggcgggtgtctggaagaatgggggcagaaggtgagaggccctgagagccaaatgaaggcatttggagtgaatacaaaaggcagtaggggtgctggagctggagagggatttgatgaaagccctgtttgggaagattaatctggcaacctgcacaagctggattgaaggagagaggctggaatcagggagatcagctaggaagttattgcagtaagagcaggtagtgaggtgagaggggcctaaatgggggtgggggtagtagcagcaacacagtcaaccagatacactggaaggctacaatggagaaggaagtgacagggctaaggataggctccctgtgcctt

SEQ ID NO: 6815 - DNA, 1550 bp, artificial
  synthetic oligonucleotide
aaaaagtccctgtaattgaacactttcatttttgcttgtccccaggcttgtcgttagaaaagtaggggactttcctgttgagtatcatgtttacaaaagcaaagtggcttttaaattttaaactaagtatcaaacaagtagataaggtggatgggagggatcttcaggaactgaagggaagtggaacttaaggttggaacatcggtgtgcttttaacgacggaccgagctacttccgggagagaatgggagggtggaaaattttgtgcgtttggcgggtttcgctctcttcataagtattgatcattccgcagccctgcggaccggacacgtgaggaggtagtgacgccgacactgccagaacacactgctacaaggtcccagatggccacgtctctggtgagtgcctgggccgtggcaggacggctgggcgccggactccagtggctgagaggagggattccggggcggtctggctgctgctcacgtggataggtgacgaatcacgtcccggctctctgcactgcggggcggggcccacgctttgctgcccgccctgccggccccacccccagcctggttagcagtcgctttctgatcccggaaaggaccctgagctgggaaatagcgagaggcggggatgttggggtttgttgtttatggcttgcagtttctttctctcgattatcttcctctctaaaaatcactttcagtcacctgacaaagaaactggcgattcattgttcttaatttagtaatagactgggccccgtacatgaatgagaaggaaggtattccttaattctccggcacgaacgccaacagcgttgctttcttcggtgtcacagttcttaggcaaacagcagtgaatatttacgcaatgtgggaaagtttcctaagtggagctgccggtttttcaagtagttgaactactttcgtgtgtgtgtgtgtgtgtgtgtgtgtgtgtttcccattcatcaactttggagtttggctctaacacctcacttgaaaacagaaaacaatttcctagcttattcagtggcagtttttgccgctctctctccttttctaaggttcaggtggtgtcattttcattgccgtgaatgtttgtaaaatattgaaagtctaaagtgcttagttgccaagaaaagattataaatttatatgtggagactgaaaaagactcagattcattgagaagattatgtcctaaagacatgcacttaaaattagtgaaaaattttaaaattgcaaacttcagagtccggcctttaaaatgtctgaatttatatgaaagaatgtggactgtatatagagctacatagtggttgaaataaatcatcagcttctgtcagtggttttgtgtttgtgaggggttgaaaaggttggtaatctatacttctggaatttttcttgtaggattttaaaacttatgtagatcaggcatgtagagctgctgaggagtttgtcaatatttactatgagacaatggataaaagaagacgggtgagtgttatagactctactactctttatagactactactc

SEQ ID NO: 6816 - DNA, 2333 bp, artificial
  synthetic oligonucleotide
gaataaatcaatacaacacacacctctaactttacccatcattggttaagattgctcagttcaagaattttctctttgacttcagatttacactatttggtggcttccttgtcttttaataagccacttcaaaaaagttattggctaggtgcagtggctcacacctgtaatcccagcactttgggaggccgagacaggcggatcacttgaggtcaggagtttgagaacctcctggccaacatggtgaaaccccccgtctctactaaaaatacaaaaattaactgggcatgatggggcacatctgtaatcccagctactcaggaggctacttgggaggctgaggcaggagaatcgcttgaacccaggaggcagaggcttcagtaagccttgattgtgccactgtactccagcctgggtgacacagtgagactctgtctcaaaaaaagtaaaataaaaacaattattaaggtggcttctaaaaattaggtttgataatagctaaaagggatgggccttaaaggttttttaaagtgcatcctgaaagactgcattgtgatctttgaaagtgcttcagaaataagaaaaaaggagggataagtaataaagtaggtataacttttgaaacacttgaaaaaacaacccatttagccatataaacattttcttcacccataatcacacatatcaaattggaactggttacatagatataaatatcacaaccacccaacccccaaatccaaacatcatttccaaaagcaaaagaaaaaggattccttctccatatggtactgggtcttaaggctggaatctctgagagaagagtcttgcgttattgtttaaacaacctttattacctgcctctgacattccccagggttacagagcagggggcatctgagcctcaagttccacggatgaagcagacactgcaataacaactgaatcaatagaggagaggcatttggaagtactggggtgatacacccagtaatggtaatcctcagcagaagatggcatagctaccaaaaatcaggcgttaccactgggatgaaaactggggaggcaagaaaatcatacggttggagtcatagatcatttccctccccgttgagcactcctcccccttccgtcccccattaagttcattctatcccacagactggtcctagtgtcctgctagctccctgctgaaagagagagggagggaaaagatgtctgaggtctcttcatttcctttgtctctgtccctaaggcaactggaagctggagctgctgcagtcggcctggcaagcccgttggctctgcagagtgagcagtccctggcagcccctggagcagctgccagttagacggcccagagttctgatagaatgcattgcttcagttcagtgccaagtgttggacgtgttggattcagttcccagagggctggagcgtgctgtcagggctgtctgaagacaagagagcagaggcagtttagtgcagttggatgtgcggggtaggggtggaggcgcaggggtgaagagggagaaactggcccgaatgggtaaggtggtgcttctccttccagggccttccagacaaggtctcctggcctctcaccattatctgggcctcagatgaggcgaaccctggaagggagttgggggtggaaggtgggaggcgcgcccagggatgagcgagatgaggagggcgcgaaccagcaatctggggctgtggttttagacccgctcagcgccctgggcgagggcaggcagcccctcggaggcaagctggcggcggccctcggcctgggagcccgcggcagcctcggcgtcggcggtcagggcgcctcccggggcccattcgtgctcggcgcaagcctgggacggctcgtccttggcctcgacgagcttacgggagcgggtgtaggccaggatgaggcctccggccaagcaggcgtagaagatcatgatgagcaggatgtagagataggcgtcgtcgcccttggcgctggtcacctcgcggcccacgaaagggtcaggcacgacccccatgcccatgctgggacgagggccagcgcccaagccgctggcattaccccggtggtgcagctcgagcaacaggcggctcagaagggttcgcagccgctggctctcgctgcagttcatggctttcggggagtgacacggcggctccaggacgctgctgacctttccccctgggcgaggggaagcgagctagcgagcgggccggccggcgggcagggctcagcagcggaaacagcggtagcacccagctctccggcgagcgcgcagtggctgggggcgccgacggcggggcctccttat

SEQ ID NO: 6817 - DNA, 596 bp, artificial
  synthetic oligonucleotide
gtcttcatgtctctgaacactccatggtgaaaacacaatagacattggagtgcacttgtgcctttgctttggatgaagtcagaatgagcctcttgaagaatgtgtgggctggtagaaaaattaatatggacaataatcatatatggaagtttattgctgaaaattgtcttgggatgataggcaagtcatagctatattattttaaatgatacaaaacaaacacacctgagagaggactttttttcagactaccacagggcaagtataagcaagtgaaacctacggacctaaagccttttcttggttctagaggtgtgctcacattcctctgggatggtaaaacacacaggaaggtgattcagagcttccttcaggagattaatgcttcaaaagccaaaccctctgggcaagcaaactttcccttggtcttcttggattttcttctttacttgatgctgaaggcgtttcatgtactaattaagagatatttatcttctttttaattcaactgaaaaatacctatagaaaggctatatcaagttaacgcctatcactgaatagacttaatagtgttattttctcttattgaaatgtac

SEQ ID NO: 6818 - DNA, 1032 bp, artificial
  synthetic oligonucleotide
ctttggttcctctatgactttttactgtactcaatggagagaagtgctcagtaacaaccgagtccccagatacaccatgacattgcaagagaagatgaaacatgaggaaatccacccccttcccattttccagaccacatcctcctcccctgttcaatctccctaaagttttcactaggcttgttcaggtcaggaatgaactataaccagtggatgctgccctctgctgcaaagcaggcttcatccgcggctgcacagccagtcttggcttccacaagacctctcttgtgttaatgattcaaagcacatgtttgtaattaaaaataacaataataattcagggtaccaggctgaccacgcaaatatagttatcctgagaggggggcttgcagaacacctttcagggcaaatcccccaccacctttacataggactgagacagcctagaaaagtacagaatgctttactgttattttcctcatcctggccccatgcactaactagacacagtctttccagagaaataccaacatgacacaaccccacgggggcattgggtccctctgttctggatttgcctccttctgcttcacttcagttgtcttaattccattcaccttggttctctgagccccggttgacacagcacactggctctctacgctcccctctgtctccttctgctgccatgccctattgtagccatgtccttccatctggcactcagaaatctttcccaaatgtcattctgctagtctcctgacaccttcacacaatctgcccatcctcttggacagagctgacatggtccccgaggctggggatgctagaggccacctagtagccactaggaagcaatgcttgtactctgtgccctgtgcactcagtgacaggcaaggaggctgtggaactattctcacaatcatccggacctgtcttctcaaccccattggtgctgccacctaagagattaacaagggaggccactagactcagattgctcagatacaattataactggaaacattgggt

SEQ ID NO: 6819 - DNA, 5829 bp, artificial
  synthetic oligonucleotide
gagactcagaaagtacttacggaatgaatgctggtgtcgaatgttttgcatggtggcagaagcagtaagcagacagtcaaattaagacaaagacttctccatcctccgtacatatgcagtttatttttactgctaacacttcatataatgttgggagtgtgcattgttttttgcttgtgaaagatcatgtatgcattcgactctcaggttccattgtggacagagtggtaggagttgattcaaagaataaagtgcaggaggagaaaaggtaagatgatgaagtcaaaggaacgagcttgctctggctcctactgttgaaagatcactggaccgggagttagaacctcaagttctagtcctcactctgccactaacttgtgtgaccttaggcaagtcacttcacttgtctgaacctcagtttgtctgtggtacaacagaggtaataatttctgacactttgcactccacagtaggtcagctgtgttcatagctgggaggcactttggccaaaagaatttagagcattgtctccccagactccccagatctccaagtcaggtaggtagattatctttctgctttaagattcaaaccagactgggataaaaaggtgggaaggttgagttcgtagaatcatagaagattaatgccagcaggtattttagagaccattctagtccaaccctctcattttgcttctgagtacacagaagcacagagagattattttccccaaggtttcactgaaccaagcctggattctgggttccgttttcactgttgtgcttcaaggatctacttaaaaagcaaagttgatttgctcttgttactggttggcgacaagaaagctctggcctgtatcccagcaaagatatgatcaggacttttgcctgcagcttttgcagttctaaattcaacataccatttcacctcaattattacctgccttttacttatggggacaacaatctcctagtgcttatttagtgcctactaggagtttgccactctgctaggtgctgtgggtggggtttagaaaagattaagatccattcccagctctcaaagagcctggtgtgggagacaagagtcacaatgagagaacaatggaaggcagtatgtgattcagaataaaatgagtagtgcaggcaataaatgctgtacaagttcagaggaggaagagagctccaggagctgagggagggggattggggggagtgaaattttacgtgggctttgaaggatggtaggattgtttatgcaaatgtgggggagggcgctgaatttgaggttgtgtgtgcgtgcacgtgcttgggtgtgtgtacacatgcaaatgcagggatgggtaataatagggagcacttagtgaacactctctatgcaccagacaccaccttatggtccccaacattcagctcatttgactgtgcataacctcatcaatttgataatagtatctttcaattaatagatgaggcaattgaggcacagggaggttgagagtaaattgtccaaggtgacacagcaagtaaataatataaatggggttagattcgaatccatatcctaaaaacactttgttattctacttgtaaacccagaataaaattttaagccccctaaatgactgaacagacacaccccccaacacacaccccctaccttggctaagaggacctggaaagaaaacttgaaaaactagctcaggctggccagatgcggtggctcatgcctataatcccagcagtttgggaggctgaggagggcagattacctgaggtcaggagttcaagaccagcctggccaaaatggtggaacccagtctctactaaaaatacaaaaattagcaaggcatggtggcacatgccagtagtcccacctactcgggaggctgaggcaggagaatcacttgaacctcggaggcggaggttgcagtaagccgagattgcaccactgcactcctgtctaggggatagagtgagactctgtctcatggaggttggacttttttttttttttttttttttgcttaatgggtataggaattctatttggggtgatgaaaactttcagaaatagagtagtgatggttgcacattgtgaatgtgattaaagtcattaaattgtacaattaaaaatcgttaaaacaactaggcgcagtggttcacgcttgtaatcccagcactttgggaggacgaggtgggtggatcacttcaggccaggagttggagatcagcctggccaacatggtgaaacactgtttctactgaaaattcaaaaactagctggacatggtgcatgcctgtaatcccagctacttgggaggctgagacaggagaattgcttgtacccaggaggcagaggttgcagtgagccaagatggcaccactgcacttcagcctgagcaatagagcgagactccatttcaaaaaaaagaaaagaaaaaaatagttaaaacaacaaattttatattttaccacaataaaaaatcattagaaaccttgacagaaaccatcacaaaatttcccatgttcaaaaaacctcaaggacattcttcattataccccctctctttggagtttatgcacaattgatcagcattcacattaaaatagagatcataagactgacaaaacagactcttcgtgacaataaaataccaaattctaacctgaccctggtatagcaccacatgacagaaagcaggccctgaaggaaatcaaagtattttaccccaaaatacatttctttgacatatgttgaaatggccttgcaaagctatctcttgtggagaaaatctacattctatagagaatctccttccctttccaggtcctttcatgatccaggagagatttaactaagagtcggacacgttttaaggtccaataagagattttacatctattctctctgaaggttgctacctgtaggcttcatctacatagcaagaatcttggcttccacaatacccgttatcttaagcatttctttctgctgacttcaactctttactttaaataaagcttaactttttcgaccagttgctagtcagaagtctttgaatccacctatgactgtgagcttcccccaaccacctgagatgtcccgcctttccaggctgagaccaatgtataccttacatgtattgatttatatctttgcctgtaactcctgtctctctaaaatgtataaaaccaagctgtaatccgaccacctcgggcacaggatctcaggaccttctgaggctgtgtcacatgtcatggtcctcacatttggtgcagaataaatctcaaatattttacagagtttggcttttttcttcaacatgcctgtgaaaaaggaatttatggctcaatttagaaaactggcctggctacagtcattattaaccatagtcattgttgcaaactcgggacagtctaggccaaattctcaacagaagctcagcatggaaattggagggattactgaagccattggctaagtgctatatcctaattcttgcttccttgaagatagcaacttgaggttttgggatgctgtattccattgctaggtgctccccagctttgtccttaatgttccttggttatgttgctgaggatttaacaaaacacttaaggagaatgaactagtgagcctctgaatcaagccttgtttgttgttgtttattaattggcacttgtattactggaaagtggtctggatgcagaccccaagagagggttcttggacctctagcaagaattcggggcaagaaagaatttggagtaaagtcaaagcaagtctattaagaaagtaaaggaataaagaatggctactccataggcagagtagcagcttgggctgctcaactgataattcttatggttatttcttgattatatgctaaacaaggggtggattattcatgagttttctgggaaaggggtgggcaattctcagaactgagggttcctccccctttcagaccatatagggtaacttctggacgctggtgggagtgacttttagcatgctaatgcgttataatttgcatataatgagcagtggggacgaccagaggtaactgtcatcacctttttggttttagtggggtttggccggcttctttactgcatcctgttttatcagcaaggtctttgtgacctataatcttgtgccgacctcctatctcatcccgtgacttggaatgcctaactttttgggaatgcagctcagtaggtctcagcgtcattttatccaggccctgttcaagatggagtcgctctggttctaacgcctctgacacttggagaacatcaggcctatggtagatgttgtacaaaacttggagtcagacaaggctacctggctgtacttgttcggaaaaccagacttggaaaaaacgggagggcgatggcctgataatacagtagattgcattttatgttttgagcctggcttgcagccaacatccaaaagtgtttcctaggcaaggtgcctaactgtgtttttctggatattcttctaactcatcgtgagtcttcaataaatattaaataaacatgaggaaggtcctgagaaggtccttttactgacccttgtctcaagaaaagcaaatagccgatcggtaaaaagcagcaggtaggaagaggggattttatttccgtcagttgcccttatccaggttttgggcttagtgctgctcctccacactcatatagtcctggctggcttttccacgcataggttaggaagcaactgctctggggagggggaaggggggaagagggggagggaaagaggtcacgggaagcctcccttcctcccactggcctaccattgaaggcctgtcaggagaaaggagagaagtgggagagggagagggtgtggcaggggtggtctgtgtggcaagaggtagagagaaaatagtggatcagagcaggagggggaggagcagggaaatgaagctcctgtcctaggcactgaagtgtggagtggggctgtggctagaaaggggagagaagatgcctttctggccttgcatgagtcgtggcagaaaggaggaatcgcgaagaggagccggccatacccagcacacaccccgaagccaagctgctcattactagaaaggcttattcccccacaagaagttagtgcgggccagctaagtgcctactatgtgtgcagtatagaaagaagtgccctggagaaccaggtcgcgggaggcggagccagtcaacagggcttcaccgagggggcgaattctgtacacggttgtgaaggagggtggctgtgcacgcgtgcaggctccgagtgcagaagacgaggcaggccagggaggaggcggaaggaggcggagcctgagccggaggagggaggaggagggaggaggaggagggagagccgaagccgcggagggtgggaggtgtgaatggtggacgggtgaggggagtgccagaggcagaaaagggaaggaggcgaggaggagtagtcgtggcccgagggcgtgtggtggggcgagagctgaactggacgggaggagggaggcagtggcggtggcagcggggagggggaggagagagggaggggaagaaggaggaagcgagcgcggctgctgcagggggaggaagacggggaggaggagccgtgcgccgcggcggcggccgccaggggaaccgagcgcccggcgcggagagcgcgggagcggagcagtagcccgatccggggccgcgggccgagctgccggtgagtgaagccccgaggggcgcggcggccggtccccggggctgggcgggaggcgcgggaggttgcggcgccggggaggagggaggggggccggct

SEQ ID NO: 6820 - DNA, 238 bp, artificial
  synthetic oligonucleotide
tatacaagtaaattttaaaaatattttcccccttcttcagacattcatcctaaaatagcaaatacacaaccatcctgttgttactgttttgcttagcaatatttcttggagagctttccatgtgagcccacaagaagctccccctttctttcttttttttttatagtggcataatattacattgtgtggatgatagaatacagtataataaaaatggcagagctttgacataagacaa

SEQ ID NO: 6821 - DNA, 1907 bp, artificial
  synthetic oligonucleotide
ctgtctttattttcaaatatcctttgagatgcgtttagaagcagaataccagaaacatgaatcaaaaaggataattgattacaaagtcatcacctgagcatgactaaccttttaacgtactctactataaaacctctgcttcatcatctgtctcagctgaagtttttctttttttctcagttgttactttatgaaaaaggtccccttgaccaaaatacatatgtgttgctcttctttaaaatccctgcagattagtcacctttggcttagatattagttcagtctccatgaaccaattcttggcttttacagagcttaccaaaggactaattagggccaattttgatttatgtaggagacagactacttgtctatcaggaacaaaagcctgccaacttatttcacaaaagccactgaacaacgatctggtaacatttattttaatagctgacacacagctttaaaatacctgatctctctaatagtcaccatgaaattttagtaaaattttaaataaagtatggctaatgaagaggtgctttgaaaaactctgaagccaaacatgtttatatatcttttgcaatgaaggaaattgatcttactctaagattttgcagagaacaagtgacagctcagagtgcaattaaggggaaaaaacccccaattctctgtaatgattaattataatgagcatcccataaaaacttaacatcctaaagcttcccaagaaatgttcaggcagcacaggtgacctttaaataaaaagcgtgctttctatcaaagttagaaaaatgcattccttccatttcttaaaaaagggaataagggagtgaatttacagacaagaaaactaaagttataaaattttctcaaaacctagagatgtgacttagtttactttccaaaggctagtggggacagggtgggcggggggaagaaatcacctcctagcaaacatgcctaatatgaaataatgctgtttgcctaataagaaattaagaaaaataaaattgtattcattagaactgtacattgagtatctgactcaatacagtttaacttagtctacaaaagaaatttgttcctaaaaagttacatgtgggttgagtttacataaatgaattaatcttaaagtcaagaggaaaacaataacattctatagtgagttcttctacaaagcaaaatacgtattcataaagtgaatcgctccctaatgtatttgcctaatttagacttaaatatataatgttgacttaaaacaggatgatacagtaattaaatggagacattaatggcttagagcatttttcttcctcaagggaattctttttgtgaacaggaaatctagaaggtacaacttaaaaactggactgtttttcacgtttgttgcctacatttaacttggcaatggccactttgaaagttagggacctcttcttaagacttctaaatggctagtggtgattcattctctggacaatgaaacagaagccatcttttaaaaaggagtatgtcacagaatcatattctgtcagagtccaaagagatcttaggtatcacttagtccaacttcttcaggttcctgaagaaactgaggcccagaaagctcacagagctgggcagtggcagtcaggaacagaacccaggtctccttattcccaaaattcagcattcttttaattaaatgctggggacacacacacacacacacacacaggcaaatcatacatgaaataatagctataacaaaagtactagggaaggggcagggagtttatggaattctggggaagcagcaggctaacttcctccaaccaataaacatgctgcgagtaaaactggagacaacttgaggcggcctgagaagggactaatcagcagcgcattttgctaagagaaccaacagc

SEQ ID NO: 6822 - DNA, 2148 bp, artificial
  synthetic oligonucleotide
ggacttacgatgcaataagtgtttagcatttaaagatcaacaaattgttatcaatgatgaaaagtaagttttttccaaggactactactttggataaccacatttaaggcagtttgaagtttgagagaatgggaaagatcacagagaagggcttcatttcttttgccttctacttttaaaaagtatttctcatgctcataagatcataactaaaattttaatattcaattgctacaccaaaacctcaactttcaattattttaaagtactcaaattcctaacattgtccccttaaaagtggtaaaagcataggatttgcatgataatcacctttagttacatcaaagcataaccatcttattcttccagaacactaagatacaaatctgtcctcctgttcattcaggtcctaatgactcaaatactttagacacttataagtaagcccaacatttattatgtaaatattcagacaaaagaaatatatttttaatgtctatagtataattttaggccacatccaatgtaataatttcatacaatatttgtgttctaacttagctttaccatttcagtcattcatctgaaaaaatgaagactatcgcagacaatgactctcaggaaaggagacagatatcagtttactgtactaaaacaaaatatgaattcactttaacaagacaagaggaaagtgaaatctaaactataacttttaattttcttcatttgccaagcatcagagctataatccaacttggttctagctaatgtttggtaaactccctgtgtatgtgtgcatgtgcatgcacactcttaagagtcctctatttcaaaggctttttcttctatgacaagatcattttcccctttaaaatatgtattacaaatttcttaaaatataaatacccaacaccttgtatatggttgctttgataataatgatttacacgcatccctataattttgacctttttggaccatgtaggataaaaacaagccagaaagtggtacatactgttttgcttttataaaaagtgaactagggatgaaccaaataaaataatttatagatacctttaaatacattttagcttttataacagatatagagtagtaatcatccagtatcacgtcctctgcttcttgagaaaaactgctttctacctaggactacaattatttcgataacttcttatctctcctaatatatcataaactcctaaggcaaaattaagacaagatttgcaggatgaactgtttaaacatgattaaaaggggaaacagcctcgaaggaccagagaggtattaaactttacagatagatgtaaaaatagggtaaatttcttatagttcactctctccctatcaaacttaagaaccaagagccctggtgctgaaaaagcccattttcagcttctctcaacactaccttttcacagatggccttttctgccccaggcattttgcctgtggctcttaatcaaagcagcagggagattccaactggaaactctaaagatctaaatgatgtgataaggaattagaatctgatatactcactacacttaatttctgtggcagtaggtgctatatgaattcagacaattctctacaattcaggagccattacccattctgcaaatggttcctgctgcttagtttccacattctgctgggaattttgtggctacatctctgcacattagcacaaccttgggataacgaaggagtgcattaacctcatggctaaaatgaggattccagtttgagcagatagttcaccatgcttcatgtggataattttgagtaaagagcgtacaacaacctaggttccaaactgtaccttaaattaagtgcctataaaatctgacaaatgtttctcattttgtaattaataaactgaaactatcaaattaggtataagttttaggactcaggccatcatctcttttataaaaaggcaaaaaatgtaggttgtaaattaaactaattaattttgcattgtttgtgatacatctaatttatttccccaaaatgcatactttagccagaagtcttgccacaaccacttgccaaaaattgtttggccttaacatctccagaatgagcttccataacaataatgtacagtcagaggtgattcataca

SEQ ID NO: 6823 - DNA, 936 bp, artificial
  synthetic oligonucleotide
gtgctctcccggcactgcatgtggctttgggtaacaatgtggattatctgtaaaatgaaacagatagggaaaaggcaagaatcatcaagactatcacagactttattgaaaaaaactagtattagtaggtctttactcaagcagaacttttcacttttgcccatccactgaagatcgcaaagatcctaaagcaatatggctgatcccatcagttcataacatccatccttcatcattgagcaaagccacaaaacagatccagcttgattcaatctattttactttctaagctttaggacacacaacctagaatcttgtaccaaaggcacttctagtccttcaaaaatttccctttagttctgaaattatgaattcctgagatggcctgccacgaggctttatcttgctcaaggctgtactatgatatacacataaggaaataaaaggatcactgcctgctttacaaattgataagcctgaagactaagaaaatgtaaaaacctacattaaagaaacccaaaattctgccaggtatttttactagcagtacaaagctgaaaactatcactgatatctacttatctgagccattcaaagtcacaaagtgggggagtgatcccaaggggccaactaaaacatcacaatagctctgttgctgctctgtggttctggtaattcaaaaagaaataacatttgataactgccaacacttggaactacacatagtaagaaatctgatttcacctgcccaaccatttgtttcttcccatattccccccatgttttttaatggcaccaccatcctcatggttccccaggcttatgaactctgaatcatgttcaaagcctctcttcttttacttctgccaagcaaccagaatttgtttttttttttcctgcagtgcctctccatgcacatgtagtcacctaatcaca

SEQ ID NO: 6824 - DNA, 1889 bp, artificial
  synthetic oligonucleotide
gcgccagaggctggcggggcgcgcgcgcgccgctcccggccccgtctgcctagccacgcggctgccccgcgcgcgcccccgcctcggtgcgcgctcctcgctttcgcggctgggcgcctcgcgcctgtcccgcccgactcgtgcctcttctgagccgcagccccagccccagccccaatctcaatctctccggccggcagaggttggaagacaggaagccgattagaaaggaaggtgaaggaaacaagagtcagacagcggaaagtgggagcaaagggagaaggtgggcacgcccgggaaggaaggagggaaagggaaactagtgggggtaggggggaagaaaggagaaagtccgaagtaagcatccaggtcccaaagcacagctcagtaaccccccgccgcaagcagtattaatgacacttaagcccagttacgtggaacctgagccacccggcctcaaatacacgggtttctgaactgttggagtgtgagcgagcaggtgcccagagctccatacctgagaccgcccctgtaaagtgtgtacaaagcaatccaggaaatggccacgctgctgtctttttaattccagcctaagcacacaccagggtactctttcctttccttatggagaaatattcaagtccgactgaatctatgtatcttgtacttgttcccccaacttaccctccttgccccgtttaaacatttaaaagccaaaaataaagtcctaactaatacttcactggttcaaagatactaattgtgctttgggacttgcagtggtggacttttctggttttggtttttatttcttggcttgggtacaaagcaattaggaatattatctgtagtgctcagatcttagagataaatagggaaggtaatgtacttagtcacaaattgaaagattttgttcaagtatataattagctcttaatattcatttttaaaatttctcaattaaatgcttggatggatgaggagacatatgagtcagtccctttctgggtgcctaagtgcagcttaataataaaaataatgacaataatcaaatgttaaaattcgtagaaatgaacgtgatagaaatagaaagcgtaagttatttgcattgtatctacaccatgctaaaacatctagataaagtcaggtatctgcatatttaaaaactgcagattgatttttgtcaccttttttctacatgcgtgggatcttgcagatagctgggggctgttcattccactcagggaataaaaacaaaacaatttattcattcagtaatattgagcctctgcaccatactatgtgcacaacactatacttctgttgaaatccagggcgtactcaggaagtatgcctcccgctctaaaagagtttatgaattaagtcagatacatgcacataatcagataaatagctattatagtatgtattgaacactttttaggtctccaataccatacctcgtcctaccccataatccttcagaataagatactatctcgttttatcttcacaacaatgctctgaggttactcattaacagatgaggctattaaacctcagaagtaatttgcccaacatcacacacctagaaagtaacagagctaggattggaatgctggcatgtctgattccaaaaaccatgccattatactacattgcctctcactaacaatatatgataacaaggctaaggatggacaaaagatagtgacattacactccagcaggtggaaccgaggttaaacagaaataagaacttagtttttatggaaagattgagagacactgaaatatgttaccaaggaaagatgaaaaatctccttccaaaaagattttatgagatagatagatgaaaatctggaatggttagatgcagcctaaagaca

SEQ ID NO: 6825 - DNA, 2633 bp, artificial
  synthetic oligonucleotide
tgatgatgatgataagaataacaactaatatgtatgtgccaggcatatactacccatcttatgacatcatttcagtaatctcatgttatcctcacaataactttatgaggaagatactattgtggttttccttttaatgaggtgactgaggctcagagaggttgagtgacttacccaaagtcccacagcagagatgagatttgaagtcaggtctgtttgctttcagaatcttgcgtatatccccaattcccttgccctgtgtctttctgctgcatccatgaggcaaaatcctaagtctggataaatttaactgacagtttcctcctctgtgcttatgcccagatggaggaacattgctggagaaaatcccatcactttgttggttagtcccaccagaaagtcatagtttccaacctcagcggggccctcaactcagctaaacaatccttctaagtaactgtcctgacaatagcacttgcaaactttctccactgccctctggagtcagactgtctgggttagagtctgctttggccacttccatgctccataccatgccagcctttaagaaagggtgaagtggaggaaaaaggatgaggggaaaggggaagtgatatgtatcgagtgtcttctaggtaccagccactgtgccaggtgctttgcatgcagtgtttcatttaatcctgccagcagccctgcaagggcaatactcttgttatttttgctttacagaggaggaagctgaggcacagacaggttaagtcactcactaacgtgacacaatttgtatgtggagaagccatctcattcgtttagaccttccttatcttgatgaattattgtgacaagctgataaatgggtcccctgttacctatctcatgccctacaatctaccttccattctgttgctgggacaatctttctaaaatgcacatctgacagtgctactactctgcttaaagtccttccagagcttcccctcagtcttcagaatgaaacagaaacctttgatcttaatgatttggccctgtccttcctttctcactgcatccactaccacttgcccatgcagtcacacagtactatttttggccacctgatgacaccttgctttcttctgaagaaagaagaaagcatatatatatatattctctgcctccccatcctccacaccctttcctgcccactttaaatgctcctcttctgtgctttcacagcattcatgtttatcccagtgtgttataatttcctgctgtcttctctgtttcccccattaaactggaagcatcttgagaactgggattgtgccttagtcatctctgtactccccagggccgtagcaccagagccatggttaaatctatgtttgttgaatgactgaattaatgaatgaatagagtgaatgagagaagaaaaagctctcacttggaaagtttagtgacatgagctgtatggtatctgattcttggctgaagctgctgcagtttttccctatgactacagtgctataaaaatatgtctgcacatggataaagactggaagagaactttccacacaaaactaagagttgtgttagagtggtgagtgatggatgcttttttccccattttcaaaatgttctttagtgctgcttttggattgttttggcaatgtagcagacattgtagaaatggaatttggggctcccatggaggaatcgacaaccaatatgtattgatgcccagtgtactctgctgggttctgggtgctgtggggagatgggtgggtaaaggcgactcattctgactcaggtttgcatggtcaggaatcttgccaattacgttggatttgctggaataaaaagataactttcaagaattttccaagctcctgggttgaggtatttcttttctcccaaagctgggccgcaaacaaagatggcttttgtttgcagtaaaatactcattccttcaattttgtcctgcaaagtgacttctatagctttgggagtcaggtttgctgagtggggaaactgattgtccatgcttcattgatttagaaatgaccaaaaatgtttgccttttctggctcttgaataaaatgtttaggaatttcattggcaaaatgatgaaattgttccctttactgctgcaagacttccaaaactatatatcgtgggttaacttaacccagaagaggcaaaaaaaaaaaaaaaatgggaagcagactcagatgattaacactctgccttaattgggtgcttactcactctgccgtggcaaggcactgtgttctggactttggagatatctcatttaaaactctcaacagcctgtgggtaagggactgttattgttctcatggtagagatggtcaaactgagtttcatagaggctcagctctgaaatcatgagaccaggatttgaagccgagttcagctggttccatgggcacacactaaccatttggcaacagtgcctctagactagtctggctacaaagggacagaggtatgtatttattttgatttaacgaaccgttgtttaatgtttaccatgtcccgggcacatggtaactgctttaaaaatgttagattatttacttctcatagacaaccctgtgaggaggtactattattaatatcatatgaca

SEQ ID NO: 6826 - DNA, 1724 bp, artificial
  synthetic oligonucleotide
gaactctcagtaaacattctgggggccttccctctaacactgctttggtggaataatatctccagttttcaccaatcttggttcaatatttacctgggggtttgcagtgatcatggggacagggctccaacatgaagtgaaggttcatgagaaggaaaatgaggggaaggctgtgtgtgtgtgtgtgtgtgtgtgtgtgtgtgctggctgagggatgaaggtgggaggaataccaggattctgaagcaatgagagtgggattgggagagagagctcatgttgaagaagaaataactcaccagttcacatgggctccttttcaagggtttttctttatataaacaatttgcctggttccaattagaagcccacattaggcagttagctccaatttggcagttcattcttaatttggctttccttatgggtgggagggagggctgacagttaaaaggttgatgggaaaaaccttggtatcctggtgtgaagacagaccctgggatcagaaggttgccctgatgactttgccaatgtgttcattgcccctgtcctgctggggcgcatacagcaggcccttctttctcatacgcccttgacagaccaggactcactgctagaaaacccctggggaagtcattgctgaagactctagtgtggggcacattaggtttgaggagcaggggaaacattcaggcagctggcaaggtctgggctaccaggagagatttgggagttagaagcatattaggtgagagttgacactgtccaaagggagtatatagaaagaaaagcagaggaaagggctcatggagtcattacagcctgtgaggtgggaacagggtttgggagtactaagggtttggggagggtttatgtgtttattcacccattcatttattcaacatttcttgagctttatggcagatgctgagttgaagaggaagctggggatttaagagggagaagagttaagaggggatccctgggtggatccagatgaaggagaagggaggggctaagtgcctaggctcgctcttgccaggagagcacatctgttaacacaaagctgcatctgtatctcagccagctctcttccatttcatctcctcctctctacccacacttgcaagacggggagccacatggcggcttcctactcccttgtaccactacaccccctgccgggttctttctaggcatttagctgtggcatcagcagcaccccttctgagagatcaggcaatccccaagggtgagtggtagtggtagtggtggggagggttgatagcttcgagagaagagctggagaaggcgctgtctggctgtaattagccccagctgctgttgtgaggcagcgttgggggccgtcaggagtgtacatgcatgtgtatgaacctgtgagcgtggcacctcattgctatcactctatttttcactgtattgtgtgctggctgcagcctcgctgctctgaaacccctcctgtccctgaggatcccgaaagacagagtgttccacaggcagcaccagcttgaatcactaatgctattaagcaggaggacaacaaatataggcccccatatgtcctggatatgcaagtccctgctctctctttccccacccctgcttcctgaatgtttccaagtgagtgaagtcccagcacttgaaattagcaacacctcacttctgcacagccttttggcaaagagctttcacagctgccatgt

SEQ ID NO: 6827 - DNA, 1098 bp, artificial
  synthetic oligonucleotide
tagatgtgtagacaacttgaggaaattcacattcagaaacatataatcagccattcattcattcattcattgggcatttattgagtgactagtgtatatttacctcaatcataaatgtttattgactacatatattgctaaatgagcatgtaaacacaaatgtgtgactgtgtctctcttcaggtgctctgaaggtaagcaaaattgatttagctattttctctttgttatgcatttctccacgtaaacccttcaccttccttggagaattattatggatgatccaggagagacccaagtatgatggacacgtcaatgactccacaaagatatccatatcctattccttggaaactatgattatgttatgttaaatgtcaaatgggaattaagattgcaaattagctggccttgagattgagcgattaccctggattatatgtgtgggcccattgtaatcacaagtgcctttataagaggaagggagaggcagaacagggagaaccagaatgatgtagcatgagaagaacttggcttgatgttgctggctttgaagatagaggaggaccatgacacaaggaatacaggtggcctctagaagctggaaaaggtaagaaagtagattaccccctagaacctccagaaggaatacggttctgcttacaccttgattttagcccagtgagacccatttcagacttctgacctccggaactataaggtaataaatttgtgctgttttaaatcactaagtcagcattaattggttacagaagcagtagcaaaacaagtacacaaatcagttgtctaaatcaatggttcccaactttgatggtgcaacaaccgtagagctttgaaactcctgatgctcaggttacttcccagaccaatcagaaactctgggggtagactcaggtgcataaggtttttttttgtttttttttaagctccacagataattccaatgtagaacaggattgaggaccactggactaaatacaatttttgtatcactatattttaaccgtgaaaatcacatttggctgagaataatctcttcttgcctatttctaccagtttgtcttctagcaggacaag

SEQ ID NO: 6828 - DNA, 1578 bp, artificial
  synthetic oligonucleotide
tacatgagttaactagaaaatggctacaactgctaaatgatgcttatggtctttgttgttccaagtgtttatgatacaaataaatacacaagaagaaccacatccattcttctctactaactacaggcagcttggcctctttaccctatgtcctattctctacacaacaccaaacactggagggtttctactttgacttaacacagctccccagctcctgcttcccacagcattttgcaaaggtgtgtcccagcacctggaggcaggagtatatctagggaaactctctgcgtgttctcttaaggctaagctttcagagaacacctgggtgggaaggctttgggatgaatcatccagaaggagaaacacctctttgccttaggatctagttactagtctccacattatggaatcactgccacctctgggacggagggagcagccgcataacaccttcccccctttaccacacacacacacacacacacacacacacacacacacacacacacacaaactaatgctttgtgacctctcaaccgggatgtactgcttctctcttccaaggagaacgtgtgtgatgtgctggtgagagtcttgtcccaagaaaccctggccataaggcccttgtgtctctttcataagaattgactcctttatgccaggttgtcataaagactgaacattttacattttcccctattggtatcaaaccctcttaggaaagaattctctcacctatagtcatggaatgagacatatggggtttctgggtccttaaaacatttctacagttcattcctgcccctcagagggaacaaatctagaaggcatgcctgagatccttgctgtgaagaattaggtcttcccacaaagatgatttctaaagccagaccccagaatggatagtttatgctctggtattgggctgcaagtagacattttaggagcagccttctctggaattcttgactaaaatatctgcttgatgaataagacaaggatagtaggaaggtttaggataaagatcttcatcagaatatccacctccctaaatgaacaacaattttcttaactgaagagtcaacatgcagatgctcatgaggaccgagccactttgcaaagtaaaaatcaactcctataattggagaagaaggaaaacttcccttttaaagagcttctagaatttactaatttaatataatttttctgaccagacaactatggtctcaaaaatattagtgagtactgatctattacttggtaaattttattgatgtgaaagcaaaaagatggcctttttgaattctatcaacttctttcttcaacaattattttttcttacatggattcagtttctgatgattttactcaatttaacttctttctggaagtcccataggtacagggggaaaagaaaagtggtatcattagggaaaaattattaccacttctaagtgaatgaatgaggctatgaaagtgtttttattctttaccctgactctattgttggtgacttaaacagccacaaagacctaagggcagagcctcttgttcacagttatttactctcctggg

SEQ ID NO: 6829 - DNA, 1994 bp, artificial
  synthetic oligonucleotide
ccgacaaacaataagaaagacactggagtcccaggcccttgtccatcagctgaaatcctctccccactctaccacccagcaagaaaagttcagttaactggtggtgtgttgccactgaaaatggcagttttaacccagggtatctcttgttggaggaaatgctttcattgctgcttatgactgacaaacaatgcctcgcatttggcttgcaaaacacctttctatcatttcatttcattccacacaactccaccttcaaaatgggcactggggggacccagagaactcaaataactttagtggcagggctgggagggactggaaagcaggctttccgggccctatgttctggcaatataccacgttgcttccagagcctagtgtctcaaattctgacccccgtagtcagggacaaaaaatgaggcagatggccagaggataggatagggagcctttcgcccatctaccctgctacattaactttaccatgtattcatcagcaaaatgagaaaacaggctcaggaatacaggcagtgattaaggggactgcagagtcccttgggtagctcagggtggagtacctaagtgacctctcaaagcgccagagcataaagaaatgcaggccgagtggggagggacgagctgtgagttcgaattcagagacccccaacttgctttggtcagaagccttgggccccacctccatccaggttgctaactgctggagcacagaacaggttggggtggcaggggaatttggggcaccctggggaaacttccagggacggctccggccaagagaaggcaacccacctgtgcaaaggctggaaaaggaggtgagggaagcgggcgccgggcactgctcactaacctgggcactggccttctccgtctgccacgcgtgcacgcgctccgagctccccggggcgctctcgtccgaggtctggggctggcaggttgtggcgagagctagagtgcgcgcgaggggggagggggaactcaaaagtgggtgggaggaaaaacatcaccgccctcacaccacgagggagcagcggcttgctcggctcccgggggcagagccaaggcgcgggcgcggcggcccggggccacctgcccgccctcccgctcgctccccacttggcccgagaagccggccgctcggcgctggcgggaagtccgcaagcacgcagccgctgcaagcacgcacactttctccaccccggcacaatggctttatttctgctcccccggcccgaaagtttaaaaatcgggagaaagtgtgagactcagccggctactttcccatcacacagcgcccccactgcagcccccactcctttggctaggcgagcgttggggtcttaaagggaccgcacagctcctccggtccctcctccccctctgcactggatgcacctaggagctccccaccactcgcgcacgccctgaagataccgactaccctctgactcccctgcctggaagcccacacccgctctcctccggcaccaaggcctttccgaggtgtgcacctggtctggtactgagctggtgccctggacacagaatgaaccctcctcgcaaatcacgccctagcatgctgcttatcatttcacggcgtttcccatatccacactgtggctaacagagtgacaaagctttggtttggtgtccttaaaggcggggtggagatgggtgtgtgtagggtcagggattagaaatccactttctcttacaaactgggctcccaagcctcatggaaagggcctgttctaactgttaagtgtcttgaagaaaacttggtgccacacactatacccaccattttttttttaaatgagtccctaagcttctaagttgggccaagagctcaacctggaaatcacagtagcactgctgatgccttggtgggcctgcctactccaaatttgtgtttattcaacaagtgatagttgcaaagaattgtcagaaacttctagggtccaggaaagtgc

SEQ ID NO: 6830 - DNA, 1984 bp, artificial
  synthetic oligonucleotide
gtacaggtgtagctttttcccttactctgcctgggcttgcttcatcttcttgtgcctgttttctgccagtatccagatatggtcaagggtattttggtgtgtgctttaggccaaaggtagggtctgtggattagaagatggaagtctgagtggtagtttatgtagcttacgaatatcttttgtctgaagagcacagtagcaacctaaaatcctttggaggtggcagggcaatggggaaacatgaaaaagtggtgatgatagttgttgcttacccattttacagatggagaacacatctggaaaggagaaatgctccaagagttggacactgctggaaaaggatcctggcatacctcctaatacttgctaactaaagatttggcaacttctctcctctagggatatatgtatgtgcctttaaagtgaagcttcctgatttgatatgtttaataatgccctttgtacttacccatcattcactttatctagtgtggtactgacacagcccaccccagggacgattttgagctgtcagaagatgggtggattattgtccccaaaggaataatttggattacttgaactattgacaattatgagttgtggttttccacttacctcaaaatcttggtatttggcaaatgactttagattgtatctaatatttgtctttttttctcctttttaaagatttggactagagtaagcatagttcacagaggaaatgatggccagataatataattattaaattttgctgccttgaaaaaagtggttttagtttttatgctaatgaatgtcctgttttaaaactagtgtttctctttttaattgccaaataatttaaaattgaaacatcatagccacagatatggattctatgcataaatcatatgatacatttatactttttgatggttacaagtggaaaggtcatctttctttttaaaactatgcttggtgctttaagtagaattggaaattgtcatgtttttcttttctaatgaactattctgcaaaggtaacattgtttttttaactctgattagaactggaaggggatgtctgactccatacttaatccaaaaataaaaacctcattaacaaagaggcaaagagagtcagtaaatggagcttacattaaattgggaggcagaagtccagggttcgagttctggttttgttattaattagttgtgtgaccctgaactagagcttaaatgcctctgagcctcagattcctgacatataaaatgagggcatcgttaggaattgatgatccatattgtaattccttcaacttaaacaaggcattctcctctccaaagtcaatgtttgctttgtgacagaatcacttggggacattttaaaaatatattttgaaggccccacctcaaccagttgaatctgaactccaagggtagacccaggaaacctatttgttaactagcttcttaggtgatttgggagaagactggaacaccctccagaggtaactttcaggaggcaagatctcctggtgttttctggcttgagggaatgaaagcattttcaaaagtggggaagtccaggtcacctaggagctctggcttagaaatctatgatatgaaactgcacttgaggaggctggcttttggcctagctccctgggactggtttctgcagaggtgaatggagagcacagtgttcttcttaagaagagcgagtttggacgaacaaactgaccagtcatttaataatgagtatatttcaagccctttggcacactaccttgagaagaagcattactgagagagggcacagtgatttccataactcctagactgttttggcccaagctttcctttgaatcctatttcaaatttctattccctctttgactttttcaacttttgttcttcttcccttcattaaattcacagtgttgcagtgggtttttcccacttccccttgatctcactgatcttatttccttcagccatag

SEQ ID NO: 6831 - DNA, 2263 bp, artificial
  synthetic oligonucleotide
taaactctagtggtgctagagctgtgtccttattattttgtttattctgctctacactgagcaacatggtgaagaaggggaagctaactttgattacatttgaattaagaattcagtggggttttttttttctctactggacttcatgcttgggcatagagagagtcattttccctctagccagcaggccacttgtgactgccaaccttacattggatttgtagattttggcagggtgaacctgctgagaagtggagcagtgcttctcatgaagcagattcagtgaactatactccaaagtccacaaaggcagactttcctgctcctgctccaccattaccctctctgtgccttctctctgccattacgcctttgtctaaggaaaacttcagacaagtcacttaactcctctgagcctcaatttttaacctgtgaaatggagataagaatcataactacatttttgtgagagataacgtctggctctgttacccaggctggagtacactggcacaatcatggctcactgcaaccttgacctcgtgggctcaaatgatccacctcagcctcccaagtagctacaattttaggtgtgcgccaccatgcccagctaaattttttattttttgtacagatgggaacttgctgtgttgcccaggctggtcttgaactcctgagctcaagcagtcctcctgcctcaacttcccaatgtgctgggattacaggcaggagccaccaagcctggcccattactacatttcaggactctgtctataggatggattttaaggagctcatcctatggttaagggagtcagaaggatctacatttaaatcatagacccattgctattagctgtgtcacctagggccagttatttaaattttctgggcctccattttctcatctaaaaagtggggataatgataatataaaaacctcagcagcagtatcaggcacatcataggggctcaataagtggtaattgttattacatgggtataaagccttcataagataatacaatgggtcaagctttgaaataagtcatcactgggtctgagtcatagacttatactagctgtatgtccttagtcaagtcacttaacatctctgaacataattttcttcatctgaaagatggagataataattgtacccatataataggggttgtgtgaggactaaataagttaaagtatataagacatctagcacaataaacagtaatataaaattgttattatgctatttttacagagtgagagtgatcatatttttcagcataaaaatgggggtttggggtcttacagtgtgacagaatgattgaaaccaggaataatcccaggtgtatgattactgtacagaagccatcaagtatcttggactcaaaggccacattggagcttggggaaaaagtagagcagcctgtgctgagaggcaaaagagaggaaaaagggaaacaggcaggcagaaagatggccaatatcccataccagagtggacctcataagcatggtgaagagtagatggcagcctctactaaaccatccttaccttcagtgtcaggggtccagttactaagaggtgggcagcccagaccacagagctattcatcttccatgcagatgctgattgtggtggccagagcaagaggtcattattgggtgaaatgaacaggtcatctttcagttttacacagacaaatagcctgggtctggcttgttcattgtggtctgtctagatctgttgaaaaatacagaaacaagaacagaaaaccaaacactgcatgttctcactcgtaagtgggagttgaacaatgagaacacatggacacagggaggggaatatcacacaccggggcctgtcggggagtagggggctaggggagggatagcattaggagaaatacctaatgtagatgacgggttgataggtgcagcaaaccaccatggcacctgtatatctgtgtaacaaaactgcacgttctgcacatgtaccccataacttaaagtataataaaaaaggaaaccaccacattttagtgacaaatttcaaaagccattactgtcagtaaagttgtgtaatacaggaaatttgtcttcaacctccttcctctgggccccactatcacctactccttgcctctcacctccctcagcattccccactcaaaaccctttttcctaattcaccctcatatagaactgatatcaatttagagaatctttttactttttctcagaaatcaaaatcttcatt

SEQ ID NO: 6832 - DNA, 1650 bp, artificial
  synthetic oligonucleotide
catccttggggggaaaaaaaagcagtagcatctttgagcttaattgtaataccatagtgccatctggtgaccatatggaatgactgcattatccacatgggatatttcatgtctaacaaaaatctacaacatgtaaatctctagtgtgttctgggttagtgttatagggacagacagtgagggctgtacttgagaactgttctcctgagctactcctttggagatccctcccctggttaggcactttttcatgtcagaaagaaaaataagaattttcccctttgcctaccctaagatggtagatggcaggttgtataagcaaatgagtgaagtcttcacacatcccttcggctctaaggaagatgctgggaaaggggagttggtattttgtcttgttgagagatcttcccttgaaagatttggctactgtacctatggcctcgagtccaatcccaaataggagtttcaaactcaagtaaccccgaatagcacctagctgtccctaaatatgaaataaaggcccctcttcattcttccaactaccccagaatgcaaagaactgtaccatcagagtgtagccagggcttttgaatccatcacacttttacctgagctcagatttcatgaagtacctcaacccccacctccagtggctttgaaacaagtcttaacagatggtcactcttgccatccatcccatgccatcaattcaagtcaagactgatcaatgtactgaatatgaactttattgtgatttggtttatgtaaggcagtgtagtgaaggcactgcagaagttaaacagactggaaaacatggtaaaaaatgagcgagctaaaaatgaatgcttgctggtctaggtaggctaagtactacaactatgtttctttttcatcattgcagaagcgttgaaatattgttgaaggtgggggtttggggtggaattagggaaggcttcatggaggaggtggcatttatactgggccttgaaggaggggcagaaagttgataggttaagatggagggaagtacatttcataatgactgactctagagaaaattctgtagaagtactgaaaaatgagagggcaaacaaacacccccagcgagtgaagcatcccaactgagagaaaagtctgaggagtctgggctgggaccaaagtctcaagtccccagatggggtcttcagtacaaatgatattaggaggcacaggacaatgggcttgtttgtaaacctagcagcagcgagaggtttcacattgcagtcaggggccccaaactggctgtaatatgtctggatgaattctctcatcttttaggtgtgtatggtacttacttatctttcctcttgcccactgactgcctgaatggtagttcgtgcgcgcccatgtgcgcgtgtgtgagtgtaggtgtgtgtggatgggtgggggaccgaggctttgtctcccactgcagcttcttccacttttccgtcttgtggcacacagcaggcttccattgagctgaagctcaggcccctctcactgtctaggactcattgaactccagctcttgattaagcaccaggaagctttctcaacatgaaggtaaaatttactgtcgggggtgacttgggttagggcaggactacactttccggaggtgatgatggt

SEQ ID NO: 6833 - DNA, 1844 bp, artificial
  synthetic oligonucleotide
gttcagttatggttctctctaggcattcccccaaccctgggtaagatgtggatacctagaaaggaccaaaactgaatctgagagaataaatctctaatagcggacattctcatatcccttaaaatctagtgaaatatatcgaaggcctttgattgtccttttgaatcaccctttgtatgtaaaccatctttagaattctgtctctatctccctatagttcatcttcccattatgcgaattaccctttaaaaaaaatgagctaagtttgttcaagctcagtcaaaagtaaaacacataaagaaataaggctgatggctgtgttaaagagagtttctgtcacaaccctcaaagagacaaagagacaaaatgtttctctgaagacatctaggaggaacagctagtgaaagtcctgtattctcctccctcacaaaaaggcctttctttttatcctccaaatccatcccacctcccacacagaaaggcaggactagtggcaagtttcagcaggaatgcaaattgagggatgtgtacaggaagacagaaatagactgtataaaatggcagacagtgtgattgcctggaacgagctcaactcaaagctttccacttcaagcaaagcagcccctttttatattcacctcttgcataggctgctgggatcagaattccagttttcaatggtttatagcagcaggacaacctgttggagggccaaaggcccccttctcactgtacctcttactgaaataggtagtaggattcacgccagagggaaaggaaccttagctggacagaacttgcatgatgagatttcctaatcccagtaaggaccaggcctgttgcagcctctacaaagcaacccacagcactaagcgaagagacaagctgcagccttttcagtctaattttctttgcatttatagtagatcaacagttgtttaacctacacatagttgaaagaaagagtttggatgaatttcattttctagtaattggaggctagccttctaaaaagttcacatattttggttcttaatcttgttaaagaaaaagatttttttttaaattgaacccctgtttgtcattctcttattaaggtagaaaaatatttttaaattattgctacatttttaggatcatgtctttgtatccacccagagtctagcacaagactgggcactggtaagtccacaaaaaattcttttgtttttaaaattccaatgaatcatcattttgtggtattttgtgtgtgtctacatagctgatatcctctctttttcaaacatatacagcctgaaatacatctattattaatctaatatctttaatttcttaattaaagataacatttgcctttaatgggtaaaagttcattaatatctttaatgtcttgatattatttcctgttttgcttatcatctctgtcactaacagtcactgacctatgccctaatcagaaattcaagggcagatgtgcattcttctggtcatttttgtactgaggctacactttagccatccaaattcagctcagaggagatgaagtacagcaaagagaagaacacagagccaagagaaggggaaaggaagacagacaagggagggccatccaaaatgcttattgggccatggttcagagaaaactgccttcctagacttggctcactttctaggccaggcttctgtcaataacacatttattggccatcctgacttcagcctctgatttgcccaattcaaatatactttttccaagaaacagatctcctagtcatggcccctgaccattacaaacaatactgttgaaaggtccgagtgaaagaggccattttctccaaatgagt

SEQ ID NO: 6834 - DNA, 1864 bp, artificial
  synthetic oligonucleotide
tttgtttaacactctttttattagtcaacttttacatacagtgaaatgcataaactgtaagtatgtcatttgatatttttagttttgtgacatacatacacctgtataatacaaacctttatcaagatagagaacgttttcttatgcatcttcccagtaaacacccatccctgcccctgagaggcaatcactgttctcttctgatttttttctaggtaattccaagttgtagccagggtggaaaatgccttaaagggtgataggcaaattccacttcctcagccttctgtaattgaggcagtggagccttttggttagcagctctagagtccaaaagcttgaagccaggtccagctcaaacaatgctatcagtgaaactttaggcaaggtaacctgtgaaaatctcagtttcttcatcaataaaataggaatcataatagtacctaccacaaaaggttagttgggagatttaaataagataatataagtaaattagtaataaggttaatgtttattaagggcttacaatttgttaggcactaaaccagttgtatggattatctcatataatcctctctactgttagatctccatgacagatagaaaaaataggcttagagagaataacttgcccaaaatcacatagctaattattggaagagccagaatataacctaaagtggtttgattctaagaaccacattctcacactgttaactaccacacttccttttgtatgcattacacacagagtaagagctcaaaaactactatgtattaattatatgcacattgtattatatatatacagtattatatagatatatgtgtacacacacacacacacacacacacacacacacacacttccctagaatttgtctaatctattcagttatagagtccaaatgaagccatggagcctctgacccaaacacagagaaagcttagaaatctcagcagcccaatgttgctggtccacaccttggtacaagcatctgtatctattgtgttcttaacaatgccatttccatcatgactttgagaaataccagcaataagataagccatcatgctgaccaacacacaaagctctcagtgacaacatctctgtggaataaagaactgggggaagcgcttttttttccccattaacacattcagctccctgacgctctgttctgcagctgtgctgcagtcgctcaaacaaagggttgctggaaaattggttacatcatcggcatcagctctgacagactttccagaagcagcattattaacatctccacagaacgagagaatgggcagggctggagctcactcaagctacattatgctacccttcctcctaatgaaaatcccattgtactgggcaattatccacaccccattcgaggtggctgtttatgcacatcagagtcgtccattttttcctaagtgaggcagcatcacatggagccatcttattcctcagtctcccctattgggccactcagtctaatagcctaccctcacaggttagatgatagttgtttggcaccaagaagagagtggcatgccctgggcagggcagaagatggatatctagtagtaaactctgtagctaagtcttaagaggaagcatggtgacagctgaaaacagaacttcttttgtcactatcaggaagcctaaaaatggctggaaaatcaatttcaaagttttggaatctcaatttagccggcaggcagcaaagggagtgagaagaggatgagacaaggtgctgagacttcaagctttgtggctccgttggaatatcagactgccagggttattttaatcatgtgagggcttacagatactcttccaccagggaggggatatcgc

SEQ ID NO: 6835 - DNA, 4403 bp, artificial
  synthetic oligonucleotide
tagatttgatgctgagtgtttctattattactatttctaagacatttgcaattttggttttgttatgtactatttctactttttggaaagtgttgaggtattccaattttgatgatttagtttttttttgtccctactatgtgcagaattctgtgttcctaaagaagagagacagtgaagagagacctgtctgacttgaggggtgtttagaaggggctaggggaatacaggactggaaagaccattgcctgagggcattgaggtgcaagcttcacggattggtttcttttctaataactacagttattgaaagtgttggggtacagaaaataattccccaaaatatggcacttaagcatgctgagtgcttagaaaaatggaaaggctgctgggtgcagtggctcatgcctgtaatcctagcactttgggaggctgaggtgggcggattgcctgagctcaggagttcgagaccagcctgggcaacacgttgaaatcctgtctctactaaaatacaaaaaattagccaggcgtggcggtgtgcacctctagtcccagctgctcgggaggctgaggcaggagagttgcttgaacccaggaggcggaggttgcagtgagccgagattgtgccactgcactccagcctgggtgacagagtgagactccaactccaaaaaaaaaaaaaagaaaaaaagtggaaaggtctcaaaaataagcctcagaactgagctctctttctgacctttgtccacctccctgtctctctgatcctttttaaggatacaccctgagggactctctgtaacttccttatctgagtaaagaagcttctttccaaaagaaatgcaattgtcttaagactccctccctagaaatctaatcaaataaccaagaaagatcaaccatggagaagagatgggcagtcatcaccatgacccgatggacttttcatgtatttgtctgatgacagctgcaagagattacctaagggactttatctgcataataagaaaacataaagtgggggaaggacacccttttcaacaaatggtgctgggataattggctagccacatgtaggagaatgaaactggatcctcatctctcacgttatacaaaaatcaactcaagatggattaaggacttaaacctaagacctgaaactataaaaattctagaagataacattggaaaaacccttctaggtattggcttaggcaaagatttcatgaccaagaacccaaaagcaaatgcaataaaaacaaagataaattgctggaacttaattaaactaaagagcttttgcacagcaaaaggaacaggcagcagagttaacaaacaacccacagagtgggaaaaaaatcttcacaatctgtacatctgacaaaggactaatatccagaatccacaatgaaaatctcaagcaaatcaacaacaacaacaaaaacaatcccatcaaaaagtgggctaaggacctgaatagacaattctcaaaagaagatatacaaatggccaacaaacatatgaaaaaatgctcgacatcactgatgatcagggaaatgcaaatcaaaaccacagagcgataccacctcactcctgctagaatggccataatcaaaaaataaaaaaaatagtagatgttggtgtggatgcagtgaacagggaacacttctatgctgctgctgggaatgtaaactagtacaaccactatggaaaacagtgtggagattccttaaagaactaaaagtagaactatcattttatccagcaatcccactactgggtatctacccaggggaaaagaagtcattatacgaaaaagataattgcacacacatatttattgcagaacaattcacaattgcaaaaacgtggaaccaacccaaatgcccatcaatcaacaagtggataaagaaactgtggcatatatatatatatatttatacaatggaatactactcagccataaaaaggaatgagttggctgggcgcggtggctcacgcctgtaatcccagcactttgggaggccaaggtgggcagatcacgaggtcaggagatcaagaacatcctggctaacacagtgaaaccctgtctctactacaaatacaaaaaaattagccaggcgtggtggcaggcacctgtagtcccagctactcgggaggctgaggcaggagaatggcatcaacccaggaggtggagcttgcagtgagccgagatcgcaccactgcactccagcctgggtgacagagtgagactccatctcaaaaaaaaaaaagaattaattaatggcatatgcagcaacctggatgagactggagaccattttcctaagtgaagtaattcaggaatggaaaaacaaacatcataggttctcactcataagtgggagctaagctataaggatgcaaaggcataagaatgacacaatggactctggggactcaggggacaaggatgggaagggggagaggaataaaagactacaaataggctgcagtatatactgctcaggtgatgggtgcaccaaaatctcacagatcaccactaaagaacttactcatgtaaccaaacactacctgctctgcaataatctatggaaatttaagaacaaaaaagacagcattagttcttgtatagttccacccctcactttcccttaacttgttggcaccgtccagagtccaaagataatcatttataaaataatgtttgcctcccaggtccattcatttctcccttatgaagaaagtatttatgtctcaaacatctgacttttctttgagcctcaaactttgtgtatggtttccatgtccatatgcatgttaataaattttgtatgccattttctcctattaatctgcctattgtaagttcatttttagtgaacctttagacagcagaagggaagctgcaaaaggatgcacaggaatggcaggctcatatcctattttagggagaataatgctatttagggagaataatgccttattcttgggatattattgctcgggatttgagagaggggaacatgctagagacaaggagaccagtcagaagagctttatgttaatctaggacagcagttctcaaacttgattgtacatgagaatcctctggagggcttgttggggccccaccccagagtttctgattcaatagggctgtggcagaggcctgagaatttgcatttctaacaagtacccaggtaatgctgatgctgctagtcaagggaccgcactttaggaaccactcatctaagagagagatgttgagaaccagagccagactggtgaaagacgaactagagaggagagaaagtatatgaaagatatttggaaggaaggaaccacaggactcggggattggacatgggggcaagggagccagacaaataaaagatgacttcagagtatcaaacctaggtgccttggaggatatgagaatcacagaggcaaaatcccaaacatttggaagtggaatgaagtcacttgacaggtactgggaaaatatatgaggccttattccataagcatctgcaccatggcactcaagtttaaaggcctcctgtgttgtcttcagagagaggctaatgagaagtagaaagaccaagtctgtattttgtctctccttttctagaatataacctttgagtagaggaggaaacagaagatagaaagcagggtatacgaaagttagaaggggcttaaatagtctggaaacaaagaacacatcattgggttgctaagtacattcagtgagtactgaatgtatatgggcaaacactaataaggaaaaggtaaatcagtaaaactcagcatgggccacgtagggtagctccaggatgctacctgagatcactggtgcaatttctgagatagggcatctcaattccagaccacctaaccttccctagtttcagggcttctgacctggtgccctgttgtgcctggctatttcccagcctataggaatttctcttacctgcttctctccgctgggccgcctgtagctgagcagaagctccacagcgcccaccacttccttgcgtatggcatagagcaatgcatcacccacatacacgctgtggttcagcagtagctccatgatctccaggttctcgttctcaatggcaatgagcagggcactccggcccaaggggtccatgcagttgatgttaacattatagtagatctcagcctcctgaagggcctgcttcacagtggcatagtcccccttctccacagcattgaggaaggccttctcctctgcagagagctctgtctcagccctcacaatttgcagggggatgcggtctctgtacggtgagtagttgacctttttgtagtacagttgggccatggttcatagcaatgcagaaatctgagtgaggaaacagagaaagacc

SEQ ID NO: 6836 - DNA, 3308 bp, artificial
  synthetic oligonucleotide
atgaccatttgtccgagtcgatgtgtgtctagggagggagggaggtgtccactttgaagcagagatctgactgatgcccctccatttgcatttcttggttcctttaaggaagacaggcaaacaaatctggccatttcttaagtttgaaggatacaagacaaagaaggtaaatggggaccctggttcctgaaccttcatgatccggctcctggctctctatttctgaaggtggcttttgacgaagggcaggtatccttggtccgagggccacactaatcgattttaaggaggcctgggagcaggttccccacggatcttaaaatctacccaagaatggagcaaatcattgtccagggataggacaaagctgtggttcaggaaaatattcccagtgaaaggatgtttttggtcatcgcaggcagcaccttgtcctatcaaccctggagcttctccccattgcatttcctcttccaaaacaatctgttgctggcctccctctgctccctaccaccctgagcccacagccagccagtcaatgcttctccgcctacagcagcccagcatcttcattcaacccgcacttcgctgccccttgcccctcagcagcactcaggcagtgaaatggaccgcaccggccgcctgtagacttaccctgagccaagtggttttttcggataaaatctgtgtcgtctggatgtccaccggccaggatgcgtggtgcggcgccttgccggactcctcttttgcggcgcgaaacagcagccgactgggacagcccggggcctctaggctgatgggtgggtgggcggatgagcacagggaaaggggcggggtgtaaagacgagcgcaagtactggctcctaccttggcttcccctttggatgctcagttattgccaaacttgcctgtaacagatcggccctcctcacctttcaccttcgccagtgccctgaaactctttgctctaccaatgtccctaccctgttctcccagctctctaacccaacctgagccccttcaagcgcacccactcccttcacgcagccagtcacacacaataagagctagggaagaaactgacacggggaaactgacaggggtagctgacactgtagtgtgaaggagagggagaaggagggaggaaggaagggatggagagagaggggagagagagagaaaaaaagagagagagccgcattcacactcttacacgcacactcaagctccagctgttaggtagcggctggcgggagcgctggctacccctccaaaacccttttctacactagaggtttctgtccccttctgctgccgtttctggaatatgctatacagagaaggggagagaaaagcaaagaggggtggggaggggaaaatcaaggaggcacgctccctttatcctccccacccctgtctccaaaaatgtccaaccctgagctcttccttttcccttctttctgcgcccggcttccctctgctcctgttctttattcctccctttggggtggctgcgagctgcggacaacccgtcgtggttgtgatgtggggtgtgtgtgtgtgtgtgtgtgtgtgagagagagagagagagagagagagagagagagagaaagagagagagagagagagagagagattgagacaaccgtggtaggcaaaagcacccctcacctcccccagcccccgggccgaagccactctcaatctcctggcggcggggcggggcgggggaggcggggaggcgagagggaaagagggaggacggggcaggcggcaggggcagcagctcctgccttctttgcagctccgcggccaggggtggaaggaagccgcagccgcagccccaagtcaacccccgctgccccgtcccaccgtctcatctctcccccctcggtacggaattttctgtctcgtttgtttgcttccccagacctccccctcccctgggtggtggcagagacgggaggggaggtgggaggctaagcgcgggtgcgggtagaggggacaggagtccctcggagcatatggctagcagagtctctctttgccccttggcctgaatatcccctgctttgggcagtgacctttgcccacccccgtcagcctgggctctgggccggtggtggcgaggctgctccggcgaccataggtcattcaggaggaaggggagttgaacctgggggagtaagggcggcgggcggctggtaggacagggagacagcggagcgctgagtcgccagggactgacctggggtcctatggggcaggcttggatccctgatagatctagattaatctagttggagctacctaattctcccatccgtgcccctctcacccatagggtcgatctcccaagatccagcctagattgatacagggagggaaagtgatattgtaggatgggggcggggggctaggttgcttagtggtatctgttgtggagggagaggggcggtgtcaccggacacttgggccactctttgatctttacgccttcctttcacatgaagcacctctccacttctttcaccttatagcctggcgctcagaatgtccaccctcttgagcccaactggaaggggctaaatagccccacccccaccacaagcctgagacttctacctgcaacctgcaggcgcataggtccactagctggcagcatttcatggcctggccgcacagccccaaatattggctttgtcttttatctcccttcctagcgctctcaggaaaggggcatgtgagtctctgcctttctggacgccgggctggtacctgaaaacctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtggaagccctaagcactctcctcctagcctaccttggaaaagtcgctcggggcaccaagcaagacaaattttccccttgtcgttagtcctcctagtcccgaggcagtccaatattctggagagtatttagcttttgtatgggagcaaggtattggagaaaagaaaattattaccctgggggatgaagagtttgtgtctggggggaagggagttggggaggaagaagtgagggtggagcttccacctcttaacaacttaaatacttcaggaagtgtttctaaagattggccaagagggtcgctgaaaaaaaaaaatcacttgattctttgcc

SEQ ID NO: 6837 - DNA, 983 bp, artificial
  synthetic oligonucleotide
cttcagattttttacctgtaaaattggtatgataatagagtctgccttatagagttgttaagaagattaaatgaattaatagctgaagaacacttagaacagtagctgggttatagtaactgccacacaattgccaattttcatgtagggttctactttacagaaggctgggtgcccagctctgattatattcacatagaaggttgcaaccaactataggcatcccatttgtcaataagggattttgtttcagttatatgtgacctagttttatcacagatatgttaactatatcagtagtggcccattccagtaatgggtcctcagatccaggcacgtcaacagcatagatgccatgctttctgaagcccacttttattgagcaagggactgatgggaaatgtatcagctatctcgccaaaggctatattgatagtgacattagacttattatatacagaatgacccaacaggagcttcatcagcagctttacatctacactaaacaatatggtatagtcattcctattgggaaatcacaaatcacaaaccaactagccatccccacactatgagagccctgcactacatagcaaagcaaggatgttggaaaggaagataagaggatgaagccacacccaagtagatactctgtgagagagagttacacatcactataaatcagtaactgtcctggagggtacaattggaagatgccatcatgacttaacattttagggcatgtcccaaagtaagcgtttattctttagtgttccctaacagataccaccatgaggtgattctaataatagaatgatagactctgagatgtagaagaaggcttagagattaaagtgtgcctttattgggaaattgggaaggttatataacagaatgcaacatctttgactgctgaggtgtatgggaactctgaaatcaaataatgtaaccaaccttaaccccaccctcacatacattcattt

SEQ ID NO: 6838 - DNA, 1537 bp, artificial
  synthetic oligonucleotide
actaagtggagagaaaggactaactgagcaattgataactttgaaatgatcaactctaaataaatatatttgaccatgcagagacaaagagagctcataaaaagaacctccacatcaggccctgggctatttcctttctccagagtttgagactggaaaggtaggaactggaataacctccccaaatttcatatgagcttctctctccttccctctccccaagatgctgctccttgagctccccatctatcctatgattttaaaagtgaggtaccaatgagagatcttcatctcagttcttattctggctagacaggtgccatcatcttcagtgataagctggttggctacgagttctatctcacactctcagctggttagaaactacccctatcaagatccctggcaagacattgttaagccctaaaccccagccctgttattgttgcccattagtctctccactccattgtataagctgggaataaaatgtcaccacagctgaccacttctattgagtgaatctggcccatatgggaagaagatgggctgattgcttttccaatcacttcagagaagttgagaggcagcatggtatatcaagaatgtttgtctcaacagaatcactttcaatgcttgttcagaatcactttcaatgcttgttcaaaatgcagactatgtcaccccctccttgattcactgaattcgaatttatgggaattcatattgttaaaaatcctcaatttattctaatgggaactaatgattgaggaatactgttttagtggaaaagtcacaattttggaatcagatcagagacagagtcctgaggtctgccccttacaggctatatgcacataaaaagatcacttaaaacctctgagttttggtttcatttataaaatggaaatgattaagcataaaattcaagtgaaacatctgcactatacctaacaccagagtaggtatcaattctctccctttctaccagaaaagaccctattctctcataagtaatggaaaagacttgaaaccacctaagatttagaacatctctcctttcccctttctctccccacaaccactccatgggtgatttttcctcacccctaggcttcattctattttcagttccccaccacaaaatgaaaccacttggccaagtgttctttgcaagaatggatttatagtttaagtatttcaggttcttctggaaattgtcatgccttggcacatagtaggaactcataaatatttaccaaatggatgcattcttttatttccagcctgagaggcctcaatatttgcatttcagtttaacttcattaccccatttccgtcgcataaccccttagatttaggcaaatccaggagatcaacctaccacattagcaaaccggatccatttttacttgtatagacaggtcataacaaaatcactctctccactcccagaaacaggcacttcatctcctcaggttaccaactcccctggggaaaccaactagcacttaacccttaggtcctcaaatcttgt

SEQ ID NO: 6839 - DNA, 1138 bp, artificial
  synthetic oligonucleotide
ctctcaaaaacaaacaaacaaacaaaacaacaacaacaaaaaccagacgtgagttggatgagaaaggacttcctggcctctacaatggttcactgactggccaatgatgccagcagaacagaacatagtagttaagagcatgggcactgaacttacccagacctggccttgcatcctgattctgtcacttaccagatatgtgaccttgaactagttgcttcctatctccatgcctcatttttctcgcccataatggaaatataataataacctccgttgattaatgtcattgtgaggattaaatgagttagggcaaataaaaagcctggcacagggctcaacacacagtagtgggcacccaaaaaaatgcttaacattactataataatttggtacaagaaagagctgcccccaagacatattttgcagaaattctctgtttccttcagagtaattgctggaaccagactagcctgtaccctctacactttttcaaatgcattctccaaacactgaaaagacttcccttttatcaatctctctcccgccttagcgccctctccagctctctcacactctctcacgctctctgtttctcgtctcacatctctcctcccccaccatcaccaaagaagcccccaatgttccaaacagataaaaagatgtggcgggacgcaggccccactccatttgaatctgggtagacttgtccgaaggggatgacaatattacttttgtttctcagatactagaatctcccacaaatccttaagtggacattccagcgcctcttcagcccactcttagctatttcagcccaggctctcaggaatccaacagtgccacctttaaggcctctctcacaattctgacacctgcatcctggctcctatagaaactccttccctcttctcaatgtatgtgatgttgagaaaactggaggatgaatagggaaggcataatcataatgttaatgggactttagacatgcaaatgtgtgtcctgagcatggatgagctgaacaaagtcgatgtgagcaacagaaatggacaagtgccatcaaagccccagatgtgtgacactgggaagaggggacgtagaaatgatgaaaggaaacacaagggttatttagaaaaat

SEQ ID NO: 6840 - DNA, 944 bp, artificial
  synthetic oligonucleotide
gatatctagaggagctaactaggaaaacatactgttacatttccagtcccacagtgcacagctggttatcagttaagaagaaaatttaaaaaacctagctaaactacagtatgcataactcacttgttattgttcgcagagatatttaaattttataagaggatgtccagagagaacaatgcattagatagtagaatttttggcacagggacatagattagaattaaactgaggagtttctagaaagttttcctgcccttacaatgtcgtttctatctggcatgctaactcactgccctagcagattttaaattcttccttcagtattttgtttaaaagagacaatacatttagtttttaggaacacaaaataatcattcttttttattggaattccaaatacccccaagatataaaaagaaataacgtggtttagaaaatacttggttaaaaaaggaattaaatcagccattctttacctgtcaaagcaaagaataatacataaagaaaaaaaaaactccatctgttttgagtcatgaagtcatcctccaggctccacagagagcttatatccaagtgggagagaaagtgaatcttactatgaaactcaattccaaagaagaggatcttttccttgaggcctcctgaggggatagatcttctcctctcatcattctaggttactaagctacagatatgtgtaaaggttaaattgcaatacctcaaccagaacatttaaggcctgtttattgttcatatcctcagcatcaaactaaaaaacagtgctttaaaaacagaacttgaagaacagctattaaataaaacaaagtaaagtgaaaacgagttcaatgtagaaacatgaagcaagtaaaacaatttgagcatttaaatatgactctataaccatttagagaatagaaagtttaatgcacctgcattttcat

SEQ ID NO: 6841 - DNA, 741 bp, artificial
  synthetic oligonucleotide
tataatctgacaattgataatttcaacagaggtcttgataaagtgtctcaaagaaagtattcatatgcaaatgttgcaatttagcttatttggatattcattgctctattaattttatatctaagaaaataaacttgctacacttactaaacaaaaattaaactttactttgtcaggaagatggtttgttgccaacaagaaagccccttctggactatcatattgaaaacaattactttagagaaaataagttggaaagaatcctaatccacttaaccttgtctcacaaagaggaatttattctttttttttctcttttcttttttgctaaactgcatctggaagtgctgaagtttcttattcatatgaaatgggcaattagggtttctcattcagtcacaaaactaaagatcagagatcttcaccaatgtcttgcctcaagcagagaagttggatcagtaattttcaagtttctatttgtgtgataatattaccctttaaatcaaaatggcaaaagtaaccttaatttttttagataatcattttaatacagtttaatacctaccacttggaagaaacattaaaaataagctgttttaaatagtctcagttacatagttcttaatttaaggtataacatatagatgtacaatttagccagagaaaaacagtatttcaacaaaattaggagaaaatgtcccccctgcattattataaaatataattagtttcaaaattatt

SEQ ID NO: 6842 - DNA, 1427 bp, artificial
  synthetic oligonucleotide
tgctgttcctgctatactctgagcttaccctatccctctgtgcttggtcaccctcattttgtgctgccagtatcctcacgaaatgctacagagcagttctactctctgcggttttttcttgaataattctgcactgcttatttggacaaagaactggcttctttgtagataaccatagaatgaccacttttcaagtgaaaaattcacatgcatacatataaacatgctacacatatgcacacacacatacatacacataacaatttatggcactttatgatatcctcacatacccaacgtgcaaaaatatcatcttggtgctttttaagagtttatctttatactgcctcttgtgagttgaatgagcattttttggtgtgatactgagtataaaaataaataaggaaggtttaaaattaggaatataaatcaaaatgcttataattttcaatatgtaattagaataaatctcacttcattaatcagaatcatcaatgacatctcatgcacttagaaatatgaacaaaggaatgcttttagaacaggtaccagaagtcttaaaattagagctatgaaagaagcataaaaatgtaaatttccctttactttgtcaacatagtgtgtcttctttgcaagaattaatcattcctgtaatcctatttcagtgccctgatatccatgtgtcattgagtctgaaaggctttcatttagaagggcatataaattttggtacataatgttatatggtataaagttgttaccaactatatctttatataatgccaaacaagtggtcactttattgggaaatcaatcaatatgactctttgagtgtaggtaaaaaatatcattaataacaatggcttacatattttatatgtagcacttcattctctttaaagccttttcaaaaataatctctgatttgcttctaatcaatcctatgaaggggcaggataggtaatactattatcaattcaaagataagaaaacaattatgtccataggtaacttaactggatttacacaaagttcaaagtcaatgttttctgacttgtaacctgatgattattatttcagatccagagccataaactggggcatggaagaattctgttatatcacattattttataaatgaattacataaggatataggtaaagctgagaattttaactaataaaattgcagaattggaaccaaagaagggtaaaatctaagaggttgatgttttcccgggaaaaaatgaaaggttttatacttgaaaccataaaacgaaacaatatacaactttaccagtatagaacttaaaaaaaagccaaaaaaccttccaatcatatttactagttttaatgaaatgtaagttccgtatgagtcaaaagaggaattaatgtgatcggaaaacctaatgtgatacaaaacttca

SEQ ID NO: 6843 - DNA, 1221 bp, artificial
  synthetic oligonucleotide
cagtaattacagaatttacagttatgaacaagggtcagatctttcatcaggtaaaatattaaaggaatgtaaattagttcttggggggccctgcttttgccttgggtcctcttccttttgatccctctgatcctggcttcaagaacctctctgcagaaatattctacctaggtatgaacaccctaagcaacaatgcagtttccattttggtctctttcttatttctcatcagattttggatttgggtgggttatctaacacctgtggcagaattttgctgttttgggaatttacataaaaagttaaattaaatttgtccactggatggctttctgggataataaagctaacgtgctaccactcttaagatgtgacacggtccttaagattggaaatcatccattctttccaaagtgtttcttcggatgggagaacatcatgtttctgaagctggtttatggtttagctcagaacaagaaactcagtagtttattctcccgaaaatgcttcttaaacaccagcatgtaaggaattctttgttgttttcatttagtttctgcctaagttcaatcccgcttagtttttgagaactagcaagattatagcccaaaggtgttaggaaatttaatatttcataacagctgctcaagagttttaaagagaagttataaaactggataactactattttctgcttcccactaattattctggaacagttacaatggctatttatgactacatcaaaagttgttcctaactttgtatcttagacttgcagaattctaaaaatactgagagaatcttctttctgagatccgctttgtttgtcagtaacttatttgtgccatgctttcccattttaggggctggcctttctgctagacggtgaaatagacaatgtatttctaatgttctgcccagggttcagtgccactgtgacatcctccttgggcctgtctcttcccactggatggggattaaggctctagtggagacctttgctttcctgtttcctcttgtcttgtcaaaatatgaaactccctgttatcatcttcatttagagcagtgttactcaacatatagtctgcagactagtgttgctccaggactggattagatatgtacagaaattgagagtgtgcatttagaaaactttgtagcgatggatgagatgagctggaatcttgttcttttttgaaaatagtttgaaaatattgt

SEQ ID NO: 6844 - DNA, 454 bp, artificial
  synthetic oligonucleotide
agtctgcaatagtatgaggcaatggatgggagttgagctattctctaaagcaagggcaggcattagataaaggaataatagaagggaacatatccaggcaggaaaaacagtgtgaaaaaatcatggaaatggaaaggtacattgcatgttttgcaggatgccattttggtcaatttagggtaatgacatatcgacaacagtaaaattcaagcaaaagcgattcatacttccaaagagtatttttgctataaaattgttctaaactaagcccagttcagcagacaacaaaagaaccaaaacatgaacattgaatcatagcaacccccagctttcttcactaaaattattttagggtcatttttctatgtccaaagaaaatgtctgaattacctggttttggcactttgattttgtaaatcctcttgaggaattgctcagtcaacaaccctattga

SEQ ID NO: 6845 - DNA, 1801 bp, artificial
  synthetic oligonucleotide
ctcacctgaagttaatgagtgttatcatggtggctctgtggcagttaggcatatcaccttaaatattatttctttttctcatctctaaaacaatgatagcaggtctaacacagctttcttactaatcatttcatcatgtaaaactgaaaattattcatggaggggccatgtattccctcgttatatgtacagaacattaaaattctagctgtcttaaaacatgggagctgtcatggagttagggtaaaattatgagtgctctggttaaaaagtgatacttgaaaggcaaatacaacattttaataagcttaggaaagatgccaaggatttagtgccttttgcaaaacattggctacaccgattctgaaacatgccaggcgtattttctcctcaacaaccctggaagtgcaatacaagtacagtactttgaaatgtgtttgcaggactatgggaagcacacatattaaatagaattcaattgctaaaatctgtttctgcccagattaatgagtagaaacaaaacatctgccagtaacctctgtttggctatattactttaaacttaactgaaaaaaggtatagatgcctttctttttatttcactacacatttataagccttctggatgaaaggggacttgaaaattatttccaattttctttacagttatccgtggggctcttttagtctagaatattcttttaatttagcatattgctttgaaacagttttaactgtctttatgatattgctgccatggaaattagatcagctctaggattggaacattttgacaaaaatcagcctcctgtcatccttaaaactaatatatggcaaacgttttgttctttagaatgtttttaaaggaagaaatcagatattattttatatcttaggcttttcaactaaagaaatatgggctactctatttattcctacagggtaggttataggtttacccaaaccaatatttggtttcttattctccttttaccaaggcttgcctctttttcatgtcttttgattattcatatgttactagtctgcaagttggcacaaatattaactaataacctttctaagacggagggtcttctcaggtcacagcagaagaaacactaagaaacagaaggcatatttagctatcagagaaagaagggaacatcagaactgtgacttctaaaatggagtcctaaatttgggaaacaggagggtttcctgtacctattgatgaggtaaccaaaagtactcagaatgcttttcctttactggtagagcaacgtaagtgcacaaaagagtgttttagaagctattcctcctatgagtgtcagctgaatgaaactcaatatttaactgttaatgagtatctattactgtcagccaaacatatttatcactgccaaatgctgtacagcttcatcagccttcaggaaaattctccatcagcctcagttgatgtagggctcatacctaggacacagagggctgataatttgtcattttgacttgaaatgaataaagaaaagccatatttaactggcacacaattatggggttttgattctggttatttgaaatttctagatagctgaagattagcagaaaatgtcattttacttattttttaaataaactttactttataaaccagttttaggtacacagcaaaatttaacagaaggtatagagatttctcatatatatcctgcctgcacatatgcatagcttccccacccattttatttttatacttgaataacacactcttcccctctttcccatatcccatagaatgtgccag

SEQ ID NO: 6846 - DNA, 1044 bp, artificial
  synthetic oligonucleotide
taaggcttttgaattccaggtagaaaaaactatgttgaaactttatgcatttatatatcaagaaatatcagctgtattctgatgctttaagattaatttagaacaaattttattattcggaactgggagattcaacaaagtgaatttgctgtggtatatcataggaaaacttttaaactttacttttagagtgtgaaagttgtattatggatgttatttttttctgggccgaaaagctgtcttttcctggctttggtgacatttatataccttagaactaactgatattatttattatttattattttttgcaaacattggtaccttttacttcaaattttgtgaataaactgatacatatttcaacgggctttcaagcaattttacaacaaagcacatacttcttagcaacatcactataagacagcaatgtattctctttaatgtttacctgttgtaatcctctatagggtttccaaaacttctgcacattgtgcttttcatataaaatttttattaaagatcttagctattttctaaatgaatatcctttttattggattttttccaattacaaatgaaatttcattttacatctataattagaaacaacacttacaatgggactgtacaaatttaggtcaaaataaaaatatatgtattttgtgacttcataagacatcctttactatatctttaaagaaagcagaagtaacagcaatatatgtgaaagtaatgatttaatgactataagcaagacaaagtaatagaattgtgcttcttttgcagactggggacaatgaaatgtttagctacaattttcccatccgatattattaataaagaaatgaaagcactttttccagtatgatccttttttttcctttgctttttggtggtatgcaaactgcaagctatttaatatactcaaaattctgttagaaaaagctatcattaacattttgaatgtctttaaaaattctatgcagtctgatggtatatgtataagattataataaagtaaaagaaatgaataatttcttt

SEQ ID NO: 6847 - DNA, 2246 bp, artificial
  synthetic oligonucleotide
tataataagctatctatgtctaagatttttttctaagtctatgaccatgtttgaggcacagtaagggaaaagtcaattgtgttcgatgtcataaaagtttatttctaggtgtggcatgcctcaacgatggacattatggatctgatgctgggtttttacgattaagtagtaatagcgaatgctgaaaatataatttgatacaattgtattactaccaaaaacatatctggctatgataatttgctttaaaactgaaaaaatatgggtagaagtattatcaaaattccttgcatttatgtcctgtggtaaataagaaaaaaaaaaaaaactcccggtagaattcttgtgtagcttcttttgatctgtgaaaatacctgccttcgagaattttgctagaatcctgtcactcattttttaaacctgtctgtcatcctttaggtgtgttaaaatagggctctctggtcaagagggggaaataataatgagtagagaagtaaactttctagtcagtttatttttttaaaaagttcccaaagtttcaaatgatgaggaactttttcctacgtagtaacaatcttctttaattctttcccgaatttctaaatcagtagttttggaaacatatgtatttgtagtaggaggaaatcgccccggttcgaaagttgtaaaaacaagtccacagccttagaaaccgggaaatatttggaaaccgtgttccggggggcactggggattttaatcaaacctgaggaattcactgtaaataactcctctttccagggacaatttccatacacctgaggaacggaaaggaaagcagtgaaaaccctgggctgactccccaggcctcgttaggcaggggttccagaaaacctctctggcaatgacagagcgacagaaagcgccagcatgtgcttgttttgagtttgcttccccagtcctaaagtgcgccctaaatttctccttacactaaattctctggtctggtgttgccaaaatctccaaagtccgtcggaccttgcagcgctctgccgagccgcagcctagagaacctgaagaggcagtacgcgccgcaaatgccaagaaagcagagccttcggtcccggcggaacccggtaccccgagcctcgccgcggaccgctccggctcagtcttacaggctctgggccgctcggcgagcgccgctcaaaggctaacgtgcctgcttgtttctacccgacctccgaagcccagacgtgcttcagcaagccgcgtggctagcaaactttctctctgctgctgcgggaaccttcccaacgaccacgtgggtttcacccctggtcgctctcggcacttttgcctttcacaaggagaaggagagaacagcctttagagcgaaatatataataataaaaactattattaccatcatcctcatcctcataattgctattatcatggtcaatttctccaagccggttcccccgggagccggggagcgagaacaggttttggcggatgctaacttccactcgctgctcggcagatccattttggcttagcaaaaatatcacagggatttatatttacattttttgaagtaatataaatgtctcagcctctgacaaaataaatacgagtcccgccagaaaaggcaagactaagcattccacattcatagagtaaggggacacttggggagtttttaaagatgagtgcttaattatttaaagagaagacatacgttttctcttccatatttataaattactgttcgctaccaaagcatttctaaagatgcgagcgttgtgcagtcggtggacttggcagcgctgtcgcagccacctgtgcggcatcatacagcagcattcaacagatgcttcaagaaaactgcgatgggtttttgcttttcgaaacagaacttgggtgccgacagtatgttcactgccaaattaaatttcaaagcctgaattcagtggcgatggagggaatcagaggattcccaaaatgccccttttggaatagactggacagctcctttcacaaatatggaaacagaggcacagagagaaatgactgttcctagggcatccagaataaggaaggggcctgacccttatcattgcttccacttccttctccatctctaacttttggggctactgaggcaaacttcggccttcagaatagccggcagctcccaccccttttgcgttctgccgggttaggtcctccaagcctctctctgtacggcctctctgtagcct

SEQ ID NO: 6848 - DNA, 3431 bp, artificial
  synthetic oligonucleotide
cgggggccacgtaatgctgagtgctgattggctgctcttggctcctcccctcatcccgcttttggcccaagagcgtggtgcagattcacccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcggcagttaaaagatttggtctggaatcactgccagtaccgcgcagcttcttcattaatattaccagtataagtcccatccaaggaagcctctgattgctgagccactaagtgcatatgccccttacctcataccttttaggcaggctaaccgagggacgttcatatatggttgagctaagatgatttggggggcggggggtgaggaaatgcggcgcactgagtaacctctgagctccccagtttgcagacaattgcgacctcacatacacggtaatgaaaaaagatatctgggctccagagtttaaatttttcatgaagaagtttacgtacatatcagccattctgacaatcaaaatatgagtgcaatagaaacaaggtgttactgtgtagttggctacatatgtgtagagacaatgacaaaggccaactgacatgccccacagaaaatgatatctaccgtgatcattgcatctcttttgcagtactgaaatcatactgaatattgtctgttctgaagagtataatctccttagcacctggctgtttgggaatcatctacaatgcccccccattccaccccacaggtggggggaaataaataattttgtccatattttggggaggtaggttatagaatatttaattatatttttcattccttaaataaattctcctgatcctcctggggagggaagaaaatatttgtttcatcaacatgatttctttcctaatagcgtctatcatctacagcaacaagcccaacgcaagtcctgaaattcggaagatggataaggcttgttgattgcaatgtcaaggtaggatttggggtgctttagcaaaaatgacggtgtttttctatctgcattatctagagagggttattaaccctttctatgctttcttgaggggtttatctccatctagaggtgtcatggatgacagtgatgactttttcagataatgtaacaggcttttgtgcagtatgaattcatcagaaaagaggtgagaactgatatttctgggaacctcctggatgccagacgtggatccaggactattacatatatatacataaaatatatattatttcatatagtcttcatagcaagtctatgaatgacggagatattattatcctccattttattggtgccattagatttttcccctcaatttttcaaggtattctcaaaagttaatttaaggcaagagaataagaaatatttatttgtgcttccaagtctacttgggaagagcaataaaagtaaaatctaaaaagcctaacattctaatagattcgtccaacattataattgagtcaagcctcaataattttactgttccatgtatttccttcaaggaaacgtcatccctctccagctaagggaaacacaaaaattaaaacaaaatttgggggagagattatagtaaccaacattaaatatcctcagctattcttattaaattgttcaaggcctgagattgaaggaggttgcagtttgctgagcctgctgaaagataaattaattcccaggttttaatggctcctgaagctccagactatttgtccagtattattaaggagcatcttaccacctcactttcatagcaatggaatacctcacaaaaggatgatgtacgtgtactgagattattttagtaaagcatctgatacagcttagtattgtctagt

SEQ ID NO: 6849 - DNA, 1407 bp, artificial
  synthetic oligonucleotide
tttgcttcttgaattttaagggaactctgggcactatcaaaatgagggaaacataatatcacattctaaggaccttactatattcaaacctataagcaacaaatttaagtactagattataggctaatcttaaaaactattttttatagtatcagttgtttttttaacaaaaaataccttagagaaaaacaataaaaattaattatttatgcagagctctaattttgttctctgtaacaggatgcttggtttctgtcttattgtttccctgagacatcaaaaacaggacttaaataaattttcgaaaagagggtttctatagttacgtgtttttgtttgttttttagtattgggtactagatacattacgtacttgtaatctgacataaacaatttaattatcattagcttattgtatctttgctgttgatcaactcaacactcaaagcttactcttcgctaccagtgtcttacaaaatatgtactgactatattttgagaagcctaaaataaatgacaaaagtactaatttgctgaactttggaagtgtatgagaatgtttaagcgatttatgacatgttgaggctatggaaggtagaatggaagatgtggaactgggtgacattgaagtaacatgtaaaatgatttctaggaagccaaggaactaaattgtactcaactagtttttcctgtgagcccagattgtgcacagaccctcttccaaacgtgtttcacaaatccaaggcagttatagaagaagtaagaatgtgtgtcctgattatgagccagaaacatgacctttactgaaaggcaatgatatatttattaactatttaaacatttctagaaatctacagactcatttaatgcttgcattaaagttattttaacaaaatccacttacatactttcttcttatgtatggtaaaaattactttcctctaaacatggtaaaaattatcacctgtatctgcccatgtcttggaagagaaagtacatacaaaaaaatctgtttcattgatattgaaggacaatatatgtatgtatctacaacacaaatatacctttgatttactaagccaagtaagaaatggaagtgtttgggtataatagactctcaatgacaagtcctgccactttttctttcttagcacgtcttcctttgtagactatattgtttctaaagtgagactatttatgagtttatcctcctagcatagatgcctgatctgttctccttttagcttgaaactatttcagtaagagctttacacaataggcttgagggcactttaagaacatgtcttaagaatatttgaaattaatgactaatcatcccaattcaataggacaaatattctgatctacatttgtgcatcacccacacatttttgttttaaaattttt

SEQ ID NO: 6850 - DNA, 6377 bp, artificial
  synthetic oligonucleotide
atcttaagtggcaagtaagctagtcttttgccccatagcatcctgtgttagtggtccatttaacaccttcagctagtatttccagggacttgttacagggacataaatttcaagcagaaaacaattcaaaaactattgaagtccttggtctggtgtctgcttcctctacattctttccctaggcaatacaaccactttcattttttatgctaccatttgttgatgacacctagatctaaaatccaggccacaggctttttccagactttcccttcaagtgttatgaagattttttatgccaagaggaaggcttatctttggtgaaaaagtatgtcaaagaaaaaggaaaccggtcattgtcctgggaacgaaatataaaagttgagagttaggtatatagccaaatagttcatttaatctgcaggaaagaagcagaacagaaactaggctctgccataggtacaaatggattaaatgaagcttttttgctattatgtttatgctggtgtttcccatggggtgccatgattgttctattttactctgtagccattttttcttgccctttttgcttttgtttctgcgtgcctgattctcaaactttgacatatgaccaatctgtttctcaggctgtagacatacaccttcattccttggctaaccttttttcttccttcaccagaactgaggcccttctcttgtgatagagtgccaaagtcaatccattattacaactctgcacctgtctccacccctttttttttttttttgccatttcctgacttcaattttaattgtgaagcaagattttatttcttttaaattttaaattttggtgggtacattgtaggtttgtagatatatatatgcaccatatatatatggtatatggtgtatatatatacacaccatatagatacacaccatatatatacaccatatatataccatatatatacacatcatatatataccatatatataccatatatatacaccatatatataccatatatatacaccatatatataccatatatatacaccatatatataccatatatataccatatatacaccatatatacaccatatatacacctatatatacaccatatctataccatgtatatacaccatatatataccatgtatatacaccatatatataccatatatataccatatataccatatatataccatatatataccatatatatacaccatatgtataccatatatatacatcatatatataccatatatatatacaccatatatataccatatatatatacaccatatatataccatatatatacaccatatatatacaccatatatatactatatataccatatctatacaccatatatataccatatataccatatgcataccatatatacaccatatatacaccatatatataccacatatatacaccatatataccatatatgcaccatatgtatacatatatacaccctatatatacaccatatgtatacatatatacaccctatatatacaccatatatataccatatatatacactctatataccatatatataccatatatataccatatatatacaccacatatatacaccatatatatacacaccatatagatacacaccatatatatacactacatatatacaccatatatatacaccatatatatacacaccatatatataccgtatatatacacaccatatatatatactgtatatatatacaccatatatatatactgtatatatatacaccatatatatatactgtatatatatacaccatatatatatactgtatatatatacaccatatatatacaccatatatacaccacatatatacaccatatatataccgtatatataccatatataccatatacatcatatatatcatatatatcatatatatcatatatacaccatatatacaccatatatataccatatatacactatatataccatatatatacactatatatactatatatacaccacatatatacaccatatatacacaccatatagatatatacaccatatatatacacaccatatatatacaccatatatatacacaccatatatatacacaccatatatataccatatatatacaccatatatatactgtatatatatacaccacatatatacaccatatatataccgtatatataccatgtatatacaccatatatataccatatatacacacaccatatgtatataccatatatataccatatgtatataccatatataccatatgtatataccatatataccatatatataccacatatatataccatatatatcacatatataccatatataccatatacaccatatatataccatatatacaccatatatataccatatatacaccatatatataccccatatatacaccatgtatatatataccatatatacaccatatatataccatatatacaccatatatataccccatatatacaccatgtatatatacaccatatatatatacaccatatatataccatgtatatatacaccatatatataccatgtatatatacaccatatatataccatgtatatatacaccatatatataccatgtatatacaccatatatctataccatatatatacaccatgtatctataccatatatatacaccatatatctataccatatatatacgccatatctataccatatatatacgccatatctataccatatatatacgccatatatataccatatatatacgccatatatatataccatatatatacatcatatatataccatatatatacaccatatatatatataccatatatatatatggtacataagatattttgatacagacatacaatggctaataatcacatctaggtaaatggggtatccattaccttaaatatgtatcctttctttgtgttacaaacaatccaattacattcttagttattttttatttattcattttttttttttgagacggagtctcactctatcaccaagctggagtgcagtagtgcgatcttggctcactgcaacctctgcctccagagttcatgcgattctcctgcctcagcctccccagtagctgggactacaggcgcataccaccacgcccagctaatttttgtatttttagtagagacggggtttcaccatgttggccaggatggtctcgatctcttgacctcatgatccacccgcctcggcctcccaaagtgctgggattacaggcgtgagccaccgcgcccgccccattcttagttatttttaaatgtacaatataaattattgttgactatagtcaccctgttgtgctgtcaaatactagatcttactcattcttcctaactatattattgaaactattaaacatccccacttctctctcccctcccccaaacccactacccttcccagcctctggtaactgtcattttaccctatctccatgagttcaattgttttaatttttttagctcccatttataagcgagaacatgtgaagtttgtctttctgtgcaaggcttattttgcgtaacacaattacccccagttccatccatgttgttgcaaatggcaggatctcttttttttatggctgaatatactccattgtgtatgtgtacattttctttcttcattcatctgctgattgacacttaggttacttccaagtcttacctgttgtgaacagtgttgcaacaaatatgggagtgcagatatctcttcgatatactgatttcccttattttgggtatctactcagcagtgggattgctggatcatatggtagctcaatttttagcttttggaggaacttccaaattgttcccatagtggttatattcatttacatttccaccaacagtgtaccaggcttccgttttctccacatcctcgccagtgtttgttattgcctgtcttttagatgtaaggcattttaaccggggtgagatgataccttactgtagttttgatttgcatttttctgatgatcaatgatagtgagcccctttttgtatgactgtttgccattcatgtgtcttctttggagaagtatctattcaaatcttttgcgcattgttcgattattttactagatttttcctatagagttttttgagctccttatacattctgcttattaatgccttgtcagatgggtagtttgaaaatattttctcccaacctgtggccaccaccactgggactgtactaggtcagacctgaggccaacacagaaatgggtctgcccaggtcctgcaatgaccactgcctggctactgtctatgtttgctcaaggcccaagggctccacaattatttgatgacaaatccagccaggcctgtgtccttcccttcagggtggtgagtttccttggccctgggcaggcctggagttgctgtctgggagccagggtctggagtcggttaccttaggaatctacctggtgctctagtctattgcagctgagctgacacccaagctacgggacaaagttcttcccattcttcccttccctttcatccagcagaggaatcacttcccatggccgccaccaccccatgcacgtgacgagtactgcctggctacccctagcaatcactcaaggcccatggggctcttcagtcagcttatggtaaatgctgccagtccagtgccttttttttgttgttttttttttgacagagtttcgatcttgtcacccaggctggagtgcagtggcgcgatctcgggtcactgcaacctctgcctcctgggttcaagcgattctcctgcctcagcctcccgagtagccgggcttacaggcgcccgccaccacgcctggctaatttttgtgtttttagtagagacagggtttcactgtgttggccaggctggtctcgaactcctaacctcaggtgatctgcccacctcagcctcccaatccagtgccttttcattcaggccagtgggctccactctggctcaaggaaggtccagaaatgctgtccaagaaccaaggcctggaaccggggaccccaagagcccacttggtgctctgccctactgtcaccaagctgttacccaagctacaagacaaaatcccctttactgttccctctcctttcctcaatcagaaagagtctctctccatgaccatcacagctgggaatgtgctgggtcacatctgaagccagcagggctctgagtctcacccaaggcccatggcaaattctgctcggctaccactgctgattattcagggacaaaaggttctttagtcaggaggtgatgagttcttccaggacttggtcctgcccttcaaggcagtgggttctcttctggcctaggtgtgttaagaaatgttatccaaaactaaaacctggaatgagggcatcaggactctgcctggtatcctattctactgtggtggagctggtatccagattgcaggacaaagtcctcaatcctctccccttttctctcctcaagctgagggaaggagtctctcccagagctgtgagctatggtgtcagggattaggggaggggtgatgcaaacattcccttggccacgccagctgatatctcactaggtctcatgcaccccaagtgcactggctccaagcccagcacagcaccaggacttgcctcatagcctagactgcctttcaagtttatttaggacccggggggcacttttgcccatggtggtggggcttgccagacagaactcaggttctgaccactgggatggacaatttgcctctagctagggctcatctaaatgctctctcagtgggcgctggctgatttctgccccatgttgcttaccagcactgagttccaatgcaaagtcccacagtcactgcattctccctccaacaagcatacagattctttctctgcaccatgtgaccactgccagaggatggggcagtggtggtggtgtaggcaattcaagactgtctttcctaccctctccagtgcctctttccttaatacaatgttaaaaccaggtactgtgatcgctcacctgatttttctttgtatgaaggtgcttttttttgtgtgtggatagttgttcaatttggtgttcctgtgagtgggggacaattgctggaggcttctattcagccatcttgctccacctccctgaagcaaataaaaaagctttagaaaaatttgtacccctcacaccaaagtgattaaatgatagtgatagtccacctaaaatgtatagtttctgatttttaaaaccagtttatatattttatatttcattacataaatgtacaccaataaaatggccaaaaatgatatagtaa

SEQ ID NO: 6851 - DNA, 1870 bp, artificial
  synthetic oligonucleotide
ataaactgcatctggtccttgaagatctttgctagaaaataatatttaaatattatttagatcagatgcccataagtgtactattttataacaaaatgaagctcggcaacttttccatgcatcttcgtttataaaccctttctcaaagtttggatatcttctacccatgctattattgccctttgcatatctaacttttggctgagatagaagataaagagatacagaggtaccatcgtgactgatttatttttcccagcacagcaaatgatatgaggtatgtttatgtaatacatagttattttgccaaatgaaaaattttaattctaaatgcaaaatcagcgctccagtccaattctttaaaaaaacacaagtttcttaaacttttaataactaaataaaaccattcaaagaaaaccaaagaaagaaaatgatgaaccattataagagagaactatttctacataatgttacataattctaagtattaatctcaaagtcaaaagtaatgaattactgtccttaacataaggaactatacttaagagttcttaatgttactatatataaatataattttcacttttaaaatttaatataagtaaaatctcggccttttattcaaaataaaatctccagacgtcaactgccaaaagaatacagaaatggattttaaataaaagctatatattgactaataaaatacataatgaattaaatataagttggtaattacagaaatatggttagcataaagaaaccaaagtccattacgctggattcctcactagcgtggatctagtagggcctcactaggaaaaagtgataatgagatgcaaaggacaagtatcacacaccaatcagtgtagctttgggccaaacaatttcagaattaaggacacttcttctttgtataggcatgcattaaaattgccttaaattcttaaatacagaaaaattaaggtaatgaaatatctaaaactattaggaaaaatatattttaaaagagtgatttttttttaaagaagagaccgcagtaagtactaccctgggggaaatttcagaattattgcaggggaggggactcaaactacaatggccttcactatagtaaattctaactccttctcaccacacattcattagcattgtgattacggttgtgtatgagttatattgaaacagaaaaacaagttgagatccacttacctatacaatatattttatgtacttgagaattcacctatgtaaaattttgctatgttcattattttatgatttactctgataccaaaagtcaaaacaaacatctattctaattaaacatctagattattaacatacttccctaatccagttactagtacttattttaagtaaaagactatacaattcagctatgtcaacctggccccataatacttgaaggcttccacaaactctagataccttgattcatgtcctgctgctctggtcctctggaagagtttatcactgaatgatgctcctacaacttaaaggcctctgtctgtattcatatttcacataaatcaaccaaaccaaaagatgggagaagatgtttttggagagacagggtagtcatttgtaaagaaagcagaaacaaaagaatacatagatttcaaggactgagagatccacctaattagttataacaagctagaggttaacatgatgctcctcaaattgaaatgttcacatgatcagggaaaaatcataataaaacaggtaatgtccataatttctataattctaaaacaaaattataaacttcctaaacctagttttgctttccatgatccttaattatactttaattataacttttcataattgctttttgttatttagc

SEQ ID NO: 6852 - DNA, 1228 bp, artificial
  synthetic oligonucleotide
tctttataaagcccccctctgctgttcaaacgaccaaatcaaatgttatccctccctctttgaacctatgctgcactttccatttatcttactctaacccagggtttctcaaccttggcaccatggacattttagacaagttaagtctttgttgtatggggctgtccttttcaatgtaggatgcttggcagcatcccttgcctctacccactagatgtcagtagcaacccccaaattgtgataatcaaaaatgtcttcagccaggtgtggtgctgcaggactatagtccaagctactcagcaggctgagacaggaggatcacttgagcccccgagttagagcctgtgaacagccactatattccagcccaggcaacatagccagggcaacatagcaaggccttgtctcttaaaaaaaaaaaaaaaagtctccagatactgtcaaatatcctctggaggcaacctctccaaccctacccttccccacaatgagaactactgatctaggatataataggtatatgagttcttattttaaaccattatgaaatcattaactcactgaaagcagcaactttacaacctttacaaaatatctatatgacaaatccattcttacatactcattaaggtagtttaaggacacagtcatctatgtttaatttactatttctaattcacaaaaacctttaaatgtaattatttcccattgacatagacatccccaaccaagtagctcaaaatactaaggatttacgtattgcaattatttttttaagaagtgaaaaactctagactatacatactagattctcttaggaacataatcattaacaaaaagccatttctgagtgaaatccaaattcacaaatgttctagaatcagttcatctccatatggttcaaagaaaagtttatgtcacagttatcttatacctgtctcttgtcaccttgaatctctaatattctactgagacaagtaattaatctaaaaataaagtgacaacattctctgtcacaaattagaaaagactacacagaatcaagtgttcctgaaaaggaaagaacttactttcctatttggaaaaaacttttcctcaaagaatttgatataaaaaatacattagaaaatatctactgttgaattatccattacagtccattgacaggtattctgttaatggaatgctatctatttacatgaaacaagagaaatgtaaagattaaaca

SEQ ID NO: 6853 - DNA, 1017 bp, artificial
  synthetic oligonucleotide
gatggctacagtgggctggcattgggtatttcccttctcccaggtcacttaagctctcatgaaactccagtaggttaggctctggttaaatagtttctcctgggggcagactttttcagacctataatcccagcactttggggggctaacacaggaggattgcttgagctcaggagtttgaaaccagcctaagccacatagtgagaccctttatttacaaaaaataaaataaaataaattagctgggcatggtggtgtttgtctgtaatcccagctgcttaagaggatgaggtgggaggattgcttgagcccgggaggtggaggctgcagtgagccatgatcatgccagtgtactccagcctaggtgacagagcaaggccccctctcaaaaaaaaaaaaaattgtaacaaaaattttttaaataaaaataaagaacatggccgggtgtggtggctcgtgcctgtaactccagtactttgggagaccaaagtgggaggatcactggagtccaggaatttgagaccagcctggccaacatggtgaaacctcatctctactaaaaatacaaaagttagccaggtatggtggcacattcatgtaatcccagctactctggaggctgaggcatgagaatcgcttgaacccaggaggtgcaggttgcagtgagccaggatagtgacacagcacctcagcttgggcaacagagtgagaccttgtctcaaaaaaaatgagaaagaaagaaagaacaggatgctctggcttatttcaaaatgatttcctttcccctccccttgctggaatttcaagatttctctctgatattcactgtgaaaaacagatcaagctcctatccccatgaccggggcgccctggagtttgtaactctcggaggtgtacccactgagctttcagcagttcctcaactatagttcaggttttcctaccactgcactggttcctacagaggtttttgttctgataaattgtgattctctgtatttgcctgtctctccaagt

SEQ ID NO: 6854 - DNA, 1160 bp, artificial
  synthetic oligonucleotide
agtttgggaagaagaacatgagcttccttctgatgcagtccaagatgcataaataaactgagaataaatattaaacaatattttcaaattgaaagcatccttgtccttttatttatttattttttgagacagggtctcattctgttgcgcaggctggaatgtggtggtgtgatcatggctcactgcctcttctacctcccaggctcaagcaatcctcccacttcagcctcccaagtagctgggactataggcacgtgccaccatgctctgcgaatttttttttttcttttctgtagagatgaggtctcgctatgttgcccagggtgggaaagtatccttctattattcatacttttgaaacttttgagactatcatagctgaactcactagaaaaaaaaaataccctgcaataaagaaatgtattaaaatttaagcataattatttcaccaataaattgaataattacagttttcaataatactttacaattctattaagctagtttcgtacttaacaagattttgtcttattatcagtggaacacagttgtatttgttcaccccatgtatttattcaacacaaccttttgatagaaggcttcacttgtttgtaaggaaagaaaactaatgtgcattttgttttccaaaggtaggaaatacatagtacatttcttatatacttatttcttatataaacattcataaaagggactgcaagctcctttggaaaggtacttggatacatacgggtctttagaagatggaactcagtcctatctttcctactgacccactgtgctcccaacaccaatcacttagaaaagagaaaaggtacatgtgcatttcacccaatctccttatttaggtttttcagtacaaaagctggagagtggctatagctttatgttttagcaaaacaactaattttttacgtttttattttaaaataagttttctgtgcataatacattttgtgctggtacctcccctgctgtttagcagttgcttccagcttctggtagtgttaaactagaaagtcataatgccaaattgaggggatgttgtgtttgtcaggcagcatatactagtagaaagcttgatttctcagcatggtctatatgactttatccacttacatttatgtagcatcatagagatt

SEQ ID NO: 6855 - DNA, 4073 bp, artificial
  synthetic oligonucleotide
ctcagcactgggttatcccacagctcatgttgtagtcatctggctccttttgttttggtttcatcctttcttgtgtgcgggacaaggactatgaggagctggcatctttggctgccacactcttcctttcagtgtcaatgtatgtaagaaactttgtaaatctaaaagtagctcattctatctaccaaccaaatctgacacgcttttgcattagcttgtcttgtgtgtccttgacaagagattttaagagttctttttaagaggtctttattatcttggtaattgtgttcacactaccgaagaattagaagccccttgaggattggcagctgtcttattattacattatatcctaccagtattttttgcagctactgctagattttgtatgtcttggtcctggactgctagaactgtttgttgtacatcttggtgagatgtggcacacctgcagcctttcagttacccagaactttcagtttgaaatttccaggaaagtttgggaataacgaatctaacctattcacttcagctgagaagtgaaaaagtacgatctgggagttatgcatggcagtggagaaccccacctacagggatgttttgaaactatatcaatgattgaaaaatattttgtataaaataacaacaaaataatgataagaagaatttgtgtaccttgtgaatgagtaattctactcctatttctgtgaaatgaaaatgtgttcatatgtaccccagagactactatagcaaaaagattatcatagcagcattattaattttgtaacagcagaaagcaatacaaatgtccattaaccgtagaatgcatgcataaactgtggtatttttatgcaattgaatacagtaatgaaaatgaatgatcaacattatatgcaacaacatgggtaaacctcacaaacgtaaggttcaatgaaagaagccagagagaaaagattacctactgcattattttatttatataaacttgaaaaagaggcaagattaatctataccattagacatcaggatagtgataaaccaggaatggagagaaaatgactggaagagagaatgagggttctccttggaagtggtaatgttcacttttttttaacctgggtagaggtttcatggatgtgttcagtttgtgaaaattcattgaactgtacaaacatgattttgtgaagttttctatatgtatacttcaataaaaggcttattacaaacattagctcaaatttattgaccattttctaagtacttaagcaataatttggaataagagatcatggtattgcacacctatgataaacaagagactttacagactcctttgcaaaaatgatgttgtttcatttgaaaatttcccccaagaacttcaaattctactgccaatcctggtgttcaaattcctaagagtattagttctgctctggggtaagtaagggttatagtacctgtgagacttaaagttcttaaaaataatataatgtatacaaacacatttttgcagcaataatgcacatgtgagggcaaattaaacccagactgtaatttctgcaatttttaaaaataaacctttgaggaaaataaattgttctacaaaaaagacacatgttctagtttgttcatcgcagcactattcacaatagcaaagacatggaatcaacctaggtgccattaatggtggattggataaagaatatgtggtacatatacacaatggaatactatgccgccataaaaggaatgaaatcacgtcctttgcagcaacatggatgcagctggaggccatcatcctaagcaaactaatgcaggaacagaaaacctaatactgcaagttctcacttataagtgggagctaaatattgggtacctatggacataaagatggtaacaagagacactggggactattagaaggggaagaagggtggggagaaagggccagtaaaaccacctattgggtattatgctcaatacctgggtgatggtatcattcatgcctcatcacacaacatacccatataacaaacctgcacatgaactgcctgcatctaaataaaagctgaaattataaaaaaatacaaacaaacaacccaatcaaaaagtgagcgaaggacatgaacagacgcttctcaaaagaagacatttatgcagccaaaaaacacatgaaaaaatgctcaccattactggccgtcagagaattgcaaatcaaaaccacaatgagataccatctcacaccagttagaatggcaatcattaaaaagtcaggaaacaacaggtgctggagaggatgtggagaaataggaacacttttacactgttggtgggactggaaactagttcaaccattgtggaagtcagtgtggcaattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgataggctggattaagaaaatgtggcacatatacaccatggaatactatgcagccataaaaaatgatgagttcatgtcctttgtagggacatggatgaaattggaaatcatcattctcagtaaactatctcaagaacaaaaaaccaaacaccacatgttctcactcataggtgggaattgaacaatgagaacacatggacacaggaaggggaacatcacactctggggcctgttgtggggtggggggaggggggagggatggcattaaggatatacctaatgctaaatgacgagttaatgggtgcagcacaccaacatggcacatgtatacatatgcaactaacctgcacattgtgcacatgtaccctaaaacttaaagtagaataataaaaaaaaaaaaaaaactaggagttaggtacaaagtatagttagatagaatgagtaagatcgagtgtttgatagcacaacagggtgactatagtcaacaataatttatagtacattaaaaataactaaaatagtataattggaatatttgtaacacaaagaaatgcttgaggtgatggataccctatttaccctggtgaaattattacacattgtatgcctgaatcaaaatgtctcatggaccgtacaaatatatacacaatctaccaataaaaataaaaaataaaaacatctaaaaataatgaactttttgagtaagtttagatttacagaaaagttgcaaaaatagtacagataattgctgtatacctctcactaagtcgcccctaattttatcatcttatttttaccatgttatattcactaaacctaggaaaccaacactgatatataacagaactctacactttcatgtttgtccatgaatgtcctttttgtattccaggatccaatccaggataccacattccatttagttggcatgtcttgcagtatcctttgatctctgatagtctatttttggttttcatgagcttgacggttttgaggaatactggttagcctttctgtacaatgtccctcaatttgggtttgtcttatttttgtttacttgattaaactgggtttatgggattttacatcataacagggagtacaggatatccacatgacatcattagtgatgttaactttgattacttggttaagatactgtttgctagatttattcacaaccctattcacaatacaattactattttcccctttccatactttgttctttagaattaagtcactaagttcaatctacaatgaaggggtagttaacctccacctcctattagtacagaggggctacatattctacttgaaattcttctttaggaaagacttgtgtcttctcctacattgatttattcattatattatttatcagtatggccacatgtatatgctttaaattttattttattatccatattttttgaaatccaatactacatcatttattttcttgctcaaattgtttcaactttggccactgggagctcttttgagtgggctctagtgaccttttgac

SEQ ID NO: 6856 - DNA, 711 bp, artificial
  synthetic oligonucleotide
tttatccttctaactctgtaaaatgggtattagatcattcatccccctccctctcttttatttaaacagagaaaacagaagcttggaaaacttaagtaacttgccccaaataacacagctagcaatatggcagtacttggatttgaaccaattaggtctgactttaaaataatgctctttcagggctggacatggtggctcatgcctgtaatcccagcactttgtgaggcagagggagaagcaggaggatcgcctgagccgaggattccagcctgggcaacacagtgagatcccatctctaccaaatattgtttaaaaaattagccaggcatgatcgtacatgcctgtggtcccagctactcaggaggctaaggtgggaagatcgcttgagcccaggaggttgaggctgcagtgagccgagatcatgcactgcacaccaatctgagcaacagagtgagaccctgtctttaaaaaaacaaatggtctttccattaagtacattgtttctcaaataaaggaaactggaaaagtgggcataatctgagatcaactcacaagtaatacaataaacacaagggcataaaaaaaataactagattgtaagcccattagtggcagaattatgttagcactctgcctggaccataaaaagagtgtaataaatgcttgttaaagtaacttcaaactagaggcaatactgctttctgacct

SEQ ID NO: 6857 - DNA, 303 bp, artificial
  synthetic oligonucleotide
attataggaccagttgggttttctgttttttattcagagttgggaggaacgggagggagacgaccatcttctggcgatatgaaagtcgagaaaggcaaacaggaggggagcaagagaggaaaagaagaggatgtgaaaagcccgaaggaaggcaggagagcaagcaggtaggaataaaggcgaggaagcgggagccagctggcaccacagcgaggagtgacagccgccggcagcaggggccgggagctgggaggagggaggctcaggcaagccgcgctgagcctttcttctccttcccggact

SEQ ID NO: 6858 - DNA, 1400 bp, artificial
  synthetic oligonucleotide
ttgagaaaggaagacatgtaatttatattacataactctttaaaaaaactagtcaaacataactttttgtatagtctatattatataactattgagaaaagcctggagcatcgtaatgaaatattaatatttctgaagtgaaaggtatgaaaattcacaccaagtgtgaataaagactataaatagcctcacactacttcaggtcaggttttgtcatctattgagtttgggctccaaagtatgaaaaaacaaccttatgcttttcagaagttttggcattgcaggattgtgcctacaggcttgtgagcctgcatgctccgctaacctggccttgtttgtgtagttctccccctgctggaaggtaagccccatggcaccaggggcttgtccagctggttcacctaatgccgagaacactgcttggcgtgtacaagacacttaaaacaaatgtgtgaaataaatgaattaatgaattaatcttggaagaatttccaggcacagtttcatgattctttcacctgcccaactccgggaaccttcacctcctctctactttaaccacctgtccaggccaccttattgcacttgtcattccctggaataacctcctgccctccccagcatctacacaccatcttttctctctctgaccatgttctcgagttgtcttggatctcttcccctctaccgcttttttttttttttttgagatggagtctcccgctgcccaggctggagtgcagtggcgcatcttggctcactgcaacctccgcttcctgggtgcaagcaattctcctgcctcagcttccagagtagctgaaattacaggcatgggccaccacgcctggctaatttttgtatttttagtagagatgggattttaccatgttggccagtctggtgttgaactcctgacctcaggtgatccgccctgcctcagcctcccaaagtgttgggattacaggcatgagccatcgcgcccagcctcagctctattatttactagccgaatgaccctggacaagttacttaactgatgtgcctcagtttcctcttctgtaaaatgagtataaacaaatgactattcgtagggttgttaggaataaatgagttaacaactatgtatttaaaaaggacttggaacagtgcttggcctttagcaagagctatataagtgttagctatggttactcttcagagcagtgtttctcatccttttctatgctacggacacctatgggagtctggtgaagtcttaggaaccccttcccagaataatgcatgcgtcctataagtaggattacaaaagaaaccaattatattggggtacaattttcaaaataaaaggaaacgcacctgtaatgtagtaatatatgtgcttctttattaacacattaaat

SEQ ID NO: 6859 - DNA, 4343 bp, artificial
  synthetic oligonucleotide
gcacatggtaggaccagctgagcagtgagaggagggggaagcctgtccattcgctacaggacttcagacttgctctgtagtgtggctggattaaacatagaaccatcaaatctgagctggaggggtacttcaagatcatccaaggcagaccttgccatttaaaaagatacgggggaactgatggcctaagagagaaagagactcagtcaaggtcacaaagccaatctgcagcagagctggaaggggaactcaggtctcccaactcccagctcagtgttccttcgaatacggcagaaaagaaataagggagcctttagggcagccttgggagtctgcacgcccttgactctctcagcctgatacatgtaacccaatcagctcaccatggtatctacacagaaaaagtggacccagcccatgtcccaccaacccaagagatagtgccaaggtgtcccaaatagacacacagaccccagtgcaggaactggaaccgatccagcagaggggcaatctagacttcccttcccggtagggctctttaaatgggtgttgtttttcttgaagggtggagagggggtggactttgaggaactagccaagggcttggcctccatctttgctcccccatctttgctccccccggccagaatgtgctgcagttcccttcagagggatgtctcagcctccagcagccattctggtccccacctgcctctttggtaagggatggagctgaggcggccagaggagaaaagatcaggcaaaaagaaaaaggaaaaaaaaaaaaaggcgggggtggggggctttctctcccctggggctctgagtagacaccctcgccgaccataaaaattccaaccagcatacccaaaataaataaataaatgaaaacctatcttctggcaaggatgcagctaggggttgaagaagtggaggcgggggaggcggcgatgactgctctagtccctcgctggccgcggtaccgggaaagaagagacgcctgcactcatctggccaacccagcctggggtggccagggaaggggtgtcggctggatgagggggacctggcttctcctggcgggttgggacaggagaggaagacacggaaccagacactggcttcttactctatcagctggacaagttggagagggatctagagggaagagccgggggtacaaacacacattccttactttctctggagggtcgtggccgggctggtgctggtactggtgctgtggcctccgccggcgccgggactggagctcctggatgcgccacggctcagctggccccgctcccgcggtggccgcggccccacgcccaccgccgccgaatagcccgcttccttctcgcggcccgggtgcgccggcccggcctcccgcccgccacgctcgcgacccagggctgggttctcgtggtgcaggtggcactgggccacgtcacgctcgcgggctgtgtaaccggtagtgtcctggagcgggtaggaggcgtcccgctccttgtcccgatacacagcctcccgattctggtaggcgccttcccggttcgggtagcccacgtcccgggccgcctggtggaactggctctcccgcagctcgcggtggtggaactgggtctcgcgcaggttctggtactggctctcgcggcccgggctatcccgcgcgccgtgggggtcccggtgcagctccccgcggtgcagctggctctcctctcgcaggtcgcggttctcctgggtgagctggtccagctggccctccagctcctcgatgcgccgccgctgggtttccagcagctgctgctggctctcgatgatgttgttcagctccagcaggtactccacggcccgatttgggctctcggatcccgggccgcccgggggccccgaccccgcctccatcctggcggcccaggggcaggggaacgggcaggagagccctgtccccgctctctcacggcgccaccctcccccgggcccagccgggggagggggccggcgggacgcgagggcgcgcaccgggcttgagggcccgggggccctagggggcccgggagacagcgctggggccggcggcacggggagcaggagctgaggctgccgccgccaccaccaccaccacagccactgctcgggaggacgcggcccacggcgctccgcccgctgcggagtcactgcgcagcgcggccgcgcgggaccgccccggccgccggcccgccccccgcccctgcccccacccggctcgcccggcccgcccccgcgcgccccacctgcggctgccacccgcacccgcagctggactggccccaaggcaccggcgcccggccagggccagccccatgacagcccgcaagagatctctccattccacccgtccctgggtcctcacttaacggagcctaaagaagccctccttcccagagtccgcccgtccctcgggttcgccaggttggggatcttcatccaaagccatcccgggaggaacccccatcccaggcagtccccaggtcccgacaacccgtggactccccatgccctaggtctgccaatcccaagcagtgtcagattccccttcctagccagcccctgtgtcttctacctcaggcgacctccctccagcccccatcatgggcagtcgtccctgagtctcccatcctggccagtcccttgactgtctgcagctgccctcatcccaggcatcccttgggactcccaaaggatgcgcacacacacactcatgtacaacatcgcaggcatctcccactccagccagcccttacactctccattcaaaccagtgcccagatctcctaccccagccaaccccagaatcccccatctcagccagtccccgggtcctctaaccaaggcagtccaggatctctcaactcaacaagccctgggactccacatcacagccagtcttgggatcaaggctccattcattcaaccaaccctcatttcctgctctcttttagaaatgctctccccattcactccatcatccccatccactgaaactgtacccatccttcaagacttaactcaaatgccaccttactgaagccaaccctgatttcctcagccagaagtgcaagttgctgctctctctctctctctctctcccctcttgacctcctgctgcactccctatcttgtggaatttgtggaacaagtggaacttgctttacagcacattcgtctgtgttcttgttttatgtcctctgccagacggagctccttaaagacagaaacgtgtcttaatttatctttgtgagcaggttgggttagaggagaaaacatgagttttacagtcagacaaaactggatttaaattccatcttctctcttaatttcaatttccctatcaataacagctacctgacagggtggtcttggataaaagcatgcaaaaaacaccttgcacagaaaagacaacccacagaatgagagaaagtatttgcaaatcatgtatctgataagggacttgtacgtagaatatataaagaactcttacagcaacaaaaagacaactatttttttttaatgggcaaggaatttgaataaacatttctccaaagaagatatacaaatggtcaataagcacatgaaaagatgctcaacatcattaaccatcagggaaatgcaaatcaaaaccacaatgagctctcagtgctacccatcaggcgtttcctgcattctcccataacctaaagggaaacttccacaatgtctggagcccttaatgtcctgcagatgaaggaagagatatcctcaaattccttgcagcagaaccccacttgaatggcaccaaccttgacttccaaatggaacagtacattacagaaggaaaagtggtggcatctacatcataaatctgaaaaggacctggaagaagattctgccattgttgccattgaaaaccagactgatgctagtattatatcttccaggaatactggccagtgggctgtgctaaagtttgctgtttccactggggccactcttattgctgggcacttcactcctggaactttcactaatcagatccaggcagccttccaggagccacgtctgctggtggttactgatcccagggctgaccactaacctctcacagaggcatcttatattaacttgcctatcattgctctgggtcacacagagtctcccctgcactgtgtggacactgccatcccatgcaacaacccaggagttccctcagggggtctagtgtaatggatgctggcccaggaggttctgcacgtgcgttgtaccacctcccgtgaacacccatgggagttatgcctgatctctatttctgcagagatcctgaaaag

SEQ ID NO: 6860 - DNA, 1855 bp, artificial
  synthetic oligonucleotide
ctattgttgggcttcattcatttattgacaaatatttttatgtaaaaacaaaagatagtaagtatgaaatcccaccaggaatcagatttggttaatttttagtatcaaataccaatcacaagtaaatcaatcaataaaccaagaaatgataaaaatgatattgtcgtaatatttttaaaagagtcttgaccttttaggagtagatactgaaatacttaaggatgaaatgatataacagatatgcttcagaatactgggagtgagggaagtgggtagggttataggcagaatgagactagctatgagttggtaattggtaagtctgggcaatggatccactgagattcattacagtattctctttactttttaatgtttgaaatactctataataaaacttttttataaaaaagtaacaatcagaaaaataaaataatactgttctctttagaaacacctaatactatactatataatagtccacatagcaacaatcatacaatgcttctattttttctctgtttcttggtgataagacagccctcctatttttgtagaagaaagaaacttgaggaaaaataagaagaaaatcaaattaaaagaaaaataggcggggtgcaatagttcatgcctgtaatcccaagactttgggaggctgaggcaggaggacttcttgagcccaagaatttgagactagcctgggcaacatagtgagactgcatctctaccaaaaaaaaaccttaaaaaattagccaggcatggtggcacatccctgtagtcccagctactctgaaggctgaggtaggaggattgcttgagcctaggaggttgaggttcatgccactgcactccagcctgggtaacagagcgagaccctgtataaataaataaataaataaataaatatttttcataaatgaaggctaggcgtgatggctcaggcttgtaatcccagcatcttcggggcctgaggcagaaggattgttcgagctcaggagtttgaggctgcagtgagctatgattacaccaccgcactccagcctgggtgactgagcgagaccttgtctctttttttttttttttttttttgagacagagtctcactctgtcacccaagctggagtgcagtggcatgatctcagctcactcactgcaatctccacctctcaggttcaagcgagtctcctgcctcagcctccggagtagctgggattacaggcatgcaccactacgcccagctaatttttgtatttttactagagacagggtttcaccatgttagccgggctggtctccaactcctggcctcaagtgatcatcccgcctcagcctcccacagtgttaggattacaggcgtgagccaccgtgcccagccgaccttttctcttaaaaaaaaaaaaaaacagaaaagaaaacaaaaacaaacattgtccacataggtataggccaaactccaaaacctcactgatgataaactagcaaagtaataatcatactatctggaatgtttcaacgggaagtgatgaaaacagttaccacctctctttgcacatggttgctctggagccattcttgctctagccctctgctgtggtaggagcctaccagctgggcagctctgctcgtttgtccacttacaagtgcaagagttagctggtctctgcacatgagcaggtttggctccagcggtatacctgttgcaggatgtgtatgtcagttaagtgtatctgtgtgtgagcaagtttatatgtgtacacatgtttgcccatgtgtacttgtctttgtgtgtgtctgtatatgtacaatatgcaatttttatctttgtgtttgtttgcgtattgctaaagtgtatgag

SEQ ID NO: 6861 - DNA, 1455 bp, artificial
  synthetic oligonucleotide
gtcatgctgtcagttcccaattgacaagtcacagactgggagaaaatatttgcaaatcgtgtatctgacaaaaggtttgtgtccaggatgtacaaagaactctcaaaccggatagtaagaaaacaaacagcccaagtgaaaagcaggcaaaagacttgaatagacacttcaccaaagagcatacacgcgtggcaaacaagcacacgaaaagacgttcagccgccgatggcttggttataatttataacttacttatttttatctaataattgtagattcagtgtatttcttcaaaaaatgtttaattaaatgcatgttaatggtgagtgaatcccttgggtgacttcgtgtttaggtcgtattagggcatttgttggatcaacggatcattttaaccctgacttccccttattcccataaaagaagttttccagtggaatggagatttcattttgtcagcagcagtgaccacagccttaccaaagcagacgcgtgcgcgtgcacagatgcacacacacagatgtcttaaaagactagaatccacacttcctgagccagaggggccgtgttgacggtaatgcattctctatagagccaagtccaaactggcaagctcaatgatgcaggcaataaaccgcctttttggcagcctaccaatgccaaaaggataaatgtctttccaaaagtgtgtattcctgttaaattaagctcttgctaacttgaaaaatccctgttctgccagcgaagcttcctcctcctctccagctggtagtcacttgcgtgaatgctggtcagtctgaaaaggtgaagctggctgtgcacttacccccatctttctccctcggggagacgacccaaggaatttcagagtattttgtttggcagagcttttacctgttattctttgccctcaaatacagtattgtggtcattttgatgatatgtgtgtaaaatgtgaataatccaattggtgtctgtactcagccttttgatgtctttttaggactttctcttctacacagcaatacgtcgtgctcgagtatccttgtagcaaagcacatagagccagctgtcctgtcagttcccctgtttgcctctgaaacgtctggttagtggggacccaaagattctagtgagtcaacatccataactctgtatctagttgtattattcatagaaaatcaatctggtgctaatggttggccctggtgttgttgggtggcagctgctccttcgccctcttgtagtgtggctgtggagggctctgcctatggggggtggcctgtggcttgtatccttcagtccaccacagcaaatgtgtgtagatttcatgctcgacacttaccactcacctatcaacagatcatcctgcttgactgtaacaaaataaatagtgtctcttcaagtgaatggagatgtctttgatttacctactttacagcttttgtaaaaaaa

SEQ ID NO: 6862 - DNA, 682 bp, artificial
  synthetic oligonucleotide
ttaagcagactgagaggtgacttcagtgcttgtcctcatcatgcagatattttatctctggaaagcgaagcattgttgaggtggtcagaattgatcaattgcaggtgtgactcatagcccttgaaatatgatattggacttaaaaaaaaactgctttctctcctctcattttgatttctggtcactgtgattttccaaatccctcaagctgaaaaccctgcggcaggtgacatgtccagatcttccttcccagcctctggagttggtgcattactcccgtgatttttctctgcctcttaccccaggagttctgcagagatgtaggggtagtgcccatcagggtcgttgtccttgtcgttttattcttattgccaaataaattcatttgtgtgtgactataagacgagtcttccagaagcagctgctgtagtgatgagttcactcctccactgccatggctgccttcgctgggcccccactgcctgcaggacagcgtccagattcccattccagggcggggtcctcgtcttcccccacttcggccctatcttcagacactcccctgcacacacactcatgcctcaggcctcctgcctccacgcccttcttcacggggaagcctctgcggaaggccttcccagctttttctagttgccgtttctatttggaggccttcttatct

SEQ ID NO: 6863 - DNA, 1221 bp, artificial
  synthetic oligonucleotide
taagatctagctttacaatgccatgattttgtgaatgaaggaaaacttaattaggatgattgacatagatgatcatctagtatgattaccatcttattgttaagtagagtatgaataagggaataacattgtagtattgggctcatttgtttattcaaagacagtgtgagatcatgtttggtattcttcctgatttttttttttttttttgacacggtgtttcgcccttgttgcccaggctggagtgcaatggcgtgatctcggcttgccgcaaccttcgcctcccaggttcaagtgattctcctgcctcagcctcctgagtagctgggattacaggcatgcaccaccatacctggctaattttgtatttttagtggagacggggtttctccatgttggtcaggctggtctcgaactcccaacctcaggtgatccatccacctcagcctcccaaagtgctgggattacaggcatgagccacgtgcccaacctcttcctgatttttatatgctaatgtttactatcctcaactgagtttcatcatttagcctgtttcctcatctctaaaatgacatgataatttgtgattataaataatgtaaggaaagcattgaactcagtgcctgatatctaatatgtttcataagttgcggtctcatcatttttgttatttaaaaaaatttgttttatttaaatgctgctgtgtgtttgcagaagtggaatgtagattagtggacaggaagctggatttaaatatatgaaaggtgctagatgttctgtataatatactaaaagatgttatttgtgtatttagacaaaatagatgtgatgtgggcaaactaagctctaggattattaaggagcaataacctaactcaagagcccaatccagatatttcaaatcactagcaatttgacattttgttgtaacctcacactcaccatttctaatatacagcccatcatcacctctggactcttcactcattcctcattcaagactcttcctttcacttccctggttctgcaacttactatgaccatagtaatggtgaacttatttaaactctgtactttagttgtcatatctgtgcattggggataataatagacactacctcataaggttgctgtgaggaataagtgtgttaattttgtaaacacttagaaggcggcatgaaagtgaagcagtgggaaaatgtagctgttgtggtactcatg

SEQ ID NO: 6864 - DNA, 2242 bp, artificial
  synthetic oligonucleotide
aatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacat

SEQ ID NO: 6865 - DNA, 1546 bp, artificial
  synthetic oligonucleotide
tcattataattattgttagtacaaaatttatcaaaagcataaatatattattggttttgataaaactagacatataagtaagacttaatttaaaattcatttgggagtttttttccctattagtttatttacctaaatatcaatgttactcattgctagcaagtattttcctttttattgtttttataaatataagcactgaaatcatttaataaataaacaaatagatgggaatgtaaagactttgtcataataattccctccgtctctgattttgagtccatctctagagtcttgggaattcacatacaatgcatgtggagaaagcacctcctcccactgctgccaggtttatttctgtcagtattctgatttgcatcttgggatgcattttcacataaaatgttttcaatggtaacacattaccatttgattataatgtagctaatgtctactcttaatcatgctataagtcaactaggcttcataggactgtcttggaaacttaacttctgctctgggtaattatttgtatatttatataattgtgtcagtcccagagcatttttcatggccacaaaatcacctatggctactattctattattagagggattaggccttaatgacttcatactcaccttctgacacttccactttgtctattatttctaccttattggtctgaatgaggttgattgacagtagcagacattctactcatttctaccttctgataaaacatcgattctgctttttctatacctggtcctctatagtactcatttttaattatccctgagcattttttctcttaccttttattttcattttaattttccctctattgattttttaaatctcaaaggaatttagtacttctacattcttttgaaaggcactcatgaaatgcaacttatgccacagtttataatataaaacccgattctacacagcacagtgaggcagactttcactgccatctcacattttctcagttcccagttttcaactggaaatcactcagtcatataattctggtggtaagagtcatggaaagattaaactgaaggaaaagtattagctgccatcatcatcatcatcatcatcatcatcatcatcatcatcttcatttgaagaaagtgttttccacaatacaaacatatttatagccccctggggtgaatattccactctttttttctgaccaccttctgcttattgaagtttaaaattatttatttatttatttatttatttatttatttatttatttatttatagagacagaatctggctatgttggccaggctggtcttgaactctggcctcaagccatcttcctgcctctgcctcccaaagtgctggtattacaagaatgagcgagccactatgcccagcctaatattccactctttaagaaagtgacccaattatgttcttgatcttttccaattcacctcagtgcttcagtgtttctactcttcaggagacatagtgaaggaagagaaagcttactgagctccttcttcaaagataaaaattt

SEQ ID NO: 6866 - DNA, 1110 bp, artificial
  synthetic oligonucleotide
aaattattaagaggaggaagagaaaaaaaagagttggttttgacacattaaaaagtagccaaacaaaactcaaaaagatagcagcaaatgataaaattgaaactatattctacattatatgaaaacatattcataataatagtgtaatctgaagaaatgttttgttagattcacttgtacttatagtttctattattactgtgaaatatatcatctttttaactacattttctaattgtttctagtaaatgggaacatgattgatatttttgtatatttattttatatgctggagccttcttaaattctgtttattctaataatgtatagattttcttggattatctgttaattaattatattttgaataatgacagtttctttacaatatttctttaccttatattactgtgctagctaggatcttcagtacaaagaggaacaacagcattggtagaggatttccttattttgttcctaaattctacaaaagtttcaccttttttagtagattgtctttctcaagttaaggaactttcttaatgttcctagtttgctgagaggttttattacaaatattatgaagttttttcccgtctatatgtactgccactttcatatcctttcttcaccattaatatcacagtgtgaccatgtgataaattacaataatcaattttctaatgtatttcttgcttttgctttcatcgagcctcgtcattggatatttggttcctattttaatcattttgacttttatttttatattgaactttcttctactttccttttattgttctttttctaatttattgagttgaatctttagcatcttaattttcaatgttcttctgtaaaataagaatttagaactataaattttcttctaccactttagaaatatttcacagacttttatatatagtatttttatcattcaatatttattatttttaaatttctcttatgatttttttgacccatggtttgttttttttcaatttctaatcatatgggattccttttttaaaaaatatattatgaaatcattacattattcccattctagtttaactttatcttatttttcttttttaattttttttacat

SEQ ID NO: 6867 - DNA, 2907 bp, artificial
  synthetic oligonucleotide
gtaaaagagagaacaaattttcgttccattgcaatttctctgaggaaattaaaagcctgccttcaaaacaagaggctgaaacagaaatcattctaaaagttaatgtcctaatgaccagcagaagagggcaacttcagttaggtagagaaaaacttgtgagtggctatggaaactgagaaaaactttcaacttagtagggaagaaaaacatatcatggaagaagtgagcatattgttgctaaaatagttttacctgccactgaaatttatgctctaaagggaaaagaagactttatcatcttttttgaggaaagctgctatttatatatttagttcttttgaggatagcaatggcccatgactgtttcactggggagagtttgaaatagtctttaaactcaaataaatggaccaaattaaatttgtcagtatagatttagtaaaataagattgctagccaataattgcagaaagaaaaagtatcatatttgttcacaaagtccaatattttgttcatttaaaacagctttgagtggagctgttacctgtttatgtaatttttcttgttgaaatgaacaaaataaaattccctaaaaactgaaataaaatcagagaattgtacacctccttaccagagactataaagcatctagcaaatatggtgaaactgggaccaggtcaaaggaggatgttgagcatatcttctgtaatctcaaactgagtctagaactccaaaggacctacccaatattttacctggaaagataagaaataaatatttgaattaacgtgtcactattgaaattcatgcataagtacacaataaatgtgtatgacaatgttcttggtggcattgttcataataaccacattttggaaactgtcccaatatatatcaacaaggatttgctaaataaattatgctttattcacacaatggaatactatacaaagaagtaactctgcatataagaacctacaaacatgttcacgttctattaagtggaaaaatttatagaggaggatatatactatggttctatttctacaacttcgtatatgtgcacatagatggatttaatgtacaggtgtatatatgcgttttctgcctctctggtcctctctgtgtctctacacacatgtgtacatgcatgcataaaaatacacagaaaggaacttctatggtttgaatattccctccaaaacttatgttgaaacttaatctccaatgtggcagtattcagaggtatggcctttaacaggtgattggaacatgagggttctgcccttgtgaatggattaatccactgacagattatcatggaagtagaactggtggttttataagaagagaaagagagacctaagctaccatgttagcatacttagtccccttgccatgtgatgccctgtgctacctcaggactgcagagagtttctaccatcaagaaggccctcaccagatgtggcccctcaatcttgaacttcccagcctccagaactgtaagaaatacattttatttttttaaataaattttcaggtattttgttataagcaacagaaaataggctaagacaggtgccatgagtgagagtgaacctccagagtttatgatcatttgatacctaggagctgtgttggacttgacatagccaaaccttgatcagactgttgatggcctacatgtgatgtaggaaatatatgggacattgtgtgattgtctttaatcaaaccataaagctagaccacactgctttaggcctagacagaatttcctccaaagggaatatgttgccactgtcagattcaatgtatgaacaggaaatgaagacctaggaggcaggccttaccttgactatgaatgaagaaaaagtactcctttcagtatctggagctggtgaaaaatttggccttgaactccaccttgtggacagatgtggagatgctataaacacttccagtggttggaaggtgagctgtctgaagccaagtgaaggcagaaaaggaagacagacaggagagtcaacttggtaggagactctgggatgcgtctgtgcctgaatagttgtaattatattcagtgtagcattttccttcttacattccaaaactttcagtaaaatcttgtaaacgcttaccttatgcccactcttaggattaaatagaaaagaggccatcctgttggtttcacagcagtcacccatgaagaacagctgttcctaggagagatgattgcccagggtttagcaccaccagaagcaggaacatgctaccgtcacaagactggagcagaagatcctgagaggcttgctcatgagcacatgtggggataataatattaaggataaataatctgaaagctctgtaaatggtgaaacccttttaattaacagtatttacctgaggacaggactcagtgaggtaaatatgatcttatgtggagtcttgcaataagtttgtctcccagcctccagccactccagccctaatatacatataccctttatacttctggaccttttaaagcatgcatctgatcctactgtcactgctcaaaatcatcagtactttcccttctgcctgcagaacagattccaaattccttaaaccttcattgaaaggccattgtagattacagtgttagattaaactcaacatatatttccaacctcagcaatctctatacatcttttcactatctttaggtatatgagagtcctagctgttctacaaaacctgatagtgtaatctggcaaacatagtaattttggcttttatccagcttggccctgctgtttttttttcaagaggtctgagtctgcattggttaccaagagtttcttagtcaagccctacctatatggcagtcagtaggaatttctgccagagtatggtgaaccaatcatt

SEQ ID NO: 6868 - DNA, 1186 bp, artificial
  synthetic oligonucleotide
aatatcgcggagcggccctgcacaaagtttgctcagactgcactcccaccagcagatctagagggtctagtgtctcctttctccaatacaacacctccctcttggcgctactcacccatgggaggctgtcccaggtcccagggtccccccgctcaccatgctctgtatttgtttgtagtttcctgggtgcgctgccaccatggtctggttctgcaacagtgccgactgccaattttcagtcttcgcccttaccaccataggatggatcctctcctctacgtccacgggcctcgtggagtggcgaatatggtacatgaaagacacctcgctctacccccctggaatcgcctgcgtgggaatatttagagtctgcatttaccggcgtcgcaccaacagcaccacaaccaaattttgttaccgatacagctaccaggacacctttctcccttttgaaatttccatggctcaacgcttcctactgactgccagcattttcggattcttcgggagagcctttaacatgtttgcacttagaaacatgtccatgagaatgtttgaggaggacacctacaattcattcgttgtttcaggaattctcaacattgctgctggtgtctttaacttaattgctgtgctccagaactacgatgccgtcataaactcacaggggatcaccttcctgccatctctccaaatgcccttcaagccagatgtgcaggaagttggcactgccattcaagtggcagggataggtgtcttgccgatgctgttaactgggatgttttctctgttttacaaatgtcccccgtacggccaagtgcatcctggtatttcagaaatgtgaatttcctggttgcattggctttgcaaatctaagatttctgggagtttatggaaaatgttattagcatgctctaccaaatatttccaacgactcaagaccgtggcatgggtagtttgggacagaaggtggccaactgcctccttctgttatcttgtgtatctgaatgtggctcactgatttgttggttgaattgagaacttttatttaaaagtcttcccacctgccagttggtcttattgcatctgaattttaattattgttggctacagcaaataatcaaccctgtaaactaagagtagggaaataagagtttctgagtacattaacttctcacatttccct

SEQ ID NO: 6869 - DNA, 681 bp, artificial
  synthetic oligonucleotide
ggcctttgcaacactcaaatcccaggaccttgtaactgaacctttccaatcaaaggagatcaagaaactcaaggcggggggagtggggagggacagcattaggagatatacctaatgctaaatgacgagttaatgggtgcagcacaccagcatggcacatgtatacatatgtaactaacctgcacattgtgcacatgtaccctaaacttaaagtataataataataataataaaaagatgattattacaaaaagacaaaagataacaagtgttggtgaggatgtagagaaaagggaaccctcgtacactattggtgaaaatgtaaactggtacagccattttgaaaaataatgaggcagttcctccaaaaattaaaaatataactaccatatgatccagcaatttctcttctggacatatatcccaaagaaataaaaaaagtatttcaaagagaaaaaaaaaaaagaaaactcaaggcctccatggcctacctggggagtcacataactcaccctggctcagccctgggtcccaagcttacagcagttggcaaggaagagtgttcagtgcaataacaggcaataccactcatatgccctccactctgaggaaataacctctatttagagactaaacaaaggtgcctcttgcaagtctaaaaaagaaaagaagctacaaagg

SEQ ID NO: 6870 - DNA, 500 bp, artificial
  synthetic oligonucleotide
ttaaagatagtttaaaaaatcaaggtaataaaaaacggccaactctttcaggaaaaaaaaaatccggtattttgtactacttgagtttctctaatgcctaaaatatgcatttaaatcatcccacacctacacagaaacaaaatcagcagggaaaaccatcccactgatgattggcaattccaccgttcctctccatctgaccagctttcaccagagggcgatctttcatgcttgcacatcgagtttatacaatgtagaagcccccaagtcacctgggaaatggctcatgccaaatacatggagtccttagttgactatcttttcatattaaaatcccatcttccaatgaagcatcctgttttcaatactgatatcaaatttcgaatgtaaaggagatttcaaatgtattgctttcaccttttcttttttattcatttatttttaattgacataaaaattgtatatatttatgggatacaatgtgatgttttgatatatgt

SEQ ID NO: 6871 - DNA, 7631 bp, artificial
  synthetic oligonucleotide
cgttttctcttttcgatttcaagtttaaactatctttagaaatctctttgggtaccatttcaaggagtacagtgttgctgtgtgtaaaacagcttcttggtcaaaacatggctgagacccagtagatacttgatggagacatccctactcaagggagctctgatgtttgccagaggagcttccctgctttgaaaggacaattcttgttatacttttaccttctctgcatgcgattccattctccaagaaatcttacgtagatcttttaggatagcagaaacacccaccacttggcaatatgtcagaactattgagattgggatggtataaaataataagcacactacactaagtgccaccttcaattgcagcctcccaaatatcctttgtattatatcacttgctatgcatagtgatttcatggttgacatagaactgtttagatttaagatatatgcatgaaaatattttgttgtttctcaggcagaaaatggtgatgtgattaaaagctaatgcttgaaacatttgctagacaagagcaggccttttttttttataaccttatcaaaccaaataatcttttctttggaatccctactccccattatgatcaatctctctggcatatctgagcaggactgagccaagaaactgattccaaatgtagcaaaggatagaaatccctgtaaagtaggactaagtcagtatttcatcaaagaatttaatccctgtgaaggaatgcccttgtcccttccaatttaaaaattattagaaaggcatttgttaggagctgtctacttaacatgtagtggcagatatttgatcctaagaaaatagagatacagccagagatttatgtacaggatgttcatctcagtgttacttatagtagtaaaatttctaaaaactaaatgaccaacaacttggcataagttaaattaaggttcagccgtatgatggaattctatgcagccataaaatcttttatagcaataataattgaaatgagaaactgttcatgggaaatatttcatgggaaaaaatggttatcaaacagaatttttactatgatcctcaattttagaaaataaagtaaacattgtatatacattgtcagtgtcctcttgccaaagaccaccaggaccacaccaagtagttggccaaactgggtttccttcgtgttgcagtgaggaacacacaccatggagaactaagaggtgtctcaagaagggggtgttagaaagcacttataggatttgggcttgtgttaagtaatttgggggaaggttgtgggttgtgtatatggggggcttacaccagattgggtgccattaggaagcaggggtagttttatgtctgagtgtcttaatcttttttctagagggagaaaagactagaatgaggctaaaggctaaagctgtaattttttttttttttttttttttgagacagaattttgctgttgttgcccaggctggagtgcggtggcgcaatctcggctcactgcaacatctgccttctggtttcaagcgattctcctgcctcagcctcgcgagtagctgggattataggcactggccaccatgcctggctaatttttgtatttttagtagaaacggggtttcaccatgttggccaggttgttctcgaactcctgacctcatgacccgcctgcctcagcctcccaaagtgctgggattacaggcatgagccaccgcgcccagccgtaattcgtttttaaaagaccacaactgtcctcatattagccaggataacatgcttcgtcattttttgtggtttggacagggttcatgttttgtctgttttcacatatgattatggagtggtcctaattttatcttaaaccatcacagttacagaatgctcttatctgacattagtgtttcagaaaatggtttatgttcggtgggagaacaccaaacttagttgtgagtgccaggctagcttctgaataccagggaatgcttttcttttcacacttatgtatagaataagattataacaaatatcatttattatatgtctgtgatatttcaggcactgttttaagtgtgttaatctatttaatcctcatagcaattctatggggttggtactattgttattcccatttttcagaagagaaaaattgtgccataaaaaagtaaagttacccactgcattttagctaataaatagtggagcaaggattcaactcagtggctacagaaccaaaagcctcaacttctacattatattgcctatgtgtacaataaatgatcgacaaaggttgaaaggtagtgtgagtacaccgatacaggtgtttttgtttccttctttttcttgttcttactttccaaattgtctaaaattaatatgtattaattttaaatcagaaaaggtaacaatttattaacgtactggtgaaagctctgatcacaaagtcattggcccaaatgcaaacccaagtcgttggtggaggcaatgctccccagaacttctacaaaaagagaagaaaaatcggggggaggcaacacccttcctgcactcttacgtgtgggctctctttctctctcgcccctctctctcgcccctctctctctcccctctctttcgcctctctcttccccctctctctcctctctctttcctctctcctcactctcactctctctgctgctccaattcaatttagacaacactaacgggattgcctgcagtaaaaggtggcccaaggtccacacttagttggttctgtctccaaattgaaacatacaggttagaagctcctccaaatatacataaggacagttaggaatagagttgggaggactagaaacaaatgccttggtcccaaaggaaaggccttttctgtgtgggaggacaacactctcgccctggccagctgagcaatgcagtttctcccgctctaagattcagcccaggcactgagggagggcactctgttcttcagcccttgtgagggctgacattaaaaggccggaaattctagggacgagggcgaaccgaggttggaagggagccaatcggagggtcaaagacttcagaatgaaaacagcttcgccaaaatgttaaaggcacctaagcagacctgtcggctggttttccttctcttacttttatccctgcgctggcatcggggcacatgaaacagctctgttcattccctgtgcagcgaccgattttaggcctcctgagaagtgcccacccactagctgccgctggctcagtcgcaaagagctgggttcgcagtatttcccaccgccacccctcctccccgcccttccatctttccgtctgcccgggctgagagccacgcagggcatccaccctgtcatttagcacctcggctacgcaatggtgggtggtttcccaaagcgcgtgccctcgcagccactcgcgctcgcctcgccgcttgcaggggcacaagtcaatgaggcttttccctccgcgatcatggtgaatcagcaaagcgctgcagagcagcggcacctccacgagcagaaattaagatgctgggggaacggcacgagtggagtgtggcaggggaatttctagccccttccaatgtgtccctcccagggacggcgatactgggggaggggagtcagctggaagctgctggacttaggcgtcgcggggagcctctggaaacagagcagtgtagggaataacgaagatgagcacagaaagtggacgagaaatgggtggaaggatctagggagcacaagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtccctattcgtcttccttcagctttgattaatatgcatgtctatgctccgtagtgcgggccaccgcctcccgttcgacccctggcactgggagactgagctgtagcgaccaaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggtactagaggctggttagatttctagtctacttatcccaaggggagtctgccgggaaacctggggaactctttcctcttcttttcctctacaggtaatagtttatccctagagacaagctaattttcattattttcctatgtccgtttgttgaca

SEQ ID NO: 6872 - DNA, 303 bp, artificial
  synthetic oligonucleotide
tcataatatacctcgaatatttgaatatttgaatattttaaaactacctttataaaatcctctcttcctactatttttcttgccattctttttcccctagcagtacagccatcactaaacatattccacctatttgatgacagttaaaagtacatagaaacatcttacattttttgttatactgagtatatatcaaatgtttttaaaaataacatttcttgtggtgatgatagcctccacaaaacaagcaaattgtactgatccacagcaatcatacttttcattaaattgcaaacatttcat

SEQ ID NO: 6873 - DNA, 1973 bp, artificial
  synthetic oligonucleotide
gattataaaaaaaaagtccaaaaacatttgagaatttaggtattaataggcagtgttacagtgagatttctgaattagacacaaaactggtcaacgacctacatgaccataaactggaacttctggggtagggttgccagataaaatataggacactcagttaaatgtaaatttcagatgaacaatgttgttttcttttttaagtacaagtatgtcccaaatactgcaggcactttttagttgctaagtctggcaactctacaatgggattatctgttctatggaacagaaatgatttgcatttcttctggacaaaaatttacaaattaaactctgcccctccagaaatgttaaatatgttaaatagcccagacaatagaaagtcaagcacagaactgcactgaaagaactgctagtaatctttcttacctatttccaaatttttgataacttttccagtgaataaagaatagctggctgggtgaggtggctaatgcctgtaaatccccgaacttttggaggccgaggcaggtggatcacaaggtcaggtgtttaagaccagcctggccaacatggtgaaaccccgtctctactaaaaatacaaaaaaataagccaggcatggtggtggacacctgtaatcccagctacttggaggctgaggcagagaatcgcttgaacccgggaggcggaggttgcagtgagccgagatcacggcactacactccatcctggatgtcagagtgagactctgtctcaaaaaaaaagcctagagtggaaaatattatttattacaaagtaacattggagattaagatataaacaacaaccataaatattatttccttaattctctttatattcaatttgagaaagcattagtcatttttcccagagtactatttgcattcaggaggtattctgatatttgagactgcatatcatagtcataaacgcagaatggaaaggttatttttagccttctggctttctcaattgcagaacaatattttcttccagaaaagaaaacataaaagacctcacaatcagataacaaggcaaaaattgttcacgagtattactttaacaaggtctgtagctctatcctcctgctgtgttcatctctgaagcaaagatagccattctacacttctaaactatgagtctagccctcaaggaattttcctagccagcaggaaactatataagaactatataaatttgattttaaaggaaaagctaatgagtaaatgatgttagttgcaaaatttcagcaaagaagaaatctactcaatagctagacagacaataatgtccacatgatatctatataaaatgatccctccaatgcaatcgggctattttgaggtattcattcattcttcaaagatttattgagctctacgtatgtgttagacttggtgataccaatacaaacaacaaacaaattggattcttacccttatgagcttatgtctagtctgtttgtatgaaaagagggagagaacaaacaagagaaaaactactatatagaagcttagtaaccaaactttaagaaactctacaaacgaatttttgaactcaaggtttaaatttgttctttgaaatactgacagtttaatgaaagaccaatcttagcttgacaaggaaattatgatttttgtttgttggtttaaacttttgcaatttaggaagcaatgtcaaaaacaacaactcagtcaaaatgccattttggagagacagagaatgaaaatctgaatttaaaaagagaagtacaattgtagtattagaaaggtaccaacatatctatttataattataaaagtaatggttagtactgaatggtcttgtaaaataggcagatcataaggtaagagtaagctctgttcagacaccattattcaagcaataatcaatttggcaacacgggaacttaccggaatcaactggggaaaattttcaaactacacagaaa

SEQ ID NO: 6874 - DNA, 611 bp, artificial
  synthetic oligonucleotide
tttcttatatttttcaaattgtccatcataaatagaaaagtatacttttaaagaaaaaaggtatagccagtaataagtagcaaatacttgaaaaaaacaccaataccttcaatcaagttctagaaaagttattgtattgaatctcattgatattaggattcactgtaaagaggaaataccaaataaaagttcagacacatgactaaaaggcaaatgaaagaaggaaatgttcccatgagccaatgagaatgtcaacctcttgcaacaattatgtcataggagaaaaaatgtcagaagaccattataataagaaactgcttataaagctgcggaaggtgaccttaatcgtccagtcatgttcagttcaaaccattatttggctttcagctgctatgtatagcatctgtgtgatatagtcatgtttaaaggggctgtggctgttcatttacatttgcaatctctcctttaggctgttattaagatttcacagagtttgcaaaacgtctgtcccctgagaccttgcaaaatgagtggcaagtaaaaagactttttgatgctcaatgtcagggaggacgattcacctagctgtgctacagtccagaaacaccaag

SEQ ID NO: 6875 - DNA, 1350 bp, artificial
  synthetic oligonucleotide
ctctcaaacctgggtgaatattagaattacctagatgcttgtcataaatataggtttctggaacctatccttctgaaatatatatttaatatgcaaaccagatcagtctgaagatcttccaggtttgagaaatgctatctaaaaggcatgcctgaatgacatttaatctgcctagattattagctccttctgctacaagtaggccatgttttatattgatttggttttccctgtagcatcagtacaatgttgagtagatagtgaaccatcagtaaatacttggtaacaactgttttaaggcccacctatttgcacttgacttgattagtggggattgttgtcttgcgggatttgcaatttggcatctcagtgcgatgttgaatcagttccttcgctattcaacagaattatttaaatcatttagtcaagggtaatgaaaggaagctaccttatattaagtatgttccattgacagatactttctgtaggttatctcatttaattctcacaacaatcctacgaggaggtacttatcctcattctgtaaataaggatacagtttagggaagggtaagtaacttgcttaaagttatatagcaagtaagtgatacagctgggattagagtccaagtttatccaatcccaacattcatgcttttttcaatttgcaaaaagactcctttcaaggcatcttccaagcaaaagtcatatacaaaacatgctcaattagtggtatgggaaagagggggatcaaagttaggttcttcgttagccagatttgattctgagctacagggagaaatacatactgaatttatgaaaaaaaccaacaactgggtttttaaaaaatgatcaggataactgtagttgagaggaggagtgagagttttcggtggctacaataaatagaattctatgttcaagagggatttagaaaggtcttaagagggagtactgcaagggttgacacaagaagaggtcaagatatatatggggatttcatttctattgcgggtcaaggtgagaatattttcaagtagtatcaaagggaacatgaaaagtagtctcagtgataagagaaatgtgagaattgccaggcatggtccattccaagactgctggcttaggagcctctagggataaaaggaattaggaccggttatgcttaaattccatcctgcaaattgtcctgaaacagagaaggctgtcaaagtcaggcaggtcatccgataagagaccaatgtacgtgccaaggggtgtgcttgagtcatatattatcacagccggagtcacatccttagttgctgttcatagtgacaaatctcagtgtaaagttagcaaagaaccaag

SEQ ID NO: 6876 - DNA, 1762 bp, artificial
  synthetic oligonucleotide
ggaagggaaaagacacaagtaccctaggtagacaattctggtaatagtccaggcagaataaaatattcccttggtcattacctcacacttcaggtgtatgtattttaaaatatgcttgtaaccattgactactactatttccttccctcctttttgtttggggagaagaagggtaggtactaaccaggaaaaattatctttagttctgtagatggtaaaagtaaagaagagaagtcctcaaaatagaaatagtgactccaggcgagaggaaagacaataaaaatttaagtttgattatgtttaaatgcttatgtttttagaacttgattttaagttcatttacagtgttaggatattttaaagtcagaaagctattagagcatttaaaaagcatactgaatattagtttttctctcacagtgtatctgtttcaaagaattggagaataatattctgttaagtgaatgttttctttgctacatttctattatggtgaacttttggtcagatttattgtttagcatcgtctgtatttaaaaccaagatgtcctgacagagaggaaaacagttataaacagagtcacatcacagtgactgtgtgtatgtattgttgaatctgccattcaaggatttgttgtagaggcatgaaatgcatccttagaaataaaatagttatttatttccttgggatttatggtattcatcagtacaggtgactcctatgattacctgtataatctcaggatttcccattgcctcaagttttgtttctaaaagacaggaatagttgaactggaccctattccaaaattagcatagtaaaacataatctttactgtgtaattttataatagcttacaattcttcaattaacatgtaaaacttctgacctttttaaaaatatcgtataaggtggaatattgtaaactcccaaattacattatcattccttttccctttctctctctctttctttaatttctacttcactacattagaatttaactgtcattttggtaggatgtatgatttcaagctattaaggtgagctgtataacagggaaggtcaaaaccgtgaactgagtcctaaattatgtagcctaccccagtgacttacattgtactttccattgtatttatgcttggctttttaagcgaattttgtttatctgtacaaaagtattgtcacaatacaaaatagttgtaatatgccactttttgagtgtctagcaatgcatattaaaacaatagaactgtgagtctatataaatatgctaagagagttttcatactggctaaaatggcaacatcttgtcatgtgaagatacagttcatttgtgatcattatttttgtgtttgtgattgcattaaaatttttatttttaatgtgttaattgtatacatagctaatcattaagatctgtaagataaacataaaacttgtgaattttagtttcacttcaggataatttcacaaaccactagattattttcaaatgctgtgaagcttggaattgggagtgctcttaagttaatgcatcctcatgtactgtttaattcagtatatatattatcttaactttaagaaaacaacctcctatttaatacttaaatacaggcctgaaaatgagatctatatatgcaactaaagattattttaaatgatagataaatgtgtgtgcctatgaatggtgaaatgattgtgttacataattaccatacttttgatgatgtaccataaaatggctttgagaagacagct

SEQ ID NO: 6877 - DNA, 2075 bp, artificial
  synthetic oligonucleotide
tatttatgtaacacatcctggaaaagtataatccattagggtttgggataaaaggttcttctctcttctaaatgtgaattttttttaaaaaaaacttggaataatagacattttaatgtgtttctttaaagcatagtttctaggatttcagttacctgatactgcatcactagtccgttttgaaagcaaagtaacaaaaattattctatgttcagaatttttaaaggatgaagagtgaagtaattttaacaggggatgcagttgagcccgatttcaagacatttatcaagtactttgatttaattacacaatatgtttttaggtgatattcaaatagaatggcttcattaaatttagcacgttatattttaagtttatagggttgtttggaacacattccaatagctgcttcattggagtagtattatcttgttatttttgttctatctttatagcatggtaaaaggtttattgtattgctgctattgtccatgcgtaagaatgttgccttggtgtgtcagtaccagctattggtagtaaaatatcagtctaatttagagacactggtaccacttatctctaaaagatggtgatgagaaagcatgtggtgtagtttgtaagctcaggacattgccaaatccttgttttcaggcatatagattttttaactgtacttgtgaacagagcttggatctagacctagcagctgagcagcattaatggtgacataatttcattacattctgaattactccattggtaggataccattttagtctttgatttgacatggtaaatgtccattatgttgtctggtaatgatatggactaatgcaataatatggttaatcaattcaaagataaaatttattgagtatgtatctcctgaaaattgataggatggtacaccaattatgtgacttttttttttactaatcttattaaagggggagaacattaaatctttgaatactgtacctcaattttattgtaatgattttgctggttaccaggtggggtggcagttgaaaaatttggtgaatgcactacgagaggacccgagtggtgttatcttaactttgaaaaagcgacctcagagcatgcttacctcagcaccagctttactgaaaaatatgagatggaagccccttgctctgcaggtaatgaagcttaatcataagtcatacaccatcattttagccatagattatctcagtaatgcttctttattgtgcctcatctcagcagcatatggattaatcttgtatgcttttgaaaagttgtttgtgaaatgatctcttcacagctattctaataggcttaattgtgatgaaatccttgagtatctaaaacccaaatgaaaaacaactctgccttaatttgtaaacatttaaagcataattccaaaatgtcacaatttatttcatgccaaaatatggatagaatgaaaataagatggttcgtttttatgatatgatcttctattttatgttatacccacatactcttttagaagaagctaaatgatagtttatagaattcttttaaatcagttcataaaatagtaatagtaatttataaacagtaggaaaatgaaatgttatattagtaattaaaatgcacctagtccaaactaggcgcagtggctcacacctgtaatcccagcactttaggaggctgaggtgggtggatcacttcaggccaggagttcaagaccaccctgggcaacatagcaaaaccccatctgtacaaaaaattaaaaacttagccgggcatggtggtatgcgcctgtagtcccagctatgtgggaggctgaggcaggaggatcatgtaagcccaggagtatgaggctgtagtgagctctgatcatgctactgcactccagcttgggcaacagagactccatctcttaaaaaaaaatgtaccttgtacattcctcctgattgatcatttttctctttccaccctgtaaggtggcaaaaatagggaaattgttgcactagaatttttgcatttttcttcagcatgaaacatcactcttcagcatgaaacgttactcttaacattgataatat

SEQ ID NO: 6878 - DNA, 3230 bp, artificial
  synthetic oligonucleotide
gggaatcacctccggagcccactcagcagcggggagggcgagggcgaaagcgagagccaggaaagcccgggctctcgctgtaagccccgcgctcagtggtgtccccctcccctcggtggtggggccgcggatacctcctcagccgcctcagctgtcggagttcaactggtgggcggcccgtcccgccgtggccgccaccgccgggtcccctcagaggcctcacaaagccatgctccagccgcccgcacctgattgaccgaccccgggctctggctctgcctcgcgccgccaccgcctccgccgccgcgcacgcgcacttcgcgcgcctctgttcccggacggcccccagagcgggaacgccaggctgcgagctgctggcacctgtctgcctgccagacagaccctgggctccggcctcgtgccggcacgcgcacgcgcacgcgcctcgcgcgcctgccgtcggccctgggggcgggaccgcgcggcagcgagcgggcggggggctcgtggcgcgcgcgccccgcacccgagggctgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattctgacacacattattagttgtccagtacaccagtcctttaaaaatctttccagcctaaaatgtggcttctttgaagttaggttaacattgttagctgtgatttgaaaattttttttaaatgtaagtcgaataccttgttttcatacctgt

SEQ ID NO: 6879 - DNA, 534 bp, artificial
  synthetic oligonucleotide
agaaaactgttagtctctaaagcttttataaaacatagaagtatttagacttttaacaacttatttcacagctttatacagatcaatatctgtacaagctagggttagacatgtaccctaaaacttaaagtataataataaaaaataataaaataaataaaaataaaaaataaaaaataatttaaaaaaagaaaaaatagagaccctccaggaagtttctcattttttcatgtaactttttcaaccagaataaatctatttatacaattccctaattttctttttaatttttctccatacttcaatcaatgctgcattacctaataggcaaattaaatatatgctaaggcaccaatacaccagcatcatccaaaaactgtttatgaaagaatgtgatatttaatatctgctccccccaacacattaaagtagaattggcagacagtgttacaatttaatggaatttcctcctttaacattagcattgtttctttttgcttatttttgggaatagggtaccatacttttccttgt

SEQ ID NO: 6880 - DNA, 2120 bp, artificial
  synthetic oligonucleotide
cagagcctttctgccagttttagtaattataactagacagaaatttgacttcatgatgagaatatattgcataaatatacatttaactcaaattttatgctagttggtttatagttattccctaaccttgattcttctctgtctaaataaaagctaatggctaacctagtgcattgtctgtacaaactacttgtgttaacggcttctttaacgtttcccattaagagctgctaaggacttagagccatgaataattttaatacaggctgaacaaagttaatgtgcatatatataaattctgatatatatatatatattattaaacatataatatatatttatatatattcattttaattgccacagaataaaccattctttccccttcctcattgttgtcatctaccaaatcccctcccttccctgcaatccattgaagatattaatgtaagcgttactgacttcctctgtacccaaacacctgccattatcctggacagtatgtaagccacaaagatgcagtgttatgcaatgagctgtgtccactcaaagttaacatgtttgaagtcctaacccccagtacctgaaaatgtgactgtatttggagatagggtctttaacgcagtaattaaggttaaatgaggcaattagggtgggccttaatccaatataactggtaaccttataagaagaggatattaggacacagacacatacagagggaattccatatgaagacacaggaagaagacagtcatgtaaaagctaaggggagaaccctcagaagtaaccagccctgctgacactttgaattcagacttctagtctgaattgagaaaataaatttctgttgtttaagctacccagtctgtgatattttgttttgacagccttagcaaactaatacatgcagtatctagtatgtgccagacatgttttaagtgatttacttctattaactcatttaatgtttacgagacctatatgaagtgggcagatgaggaaaatgaggcacagagaaatgaaatagcttcctaaactaacgtagctagtgaatggcagagtttagaagccaggttgtctgatttcagtaaagaagctattgatcatggtgcttgaagcctgcatgcactggatatgctgttagtttttatttagctggaaaggcataaatgttagaggctatttacataagttatccgctgcactttgctctgttgggtgacttcagtatctatgtggagttttagcccctcagttgcataacctcaggttcacctgtgactacagtcctattactcttcttccatttagggccaaggggcgttaacagttattcttactagaatgtgtccatttacttcagtgttactctttaacccattgcaacatggttgctttgcccaccatgcccctgaaacagccattactaaggttacttgcaacttcctttctgctgaatacaataaaacactttatattttattttgcatttttgaacaggtagtacatacacatataaaacaatactttaaacatataagagtagaagtgaaaagaaagtttctccctcccgttagtgttttccagcttagttcccatctcaagaagcaatggctatcaccagttttttgtgtctctttctagacctattttatgcaaagatgaatataagtggtttttaatttttacaaaatcataagttgagcatactaaaacactattccattctttattgctttcacataatgacagaggtctttccatatcagtacatatagagctcactcattcctttgaacaactgcatagaattgtattaattttattaaatagaagtattatgatttatttaactcatcttctataacacttagattgttttaatatttacaatcaatattgtaatatatttcctcaaacacatgtgtcaagaataggttgggtaatacttagaggtggaattgctaggtcaaagcaatttttgttaatgttgctacattagactccatagcaattttaccaatttacactcccacaagaaatatttcagagaatgtttcccagtgccctctccaacatagtgtattgatagtgtcttcttcaagttttaacttgca

SEQ ID NO: 6881 - DNA, 1984 bp, artificial
  synthetic oligonucleotide
cattgtttcatggcatgtaagcaatgctgctcttgaaaatcttggatgttcatcaagacactaataaatattgatgttaaaatgtggtttaatattattctttattgattcatttatattctcctaaccttcaaaaatggtttgagggaggctgcataatgttacaaaacaatgatcacaaaataaaaataattttcaaaatcagaaaagaagaaaaactccagcaagaactccttgctgtaagaagctatagatttcgcataccaaatttagctctgtgcctcctggtggctagggaaaaaagagagagagagaaaaactcaaaaggctttataacttgcatttttgctgttgttgttgttgttagagccacttcagtttctccagagaaactaacaatatctttctgggcagaactgagagaaatttatcactggattccttatgctaaggggatttttggtaacagtagaaaaatttgtttaaacattttattaaaaatgataggatttcttcttttttagccctccatgaaaaccaatatttagtgttaaaataggctggaaaccatcattctcaggaaactatcgcaaggacaaaaaaccaaacaccgcatgttctcactcataggtgggaattaaacaatgagaacgagaacacatggacacaggaaggggaacatcacacactggggcctgttgtggggtggggggaggggggagggatagcattaggagatatacctaatgtaaatgacgagttaatgggtacagcacaccaacatggcacatgtatacatatgtaacaaacctgcacgttgtgcacatgtaccctaaaacttaaagtataataataataaaaaaaattgttctatatagatagctctagatttggaggaaggtaggccaagcatgtatgtttccaatgatttagcataacccaaggatggaactcaaagaattttgagaaaggcctgttgacatctttcagtccattagtttctaatcccagctaaatcagctgagttttttaaaaaagttacaaatgttacaaatatccattgttggaaaaagtgatataaatatttacataggtgatcaatttccttctattggcatgaaagtgaatgatgttagatatggtttggattgctattgtgctttctgtagggtttgaattaacattaacaacaaccatcagcacgaacaactaggcagatggcactgtgacagatgctgaagatggggaagtgaacaggacatttggagcctacagtcctgtagttaaatacaagaacatatatggatattaaaaagaatgtatagggtactagtttcctattgacactgtaacaaattgctacaaacttggtgacttcaaacaacacaaatttatcatcttacagttctggaggtcagaagaccaaaatagttctcagtaggctaaagtcaaggagatagcagggctgcattccttctggaggctctagggataaatctatctccttgccttttccagcttccagaggcttcccacatgttttttacttgtggccccttacagtattgtattgctctgacttctgcttctgtcatcatgtctccttctctgatggactctatttcctccctctcatagaagaatccttacatgagaggattcttatatgggcttacctggataatccaagataatccttaattggtcacacatctcaaagtcacttttaccattaaggtaacacattcacagtttccagggattaagacatgaacttttatcttgggggtgggtattattctgcctactatgtattataagcatacaaaagtgggcatggcctttataaatgtaggtcaggttatttaaactctaattttcaaaattttcatctctaaaatgggacaacaatggccccttaaaaagatagttaagaagcttaaataaagtgtgaacacttttgtcactatagtgggcacacagt

SEQ ID NO: 6882 - DNA, 1579 bp, artificial
  synthetic oligonucleotide
ttgtttttagtcaaaacactttaaaattatctcaatttgctttggaattcattttgtctgtcttcccaaattgagggaactgcacaccgcttttgactattttagtaagagtttaacgtgaatagcccaaatccttacaccgctgccccttcggagttgctttaacttctataaatacacccagcaacaaggtattttgagagctccctaagtaacaatgctttgaatttctcttgtgcaaatctccacgagaactaaagcaactctcagtgggtcctccataaccgccaacttatgactataaagttgaacattaatgagtcctctgtagctctttcccccccaataaaatattctttttggtatgataattttgtttacttctcccgagagccagtcgttaccaaaatttaccatcagagggcgcacattcacagaaaatgcagcagttccctgctctggcggattgcttcccctcctatttgcaggatggaagaaacaggttttagtcggaggtattttcagttcaaattcaagttctagaactttgatttattattagcctgttctcttacttgggtggaagggaagagagaaaaacaggtctgtctgcaaccattgtgttctacccccattcagggacagcctcagaaactgcaaggtttcaaagataatcaaaacaagtctgatcgctaatggatctgagggcataggctccagcctctctaaaatgacaaatcgcttcacgttacccaagaaaccacaaaagattcacacccaccccctcctcccccgagccctgtccttctgcaagtgatttgcaatcccagacaagtattatataacgatgaaacagaagcctggagctttggtttgttatttctttcggagaaaagacattaaaaaactgttattatatcactatcctaaatgcctgtgagaaaaacatttcagagaattgttagaaacgcggggcagtggaactgaaatttgcattagtgctaaagattgtgagcatctgtaattgcccaagggggcagtttgaatgaaaagacacacaccggtggggtgaatggaaaaagctacagacctgaagtgggggaagctgggggcctaatcctggctgactgctaactagctggctgagcatccttgagttagttacttaacgtctttgggcctgagttctgcaagctggcaattagatgatgtcagaatgccttccattctactaagttatcttctcaaggacaaatgtagataatgttattaatttgacttctgtggagaatacagcagcacccaataataaattaaccattttgcaggttattttaatactgcatttcaaacagctctgaagtactttataagtcatatttatgaaaatagcccattacttagcaataatttctctagtgttttgatgggaagagctgcagagcagttctctctgggcaatgctagacagacactgtggtatatggtaaaacagacgaacaaacaaacaaacaacagacaggtttggaccctggatccattttaatttgctatgtgacctcagacaagttacttaacc

SEQ ID NO: 6883 - DNA, 1598 bp, artificial
  synthetic oligonucleotide
tcattagctgatgaaagtgctgctgtagtcatactatccttctgttcataaacttgcaaaactcatgcctgacattcaaagtcctcttaggcgtggccccacagacctttctagccttctctcctgtggccagtatatgaaaatatagcatggtgctcctagaatttggtgatatttctgaagcaactcagaaaagcagaagtgttgctgaaatctgatcaaaaggctggtgtcaaataagggtatctggcttttggagggtgacatccacgtctgcagatgctgccccaggaaagggaactttactattccctcttcttctacttcctgttgcaaccaataatggctcttcctaccattaaaaaaaagggtatctgccacggatacatgagtttagtacacttcagtgagaccacccagaggagaccatcccacacactctctttctctggaagaataaactgaactctggatgacttaagtgggaaaagatttcacaaaaagattttgggtggctcatagtgttgccaggatggctggaacctagctcagatattagctgatatggccaaaactttgctaaaaatcacatctcaatgtgacactcctgctttcagtgaacactggaggccacagcttgtgtcaccagaccagtggaggtggacaatggatgctatcccctctgccctggaatcctgatgtggctcccattgctgtcagtgctgttgccaccatcaccaagatggattctccattgtccctgcttttatattttgttcagctcccaactttagtctgggaagagtgtgtgcaattgttggagtaatatcagactggcaaggaacgtgaaatagtaagtgtagtaagacattatccaccttgaggcatctttctcccgtgaccaaacttcttgctttcaaaaaaataaattgcacaacttggtctgcatactaccagatgatctctaaggtcctttttgcctctgagagtctgtgatttgctcattttctattgctaactacattttcagtgtgggatttattctgcaggggcaaggctattacaaaaaatatggatatgtttcttggctcgtttacttctcaattttatgctaccaatttttgtttcaaactagaatggaagggcagaatccacatttcttgagagcagcagactgcattaacttaatgtctttgtattttgagacagccaaagggctgtgtcaaagctatttagttgtttttactcccataattatgctggtcttagaatggtgggtgtgatttctcaggcattctattacagttgggaatacgaagctgcctttcaaaattgctaaaagcacctcagtgcatctgcagtacgataatactaatcctagccctggcataaatgctagttttatggctgcacacgcagtaaaaagtatattttagactgaagaaaatgccagtgttcagatagttttgactttattttgtctgttggtctgtaataatcatgtttaattttgacacatttagttagacatatgaaacctaaatgctttgttacggtaaaagaacttggagctgaactaaaatttcagtaatttgttg

SEQ ID NO: 6884 - DNA, 1430 bp, artificial
  synthetic oligonucleotide
agatgggactggcaaaaataagaaaagaaggtaggtccagggctggaatttccacaaggatattatcagcctggaaaataggataaatcatgtgaactctagaatcctggagagatgagggccagataagcagatggctctcttcctccctccagtgaggaaaggctaaattctggagccccttatctgaaagtgatagagaacaaagataagagaaccattttcaaactccacctggtagattggtttccattagttccagattgggcaacatttgtttccttttgttccctttttcctgttcaccctaaatatggatcatgtctaaagttctatttttatattttatttttaattgtggtaacaaatacataacataaaatttgccatcttaccgattttgaaatgtatagttcattagtgctcagtacattcatattattgtgcaaccaatctccagaacattttcatcttacaaaactgaaactctgcacccactaaacagcaactcccattttttcctctatcctcagcccctggcaaccaccatactactttccgtctctgtgagtttgactattcgagatatataagtgaaatcatacagtatttgtctttttgcgactggcttatttcacttagcataatgtccgcaaacttcattcatgttgtagcatgagacaggatttccttctttttgttttttgtgacgaagtcttgctctgttgcctggactggagactggagtgcagcggtgcagtcatagctcactgcagcctcaaactcctgggctcaagccatcctcccacctcaacctcttgagtagctgggactacaggcgcatgccaccactcttagctaattttttatgtttagtagagatggggggggtttcattatgttgcctgggctggtctcgaactcctgggctcaagcaatccttctgcctcaacctcccaaagtgctgggcttacaggcatgagccaccgtgcccgcaccctctttaaggctgaaaaatattaaattgcatgttgtgacataataagaaatatgcattaggtctctttccccagttcctgacacagagcatctaaagccatcataatttcctgaatgataggagtgccttttgttctaatgaggtgactcttgctgggcttctggatgagggctactcactagaaagactgagcatgattagaaacttggaactttcaagccccctactccacatcctcctgggaaaagagagagacttgagattgagttaataattgatcatgcccaggtgatgaagcctccataaaaaatccctaaactatggggtttggagagcttccaggctggcgaacacatccatatgttaggaaagtggtgcatcccagctccatgaggacagaagcacctttgcttaggacccttctggactt

SEQ ID NO: 6885 - DNA, 1231 bp, artificial
  synthetic oligonucleotide
agcacacactcatgacttacctttccaaatgatccctgccctaatacttttaaaagttcaaactgggaaggatctgccttttcatgtccttcctttacatgatgtgtgattgcaatttctttgatactgacttcttcctgttgagataaacgtaagaggagcaaacagggttagccagagctattttctcccgctaaaaatcaaacaatattaatttaatcttactagaaattaattagaaatcaatctaatttctaaacatattagaaatcccaaattaacatacaaaaaccaccttttaccaacccatcaagtgaatatgccacacacatatactttcaggttaaatgtcagagacagttattataccagcctactacataggccaatttaacctctacatgacatttagtactaagtatttccaagtcttcattctctctactggagataattagaatagttttattgggtgggggcagagggtgtaaagaagtctgaaaataacagattggaataatctgctgtgctctggtgtatggttatgctacgcagaactaatgctatttaaaaaaagtgtttattgaggagaggggttgaaaaatattccagggtaaacatggagatttctaacctcaatgtggctgtttaagtacactgaagttttattcctttgaaatgtctaagttactttctgtttctagaataatctgggatctgagaggggagaaaggagtaactctaaaacacaaaaggagaaaagatttaacatttggatggataatcagacatggaaaaaaatgactattcagcatgatggaacagtgagaagtatctgggttaagagaaggattttaaaagacagtgaacattttaatatatttgaggaaaagtgtcagaacaaagagaaaatgtatgaaatacacacaggatttcaattacttatgtgagatcagcagattaggttatcttatttaatcaagacacatacggtatgttatagtcaaaaattacaacaaaacaaaacctgacaaaattagaaacataagcctgtcaaataaagactagcatttctattttgttgactataatgttatttttttctaggtgcgtaagtactgttagtagaatctcaatgtgttatgtaaacataactaatccattgtttttgttattatcatatcccatacaaacatttgcattcaattaacattttctgagatgtccttag

SEQ ID NO: 6886 - DNA, 3157 bp, artificial
  synthetic oligonucleotide
gccgtttgtttttgcagaatgtctctcaatttggactttttgggcaggaatacaatacaagtgatacaaatgcttctttaacattagaacctgtataaaattaccattacagaccttgctattttacttataggtaaatcactgtttaccaaggtaagtcttttgggaatttccaaaaatgaagtccatggacagttaaaaactgtagagggattttcccccttaaccaattttatattaaagtaaaacaaatcacacctaccttttttctcaattttcctctgatgtgacataacctctttacaccatcgaaacacattgcttctagccgtccatttcccaacattttgattacctgagcatactctagcggggagaaaggaaaagggtatggaatattgttcaacttttgataacagcaacttaaagtccacataaaactgtcaagagaataaagttgcaccagttgggaataaatacatatagtaaaactataaacaaacataagggagtgataaacatcaagttagttaacggcagagctagaactaagactctatgatgacatttctttctttctttcttttttctgagctcaggtcaagtgtagaaaacttcatagttacaaaggtcagtcgtaaaacctttacatcattgcccagaaatgattaggctttcatagacatacatatgcaccccctcacccccaatctcattcattcctacaactgctacctttataaacacgtgtgcgtgcacacacacacacaccccccacacacacaccagacatatgcccttattgttttacattgttttatagttctgcttctcagaactgtagagatcatgcatcaggtagaccggaaagccttctgatgctcagatttggctagtttcatcattgatccacttcagtaaaagcagatctcagagaatgtaatgccatttctataatatactgtctctgctattagacatgtttaaattatcgactcattctgaataagtagattgactaccccacttttggctctcctttacctcagtacctttaggtgcaaatctcataatttttagttcatttagcaaacaaaaacaaacttcaaacaatgtctttgttgaattagaatatgactaatccccagagaggatgtccattaatttgtaaatatactgagacttcattttgaaaggctcaacagtggggatgacttgtggaagtcaattactcagactacagtgagtttagcacccatctaccacctcaacatggttggtcaactcaaaggcagcctttcttctgaagtgagggaaaaagtaataataaaacagtgtatgcccaagtcaagtcagctgctattttagaggcaaggatgaccaaggctaagaaaccaaaggacttttagccagaaaacgtatctcatgtttactggtttatatgtatggcgtaataaatccacccaaagttctattaaaagctaaagtactggaaataattggaatacctgaggaaatatggagtatatactagatattatatcaatgtcaaattacctgagtgtgataattctcttctagttatataagaaaatatacttgcacttagaagatacatgatcaagtaagggaaaagtaacatgatgtctctaaatttcaaatggtcctgaagaaatcctacatatggggctaggtgcggtggctcacgcctgtaatcccagcactttcggaggccgagacgggtggatcacgaggttaggagatcgagacccatcctggctaacacagtgaaaccccgtctctactaaaaatacaaaaaaaatacccaggcatggtggcgggtgcctgtagtcccagctacttgggaggctgaggcaggagaatggcgtgaacccgggaggtggagcttgtagtgagccgagatcgcgccactgcactccagcctgggcgacagagcgagactccatctcaaaaaaaaaattaaaaaatcccacatatatatttctttatatgtgtgtgtacagatgaaggatttaagggagtttgttgcactaatactgcaactttctgtaggtttgaaatgactcgaaataaaagtaacaggaaagggcaaacgatccagttaggatttatttgactagtgctatgtatcttggtctggcacttacaatattcttcagtctaataaaatcagttaactgttcagtttcattttattgtagtttacgaagttatatgctaatggcactggagaatggagaggtctataagggcctcaggctcatccttcaaatgtccatggtctactcaacatattatatgtaccattcactaccagaaatgctaatcatagaactgccaactaaatcacagaactgtcaaccatagctcaattccctctgaactatacgacacattcttagttcccagtactttgggaggtcatggtgggagaatcacttgagcccaggagttcgagaatagccagggcaacatatgaagacctcatctctatacagttttttttttttttttttttttttttttgagacagagtctccctctgtcacccaggctggagtgcagtggtgtgatctcggctcactgcaacctccgcctcccaggttcaaacaattctcctgcctcagcctcctgagtagctgggattacaggcacgtgccaccacacccagctaatttttgtaattttagtagagacggggtttcatcatgttggtcaggctggtctcgaactcctgacctcgtgatccgcccgccttggcctcccaaagtgctgggattacagacgtgagccactgcgcccagcctaaaaaaatttttaaaattagccagacgtggtggtgtgtgcctgtagtcccaaatactcgggaggctgaagtggaaggactgcttcagcccaggaggtcatggctgcagtgggctgtaatcgtgccaccacacttcaccctgggcgatgggcaagacgctgtctcaaaaaaataaagtccccagctaaaaaagaaaggatgttattttaaaaagcgtaatttatgaaaacacttaccctgaccatcctctttgaataccagttctcttttttcagattcattctcattcttacccctgcgtctgtttttacctcctttacctgatggttt

SEQ ID NO: 6887 - DNA, 386 bp, artificial
  synthetic oligonucleotide
atccttaaaccagagaaaaatgtaaacagttttaaaaggagcaattcaggctgcaatgcagacttagacaaagtacatactgccatcgtcattttttggagagcatcagcttctggggagacctatcagctgccttggcacgttctcccgccacccttctgtgtggctttcttttttaaatgctgacgtgagaaaaagaaaattgtgaagcagtaggacaaatagctttctcaacccttgaaaacactgttgtccagattgaccctagtttgtatggtgatggtgtgacttcagcatctccattagcgcttagaacccaggactggcagaaccaggtgcattttcccttgccttaacgatctgactttggttgtgtggcttaacgc

SEQ ID NO: 6888 - DNA, 1576 bp, artificial
  synthetic oligonucleotide
acttcgaactgatgtttactcagtaaatcaaagaccggatcaccatttccaggtcccagaccctgaagacttaaaggacagtatgggaagtggccttttagcatcacggagcagagagctcgccaggctggaggaaggcagcagcgaaagggtcggggccgggaggaaggggggcgcaaggagaggagcgtcaggtgctctggaccccgggactgcgagccagaccaggaactggggcgtttcccgccccaccccccaacccctgtcaacccccagcaaaggcaacccagccccctccaagaccccgaggttccagcttcccccgagacaggaccaggaagacaccagcagccccgcgcagggccggagcccaccaggtccgggtgcccgtgtccgcagcgcagaggagggcgcgctcgggtgcaaaaatggccaagacaaaactctccccgcccacccgaaaaaccaaccacaccccctgcatccctcagcccgagccgcccggggccagcccccgtgatcgtctgctcaggcccccgcgggttcccgtcggcgccgcgcgcgggctcggcgggcacacgggcgcaagtgggagtgaatgggggtgcgcgaggcaggcgagggcgcccaccgcggtgtcccccgtccggaccctgcccccggggcgccctcccgggctccgcggttctgggactggcgcgccgccctcaaggctgaagtggacgcccggacgcgggcggcccccactcacccattggcgtcgagccgggccgggccgccgaggcagcgtgaaagttggcggaggcgggcgtgggggttggggcgccgggatcggggcgctgggatccaggcgcgagggtccggacgcggcggcggctgggccggcttcttcctcagtggcggcggcggcggctcagcgccgcccgctgctgcctctgctgctgctgccgctgctgccccggggcgactcctgctgctgctgttgcatcgcggcccaatgcgcccggctgcgccgggtttcctgctccccgcgagtggaaattgcgaaaaaaaaaaaaaaaaaaaaaaaaaaaaaaaaaaaaaaaaaaaaaaaaacagcgccgcccagcccagcgcccggcagccgcggccgcgccgcccgctctcccctcctcctcagcgctgccgcgaggctcctgcagctccgcctgccggggacgcgcggccgccgggcgggggcggggccggagaggggcggggccggggccggggccgcgtcggggcaggcgccgggggcgtccctgcggctgaggggcttgggcgccctcctcaccgcccgcgccagaggcacccctctccgcgcggctgccacccacccgcagcggctgggctgacgccccgggaagtgccgcgagactcctcgagaccggaggagaggggcttcttgggggaggggcgtgggagtgcaggggcacgtggagaaggaggagaagggggctgagcgggagggggcgacaagaggtggaggacgggctggggatggagaccagggcaggcccggggccaaacgcctgaccagggtgatggcaggtggccc

SEQ ID NO: 6889 - DNA, 2678 bp, artificial
  synthetic oligonucleotide
agtcattaataagcattgaaatgtttatagtattttatccaagatagaaataacagtatgaactgaactgcacttcatcttgccactctgtcacccacacctggagatggaccagcctccagcagtgcccccaccacttccgtggccacagaaaggaagtaagcagaggccttttctggtcttttcttgccaactggatagtattccgttaggacaagtatcacaggatttttgttattagtgttttttctttgtaaggctaaatataagcacagttgaccacagagttaagacccatgagctaccttttgccttaagcatcccctaatgaaaactacagaactgcctgcaagatatttatccataagataatgatcaagttgaaaaccaagtgctcatgatcacaggttgctggtggacctttgccagctgaaggaatttaagtgaagaaacgtggaatgatatcaaccatgtgtgtgaattcgagggatctgtttggcactgcagtgttttctcccatgatgtagaccttttttttttttttttccttgagacacggtctcactctgttgcccagactggagtgcagtggtgcgatgtcggctcactgtagcctcctgctcccaggttcaagtgattctcctgccccagcctcctgagtagctaggactacaggtatgtgccaccacgcctggctaatttgtgtgtgtgtgtgtgtgtgtgtgtgtgtgtgtgagagagagagagagagagagagagagaaaataaagggcctcccaaggaaatatcaaccaaaaacacacacacacacaaaaagccacgctttcccttttcctatcttcctttggaatctcaactgggatccttgggcttccaagtgttctccaaattggctggctggtccaggaacccccaggggacatggattctgaccttcaagttagaaacttactagggaggggtgattttaaaaaaagaaagttttggaactagatagtggtgatggttgcaaagcattgtgaatatacccagtataactatacacttaaaagtggtgaaaattgcaaattttgttacatgttttagcataaaattaataatgtaccaaaacccattgaattgcacaccttaaatggataaattgtatggtatgcaaattatacatcaataaatctgtttaaaaaaaacttacaccctggtgtgatggctcatgcctaatcccaatgctttgggaagccaaggcaggtggatcacttgagcccaggagttcgagaccagcctgggcaacatggcgaagccccatctctacaaaaaaatacaaaaattagctgggcgtggtggcacgcacatgtagtcccacctacttgggtggctgaggtgggaggatcgcttgagcctgggaggtcgaggctgcagtgagccttgattgcgccactgcactccagcctgagcaacagagtgagaccctgtctcaaaaaataaaaaataaaaaacttactacggaaagagactgtagcaagagcctcacgaggggaagcaggagcctgacattttctgagcacctacagaaattgggcggggctggttcttccatactggaaggcagttgggttctaccactaggggaccattgtcactctgcctctctgaggctcagtctcatcatctgatgtcatgggccatgactgccaaggctccttccagcacttcaatgccagggaccaatatgtgagtagcagaggacccatcgcctgtccccccacataaaagcacatcccaatagaaagacaaaacattacaggggccaaacactaccagaagcaagtttaacaacttcgtgccccaaagcccttgcctctccccagcttaactacctaggtatcaacggaagagaggcaagagttgtgttaagacactctccattcaaagaacaaaatggtgaaagtcccaaagagtcctgttctctagtgacttgtaggttcgtgcataaaacgaagactgtggttacatacaaagccttatgttccagaaggactgataatgaagtaaggaaatggtgctccagccatctgtgttaataagcccccggggttcccccagagcaggcttccttaacctcagcatgactgacatttggggtcagataactctttgttgtggtggtgcggggggcggctggcctgtgcatcgtaggatgtttagcagcacccctgacctccacctagtagatgccagtagaatgactctccactcccctgacccccgccaccagctgtgacaaccaaaagtgtctccagatagtgctgtgtccccctggtggggagaattgcccccagttcagaaccactgccagagagaattttctatcttaaaatgtgcagttctttgttaaagccatgtaatacatgtggcatcacccttctcacccactacagtgtgggccaccaggaactgtcagcaaacagaccttgtcaacatgctctgcccaggggactttacagaattgcacactcactcctggtggtccatagtcgtggagaattgcaagttgtaaccgtatttgggtgaaagggttacatgttcattcattaacatatggcacttactgtatgccaggcaatgtgccagggcaatggagctgagcagatccagttggagatggagacttaatacaagag

SEQ ID NO: 6890 - DNA, 658 bp, artificial
  synthetic oligonucleotide
cctccttgccttctggccacagctaggtcctgactgcctccacatcaccttccaagctcttctagacccaaggcctctctggcccctgccactgaggcaatcccaagctgtgtcttgtcttccctgtgagcccctgaatgccttctgggtatggatcacccttagttctgctggggcccctataagcatccatgacatgcagtaggtgctcaataaagacttgatcaactgaccactcagcttgcattttatgatgatagaccgttcccagcccaacaaaggtgctactaaaatgtcaagtgtcaatcacattttgcaaattgagtcatattcttccgtgcactaagggagcttgctatttaaaagatcctgtggttaattcttttgtaacatgaataattacttcctgctttacctttcctgtcaagatgaattttttttacatatcaggtttctctaagaagaggaaacctgtggctttgttaagagctcataaatcatgaggatatgtctctcctacccactctaagggctctttccagtgccctctgcaagcctttgaaaggtttagaactttgatgtccaatacagtgtcactgcaaatgtggctaatgactacttggaatgtggctagtctgaactgacgtgtgccataaga

SEQ ID NO: 6891 - DNA, 2856 bp, artificial
  synthetic oligonucleotide
agaaggaaaaaaaataagctggaaagggtgtaagtatgcacatggatactcaccacggttttgcatgttaacagcaaaaacaaaattagaagcaaaccaaacgtacacaacaggagactaagtgaataaactatatgctagccatacaacaaaatactacaaaccttagtaactctgtatcatagatatggaaaggtatttgtggcacatttaaattaaaaagctgtttataacagcttttggtatggctctatttggaaaattatttttttaatatatacttgtatacgcatgctggaaaaggttagaaggaaatagaccaaaatatgaaccatggttatctcggcagtaggattacaggagattctgcatatgtatattttggctgatctctattctaacttttctatcaaaacatttttaactgtgtgatttttaacttaaaaaaatgttggctatcttatcctttggcagacacaatgctcttccacggaagagaattcaacatgaaacatgttgcttgttctctattttgcccctttgcaggtctttcaacagtttttctgatgctttagaaactagagaaaggggaagaagacaggtctaacattttcaaggtcgtctttccctcttttaaatgtggctattatgttaggccagtggttcctaaccagaggcaattgtgccccagcaagggacatttggtaatgtctggagacgctttcctttgttgtcacgacttggagggatctggcgggggcggggggtgggggcaggggcgggacgggcgattgtgctattggcatctagcgagtagaccccagagatgctcctaaacatcctacaacacacaggacagcccccacaacaggcttaactggctcaaaatatcaacagtgccaaggctaagaaactctgggtaaatgagtcttcaagtgactccctaacccttcataaacagcaccctcaaatggctatataagagcatctgggccaggcatgggtggctcacacctgtaatctcagcactttgggaggccgaggtgggaggattactttagcccaggaattccagaccagcctgagcaatatagtgggaccccatctcttaaaaaaattttaaaattagtcaggcatggtggttgcacacctgtaatcccagctatttgggaggctgaggtgggaggattgtttgagcctgggaggttgaggctacagtgagttgtgatcacaccactgcactctggcctaggtgacagagcaagcaagacattgtctcaaggaaaaaaaaatatatatatatatatatatatatctggctaagaggcacccgtgctaaagtgggaatgcactgatcgctgaggcggaatacctgggttgaatcctggatctgcctcttttctagccgtgaagcctcaggcaggcaactgtactatcctgctgattaccccatcctcctctataaactggaaatcccaccactggccatccacctcccacctctgagtgcacaagaagcttcaacacaataatatgggagaagaggttttgtaaactataaagcaccatgcacatgtgaatgctattatcattctagggtagtagttggccaagtttactaatgaacacacacttagggtttcaatgagtctttacctagcacattcccactgccctgagtcacattaacctacttcagatgctaacttggcagtgatttttactaaatactgaagctgaaaaacataaagagtggttttcctatattatctctcccttggcttaaactgtgaagcaccagaacttagtgatcagacaacatgacctggaatcagactcccaggaaagaatcccacctttacatcttactagcttggtgaccatggaaagtgatgtggcttctctgtgtctcagtttcctcatctgtctatccaaaccagaacatttcagagtgaaatggtttatcatctgaccaggacatctgagaatgaaagcaggtgatgtcaatgttaatgcgaggacaacaggcatacaccagaacggtccccaggcaagtagaggaaataaggtggctctaaaagaagggataatgctgggcatggtggctcacacctataatcccaacactttgggaggcccaggcaggcagatcactgagcccaggagttcaagaccagcctgggcaacatggtgaaaccctgtctctacaaaaaaaaaaaaaaaaaaaaaatcagccaggcatggtggtgtgcaactatagtcccagctactcaggaggctgagaggtgggaggctcacttgagcccaggaggtcgaggctgcagtgagctgtgattgcaccattgcactccagcctgggtgagagtgagatcccgtctcaataaatagataaataaataggccggacatggtggctcacgcctgtaatcccagcactttgggaggctgaggcgggcggatcacgaggtcaggagatcgagaccatcctggctaacatggtgaaaccccgtctctactaaaaatacaaagaattagctgggcttggtggcaggcgcctggagtcccagcatctcgggaggctgaggcaggagaatggcatgaactcgggaggcagagcttgcagtgagccgagatagcgccactgcactccagcctgggcgacagagcaagactctatctcaaaaaataaataaaataaaataaaataaagaagaaaatgataacagtgcctgcctcacagccttgtagtgatgactaaatcagataaaagaggcaaagcacacagtacacactcattaaatgctagctacgattttttttgtccttactccttccattcattcagcaaatccttag

SEQ ID NO: 6892 - DNA, 2292 bp, artificial
  synthetic oligonucleotide
aatttctgtactacaccttctcacaccactttgcatgtattatctattttttggctgtttgatgtgaattgtgtgttcctggaggccacagctattgcctattctatttcggtattctgcacagcccctagcagtttcagcaaggagaacatatttaacaaacactgataattaactagcattagtaaatgtttcccttattcatgattcacaggttttctggacccaagatgtccttcagagaaggggtctagccagtttgattctgtgaattgttgtaaaatcataatcaaatagtgactcattgcaaaaaaagatccaaattcaacaaattgaatcctcttggcatgctctgcacacagaataggaaacatcatgacattcagaaggtgcccgacatctcaattcacaggcacaaaatgatatttaaatagcatctgtgatggggacacagccaacatatacaaaaaagttacaagtaacattgatgtggggtggagaggagttctctcacacttttaagggtaaattatgctcagcataattctcaatcacattttaattttactctgcaatctatttcactcattcaatcactctatattgagggtggccagggaaggcctctccagcaggtgacttcttcgctgaaatctgcatggcaaacaagaatggcagaccaggcagagggacttctcctgagaagctgccggacgcaggcagaggtgcacagatggcaaatagggttccaatataattggtgttatgagttgaattgtatctccccaaaagatatggaagtccttatccccagtatccatgaatatgacgttatttagacatagggtctttgcagatgatcaagttaaaattaggtcatttgagtggcgctaatccaatatgagtggtatccttataaaaaggagaactttgggatgggagctgtggctcacgcctgtaatctcagcgctttgggaggccaaggtgggaggatcacttgagcccagaagatggaggctgcagtgagccataatcgtgccagtgcactccagcctgagcaacagagcaagattctatctccaaaaaaaaaaaaaaaacaaaaaaaaaaaacacaaaaatgaagaactttggacacagagatatgcacacagggagaatgccatgtgaagatgaagacagagactggggtgatgtgtctacaacccaaagatcgccagcaaaccaccagaagcaaggggaggagcagactctccctcacgaccctcagaaggaaccaaccctgcccacaccttgatctctgaattccagcctccagaactgccagacaataaatttccactggttaagccactcacagcatgtggtactttgtcacagcagcacaagcaaactaatacaatgggtgtcaggtacagtaaatattcacaccacgctgaaagtcactttgaatctattttggcagcagaatccttgtcctaaatacaattttacctggacctccaatatgttaacagatgaaaaggatgaaaagggttactcaaaagaaaatacttcactcaacctataaagtaccaatctctgatcacatgagttctttgcaaccctctttgaaaaggacttaaaaggaaagttaaaaaaataaaaaaataaaaagaggccaggcacggtggctcacgcctgtaatcccagcactttgggaggcctaggcgggcggatcacgaggtcaggagtttgaggccatcctggccaacatggcaaaatcaggtctctactgaaagtacaaaaattagccgggcatggtggcgcatgcctgtagtcccagctactcaggaggctgaggcaggagaattgcttgaacctgagaggcagaggttgtggtgagctgagattgcgccactgcactctagcctgggtgatacagcaaggctccatctcaaaaaaatatataaaaataaaaataaagaaagaaaaagaaaaacctcaaaccagacggggtcagaaaacttgggtgagggaagggggtggtgatttctattatcatattattaaatgattatggtgaccaccaccactgccatttgaaagtacctcctagaagccaggcactgtgtccactcttcttgtcaactcagggtgttgtggtccctctttaggaaagcaaaatcaggggacctgacttgctaaaagcccccatcttagtcagcctaggttgccataacaaaataccacagactaggggggcttaaataatagaaattcattacctcacagctctgaaggctggaatcaagg

SEQ ID NO: 6893 - DNA, 1453 bp, artificial
  synthetic oligonucleotide
gcaccagaatgtgtatggaaggcttgcatgtcattttctccccatcactcagaagcctgggagttaatttcactgggcttcagtgttctcatctgacactgagttaaacaatatctaaattcctttccaccttaacatcataagattctgcctacactattagcacaaccacttggctgttttgatttttaaaaacctaatttactaaacacttttttggactattgatctgttacatgggagcccattttattattatttttaaatttctggttgaaacctctttgcaagtcctaatgagtaactaggtttgggagacaattatcaatggctgctaacattcaaaaagtaggacggccagacattatgagcctccaagtggattatccatcaccacctaggtggcaggtttactctcgcacgcacgcacgcatgcgcactcaatctctgtcgctctctctctctctctctctctctctctctctatatatatatatatcttttgagattatatatatatatatatattttcaggttttatatatatattcaggtttatatatatatatatatattttcaggctttatatttatatctaatctaatcaagaccccagatctaatgatcaatttataggaatacagatttaatgacacagcagagatgaaatcggcaaaagccacgctgtgagaaattaatagacaaaggggctcagttgctttagcaaaaaaattacaagaaaaaaaggagatatgaaggagaaatctatagattcaaacagatttgagacatactgactaactgcaacgtatgtactttatttggatacagactcaaatgaattgcaataaagaagactttaggggaaagtgaacagtgaccatgtgtttaattattctaaggacttgccataattttatgtgtgtgagataaatggtatttaaagacactcttttactgatgcatgttaaaatatttatgaatgaaattatataatatctggggtttgccttcaagataatatggacaaagcgtgcagagggctataattttaacaaattggccaaaggttgataattgctgaagctgagtgataggtacacagaggttcattatactattattatttttgttgatgttagaaattttcaataataaaaaagtttataagaatcttttttgaaaaactacctttaaggtttcataagttctgaaaatggtaaagatgttttcaaatttaaatatgcagtgaaaagtttctgctactacataactataaattttcctctctgagataaaatggataaaatatccaccaatacaatcgttgcaattctttccttgatagactagattaccctaaacaaagatctaagaaagtttagagactttcataaccaaccacgatatggaaaaatacatcagaataagagaaaagcaagttcaaaagat

SEQ ID NO: 6894 - DNA, 3461 bp, artificial
  synthetic oligonucleotide
tgaggatgatttctatttatttctttgtattcttcaactttgaataataataataataataattattattattattacaaagagctcttgtaatgagagaagtaacagagctacctccattttgagaaacaaacaagcaaagggttcagggagcacttaccagtgcaacaagtagctcagacatcacaggaccaaggcaaaacctgtcaggccccccaggggctaccattcctctcccatctccaggccctagctgctgagactttcccacgtttttcacaccttacaatcaatcatgctttcactcatttccccaaggaagaagattcaccatctttattttgcatataaatacctcattcagatttctactcatcagaactcagaacaaagacatccagcataagatcagcaaacataagctatctttccctaggaaaatcctctcaagccattgccgatgaatatatttttatcctagccaacccctaacggcactctcctcatatatctgcctctgtcctcctttctaggcaagcaacagatgccatttaaaaacctttcaagaagttcccctactcttaaaatgatatgttaaaacaatgtgtttccttttggccacgctatttttttttttttgtaattttgaaaatagtataagttaaagccaacagaaaaagacataaagggacatattttacagacctcatcaattctccccttaaaatttttttttcaatgagagacagggatatggaagacatatgacacactgtaagccttacttatcctgtggtttatttagggaattttgtgtttggaaaatgacagacttctgcttttaggtagacaaatatgaacaactcacagagaaaaacaagaccacttatttctagcaaacttttataaaatcaaaataatttagtgtcttaatttttctccatacatgagtacatacctataaatgccccgcactacaaaactagccaaatatctttaccccatcataaaaaaagcagttcaatagcacccagaagtcactactcacagctgctccactcacaaagaaaactccaaatgtcggtgaccctcaagagtgaaacgccccacagctggcttgctctgcatggacatacccttctctctaagctaacctgaaaagcaagctggatttgtttactgcacaaacatctgtaattgctaaacatctctgtgacatggtgtaacagttaccgcttgtgcaaactgcccatctaaatttctctctgcaatatgagcacatgaaaacccaagacacagagagattggaaacatctgtaaaaattaatggccaaattgaccaaagtgggagggattaaaacggctaaatagctccagagtgacattcagctttagcaaataatccgtatacttgataggttcctcctcagcttatccatagctcccctctgtgggatcctagctggcacacacattgtttcaacccactaatgcaaacccattacccagtcttgctacaaaatgttatatacagataagatacaggttaactggatttattacaactctaaaagcaaaaaaaaaaaaaaagaaatacctcttctcccatgatgcagccagcctcctctcttcagtttgaaaaggtcccagaactcccctggaatcctcccacttccttccaacagcacggagcctgaggacccagcctaaccctgagtcatacttgggaccaaatgaggaatggggagaacaaagctcgcatttgtttatggttcaggaagccagggccaattcatggcttgggtggcttcgagagaagtcctcctccctcgcctatgttgctgctgcaatctgggctccctcctggggcccccaggtgtgaccattcggacaaggaacacactgagggagtgtttatttggcaagacctagtgatcacgtctgtttaaaaatgccagagaagaaataaaaagcccactatctttcaacagatcacatggctagagagtgagggatatctagaatatagtctgtatatgacatatcaatcatgaacatgcctgtattttaaatgcaattagttgcactacacaaaaattactcataaacacacacacacacacacacacacatacacacacacacacacagaagaaggaaaaacagccgtggctttatggaaatactccccctaggaaaaatacagcaacattgctgccatgtcatcaggagcatcctaacaggttgaaatgaaatatttaaatcacaattttgttctttcccccaaaagagataccattttaatcaccacttcaatgaatctagagcgcagtggttaagtgttcaaaactctggagccggagtgtttgagatcaaaatcccagttgagctacttcctggctttgtgatcctgaacaacttattcaacctttgttcatctcagtttccttatctataaaatggggataatggcaccaacctacagggctgtctggaaaattaaataatatatgtaaagtacttacaaaagtgcttggcacacagtaaatatcatattagccacaattacaagttcaggacaatttcacaaatcaggatgccaagtaaacagtatccttatcttaccacatttctcatatgcttagactttgatgacctgtttcagttaactatggttaatatttaaatttttaattaaactaatttaaaaaccatttgcttactatttattaactgcctgcactgtatctaactctgtaaggggctttaaataagatgctgtcccagtcctcaagaaatttacaatctccttgggtaaataagacataaatctgtttacttatcacacacacacacaaatgtaggtgatgtcactaggtagtaaatgacaaatataatacaagtgctacagaattagcatttggaattcagagaacagataaaaaaaattcccttatcaaaacccaactaggacggaggagaataaacaaatctcctgtgtagaaggattccaaatcatttctttagatactcctccctcaaggaggtagaatgaaactccccactctttaagtgggaggggcacagagtaccctttttccaaagagtcaagtatggaaagagggaaaaaaccagaactttcgagcggagaaacctgactaacacctacgtcagccaaggtgactaaggttaacatctatagcgataagtatggaattaatatgatgtaatgagagcacttcacctctgtggccttcctcccaaaaacccacgactccaatctactcatgagaataacttcagacaaatgcttatttaaggacattctacaaaactgaaaattgccatggtcatcaaaaataaagaaagtctgggaaactgttaaagcctaacaagatgagaaaactaaatgtggtattctggatgggatcctgcaacagaaaaaggacactggataaaaa

SEQ ID NO: 6895 - DNA, 1175 bp, artificial
  synthetic oligonucleotide
gcagtgttggaaggcagctgtggttggctcaagggggtgtctgtcagcacccccaaaatgatggcaagcagctacctatcctttgttaagcagcatgggtccccatcaccacaagggcgccaactggatgaaagctgaaagtctaccttcggtcaatcagaactcccacgcattctctgccatttggtaacagcagtgttgaatcagaggctacaggggacagagctctaacgccctggcaggacagaaatggccatcactgagaaatcaagagcaaatgcccccgaacatggacagctgtggcccctggagccatagtgaccacatataatgaggcctcttggaaatggaggtgggagaggggcttttcgcagagatgtttaagataaattccaggctgggtgccgtggctcacacctgtaatcccagcactttgggaggctgaggcaggaggatcacctgaggtcaggagatcgagaccatcctggctaacacagtgaaaccccgtctctactaaaaatacaaaaaattagccaggtgtggtggcacatgcctgtagtcccagctaatcgggagtctgaggcaggagaatcgcttgaacccgggaggcggaggttgcagtgagccaagatggcgccagtgcactccagcctgggtcacagagcgagactccgtctcaaaaagaaaaaaaaaaaaaaaaagataaattccaaatgagaaacccaatttggggcacatttcctaatgtttcccttccccaagacttcctggggaaacgatatgtagtaagcccatacgattctaagaagatggtcacaggaaatgtatccagatctgcagagaggtgacaatcatttatttttgaaataaaagccctcacaatgtcctgccccactgagcctaggactcacgggcagcagaacccaaagggacgcacctgcaaccgaagccggattttcttctcttcatccaactcagacaataactgtttaatctctcgtctgaaaagcaaatggcaatgaaattaaccaaaatcccagacttccttcatcagagatcagaaatctcttattatgactacaaaatccatctgatccttttttacaaagaaactgtggacaacacatcattattttctttgcattgttactgcttaaaatttgtttcagacagta

SEQ ID NO: 6896 - DNA, 564 bp, artificial
  synthetic oligonucleotide
taaaaatccctaatgtataaggtatgccaattttcatagtataaatactcccaccatcgccaggttcaagctgccaacgtgacactactaaatgtggaactggcacacacatcattattatatagtattcctaccacacagatagactaaatgtaaatggcctcaggagcatagacaaaaccaagatgaaataaaacaattagggagtgatgatttttgagaatttactacctttgctttaaatataacttactaattataaatttatataatttaatttgtaaaattgctgtgtttatgaactggctcaaaagatctctgaaaattggactttgggctccgacaaaccccagtatgaaaccgctctaacacagcattgagcccagagtaagagactgaattatccatttcttcctctggccaccatttctttatttttattttttattttttggcacaaggttgtaccccttttcttctatggttgctgttgttaaacttttgctatttttttaaacattcctttttgtttgtattaagggaaagaaattctatgattggctt

SEQ ID NO: 6897 - DNA, 2095 bp, artificial
  synthetic oligonucleotide
tttgggggtagaggtggcaaagaggtattaaagctatacatactgtaaagtcttaggacctcgtctcccaatctcccacttttcctaaggttttcagcctgctggacaaaaagtacttccgtagggcctgccggataaagtgtggtccatggaacagcatcagcagccactgggagcttcttagaaatgcagacgctcggcccccaccccagacctgcgggatcagaatctcattttaacgggatccctgggggattatcgtgcacagtacagactgtcactgtcgaagcagccacggaaaacctgtcccctgcttcgtctggctctcgggaggtcagctctcttcttccccctcactttttatcgggtttcggagcctcgaaactcgagtccctgccgaaatgcgctcactccgagaccacgagccccctccttccccggcgtgctcaccccctggctccgggccgccgctccgtccctcggtgcccggggccacctgttcggggccgcgccgagtggtgccgccccaagccgtccggggcccgggcgcgttcgcgctccgccagcaccgccgcagcccgaccaggcgcgcggagccgggctcccgggagttggcgtctagcacaccacccgcgcgagtcaggctcgtggctcagtttcccgcgggttggggaaagtacggctccgtccgaaggttttggagacgcgcgtctccccttggagcctcctttcccacggcgcgcgggctcccccagtcggggaactagccccggggctgggagctacgcctccgcctttcaggatgttcccgggccccggctaggaacagcagccgggcggaaggcgcgttcgtcccgccggcccgctggcccgccgccctccggggctagacgctgcgcccgagcctccagcgcccgtggccggctgtgcgagtctgggtctcaggaccccaaggggccagacccgtcctggcgccgagcgcttacctgccgctcgcgtcctcggggctggctgctggcgccgtccggcccgccttttcccctctccggggctgcggccctcctccccccgcccgcggcctcggcgccgcccccgccgctcccggcccgctccgccgccagctctccagctgcccagcgcggcgtggcgcgtcgggcgctcggcggcggcgaggctgggcgcggaggtggggagcgggcggggcgcggagggaggagggggagcgggcagcgcggccggccgaagccgggctgggagctcggggcaggggcaggggccggggagaagcgggggcggcgagctcggccgcccaccccaccgcagccgggggccccgcagcgctcctgggctccaggcactgcgggaccctcagatgcccggcgtccagcccagcgagctcctccttggggaccccaacggaccccaacctccagactcagcggctcacctttagggctcgccccggtacccatatgcccgtttcagtgtcgcacgctgtaatgggtgggagccccgagggcgcacttctaccaagatattcctgaatccggagatcagatgtcagaccacttgagaggggaatttggagagagcagtaaacgagaaatgtcccagtaaaggattcagttcgatggttttcctggtgaaggactggaaatacaccgggttcccagaaaccgggatctcgggcgctctgcctgctgggggtcgaggtggagggggtatataaagtgagttgtccctggtcccctctacctttctgtctcagcatctctcctcctgcatggtcatagaataaaaactagatctggataggacttacagatcccctaagcaatttgtcaaagtaccctattttacagatgggaaaatggaggctcagttctacaatacgaattagttgtagagaccagggaaaaaataagcgctctgaattccctttccggctcattttactgcccccctcccccgccgcctttatagtcgaataacacctgtgtttgcaaaatgctttgtcgttttaaaggcatcgttctctttcgttaaacctgcgggagaatataccatttttcctttacaactagaacaaaattct

SEQ ID NO: 6898 - DNA, 13090 bp, artificial
  synthetic oligonucleotide
tgttctccctacccattgtgagacaggtgtggtatttatttcactagttaacagtgatattcaaatataagcgacaaggaacaatatggcagaactaagtttagtggaatatttaaataaatagccttttaaagtttcactattttaacacataaagtaaggagaatgcaactttgtttcatattcacagcaatctggtgtatctccacttatctggcctggcccaagacagtgcttacacagggctgtcagctcacgagaagaattgaccttgaaaaaggtcccctcaactctcttggtggtggctcttttgttttttttttgtttttttttttttgagatggagtcttgctctgtcaccgaggctgaagtgcattggcgcgatctcggctcactacaacctccacctcccggattcaagcaatgctcctgcctcagcctccagagtagctgggattacaggtgtgcgacaccacactcggctaatttttttttgtatttttagtagagacagggtttcaccatgttggccaggctggtcttgagctcctgacctcaagtgatccccccgccttggcctcccaaagtgctgagattacaggcgtgagccaccatgtctggcccgttggggttctttaactgtaaaaggcaactaagtgatctgactagatctttttgatccctgcaaagcttgaaacaattccaaatctctcccttgtgtgagttattgcagtccttgatttgtaaatggaggatttgagcactttttttctatgaattactcaaatgttttcatctgacactaaattatttaaacgctgtccagaaaagagcaaaagccttcctcctggctgtccccaaaaagagctgaagtaggaggtgcagaaggcagggccctgggttatcccaggagggggaaaatgttatctatggagtgatccctttaacacaaagaccagacaaccacctgtcagccagtccctgtctaactaggcactaagaatgtcacctctgccccaattggacccagtgctgcccgaaatgctggagctggtccctggagaagggcactttggcttcagcggggagaagtacagggaagggactgactggatgcaggaaaaagacgggaggggaagctactgcaggaggagggacggcgaggctggtggctcagacaagaatggtggtggtgacagaggaacagaggcagcaggtgggcttgaggaatgtttagggtgtaaaatcaacagggcttggtgatggattggatataggtgggagaggggaaaaaaggggccaaaaagactcctaggctgccgactgggtggtggtgccagacttgttggcaaagatcttgggtttgctggaaggaatgagaaactgggggtggctttctctcattttctcctggggtcactcttgacagagaggcaaagttttcaagtcagtggagcctgttactaagcactgagcaggaccccactggtggcgagtgaggggagactggcagctgctggcttggctgcagccgactcacagaggctggccagtcacaggagggactctgcattttgttctaggagttacgaacactatgggaaggctgcaagaggaaagtagtgtagtctggtgcctgatggaagatcatgtactactttggagaggagagtctgaaagtggaagcagggaatgaattaggagacaagaggggtggtccagtcaagagatgacggtggcttcgatgagggtggtgacaatgaatacagacagaagtgggtggagctgagatgtgtttcggtggtctctatccattagaaaattctccccattcaaggtggggaatttccttccattctaggaggaatcaaagctgactcctacactatgtttaatatagccttatttaaaaaaaaaaaaagcctcaaacatatagggaagcaaagagaaagcaatatagcccatatccatataaccatcacccagatccaacaaatgaaagcattctgctgtaactgtgccagtctttcctttattaaaagaagaaagaaaaagttaaagatcaagttgaagccttccttgtggtcttctctaatggttcacaaacttcccagcagttctcaaactttttggtctcatgacccctttacacttaaaaattactggagaccccctaagagcttttgtttatatgcattctagctactcatatttaccatattggaaattaaaactgaaaaatttttaaatatttactaattcgttaacaaaaacctaccgcatgtcaacataagtaaaatttttgtataatttcaaaacaaaacattaaaaaaaaattttcaggccgggtgcagtggctcacacctgtaatcccagcactttggaaggctgaggcaggaggctcacttgaggccaggagtttgagaccagccttggcaaaatagcgagaccttgtctctacaaaaaattaaaaaaattttttttcaaaacaaaaaagtaacaagaagaatggcagtgattaacattttaaaaaatctctttaatgtccggcttaatagaagatagctatattctcatatatgcttctgtattcactttgtggcaacgttatttcagttgaagtatatgaagaaaatccagcttcacacagatatgcagggagaactattttaagtctttttggataattaagaatattatttgatacaatcaaaactcaacaagtggacggtttcttaaacgccagttgaaatgtggaatctgaaatcataacaatgagctttatgtactctgacgttttaaaatccattggtctatcttgagctttgaatgaatcatttgcccatgtgtgattttataacatcaagcattggtcatttggaatacatcagtttagtgagttatgcagttagcccaaatgttgacatatttcattatccacatttgttaatatcaccaccaatctcatcagaaaagttttttaagtatcaggaagctttaagtcaagtattaggagctttaagtcaagctcacagtgactcacaagctcatacatgtttccccaaaatgccgggcaatggctcacgcctgtaatcccagcactttgggaggccaaggtgggtggatcacctgaggtcaggagttcgagaccagtctgaccaacatggtaaaaccctgtctctactaaaaatacaaaaaattagcggggcgtggtggtgcacgcctgtaattccagctacttgggaggctgaggcagaattgcttgaacccgggggcagaggttgcagtgagccgagattgtgccattgcactccagcctgggcaacaagagagaaactctgtatatttaaaaaaaaaaaaaaaagtttccccaaaatctcatttcaattcaaagtttaaattttatcactggcaacaaatattgtcagttgttttccttgcagcaataggctcactttgctcatttttgagaaaatgtctgccaaatgcccaagtctgaatgaccataatttgacaacctttcaagcaaaaatggtgtccaagaaaaaaaccaaactgctagttcagctcacagctcagacaactgtgtaaatgattttcctagaagcagccatcgtacttcggtgtgcagcggaagtgctttatatgtacttttcacgtcaacacacagaatattttaaagatcagataaagtttaaacttgaaaaaaaatttttaatgctccaaaaaggacattcttaaatgcaattgttttttttttccttttcttcttttttttgttttttatagtatgtgactcctagtctagtttggagtccctgccttgatttgtactaaagcaccagctttctattatcactgcaaatgtcaacacagtgaaaaaaggcaaatcacatcttacgaatgggatgaaaatagttttgacctcacagagatcctgaaagggtgtcagggaccttcggggatctggggatcaccctctgtgaactgtcacactactccaaagccggagtgtatttttcttgtccatgtttttaaaatttttacaagaaaagtatgtgtccataagcaagatataaccatatttcaggtgttttaaaagttctacatacctagtaatattctatacttattgttctataacttgctttttttactcgtctttaaattttttaatagacaaaaattaggctggatgtgatggctcatgcctctaaccccagcactttgggaggctgaggtgggaggatcgcttaagtccaggagttcgagaccagactgggcaatacagtgcgacctcgtttccacaaaaaataaaaaattagccaggtgtggaggcatgtgcctgtagtcccagctactggggaggctgaggtgggaggatcacttgagcctgggaggttgaggctacaaagagccttgatggtgccactgcactacagcctaggtgacagtgataccctgtctcataaaaaaagtatatatttatcatatacaacatgttttgaaatgtgtgcattgtggcatggctaaattgaactaattaacatatgtattgccctacatacttatttttgtggtgagaacacttaaaatctactctcttagcaattttcaagaatgcaatatattgttattaactacagtcaactatagtcaccattcaactttaaatgtttgagggttatccagttcgatacatgtaaatctgggttattcattttaatggctatatagtattccagtgtagctagatctcttatttgtccatttccaaattgaagaacagtcagattgtttctaattttcctcttttataaacaatgcttcaacaaatgtccttgtacatgtttccttgggcagtgagtaagagcacatcattagtgtctatatttagatatgggcctcctgggtcatagagcatgcattgcttcagtttcaccatctcaaattgctttccaaggtgattgtaccaattaacagtctgtagtttacatcttgcagcatagaccactacctaatcaccaatccaatttcctcttcttcctaggcacttagttatactatgtttcccatcatcccttgcagttccacatggccctgtgcttgagttttagctaaaggaatgtgaatgaaagtaaagtacacaatttccatgccttgcccataaagccttcccatgaataatgtttagtactttcctggtacaccagcgggatgtctacatccagggtgaccttggaagctgcacactgaagatggtaaggccactggtagcccaggtatctgggtgaaccgcccaatgacctggacccacaatggactgttatatgtgtacaaaataaacttctgtgtttagccaaagaaatttgggttttgtttgtcatagcagttagcctaccttaactaatacatcttctcatgagtgacacatgacacttacctcttcttcataaccttgccaacacttagaattatgctttaaaactgttgccatctgtcagtctgaatttgttgtttagatttgctttactttctcagattgctagtgaagttgagccatcttttagcccgtttgctttctcctctgcacattgcttgtttacattgtagaatatgatactattatagaaatatataaaattactataaatgatgaagggaatcaccttgaagagatacagtgaagtaagtcacctggatttaaaatatttttttggttattctggtactatgttgcatatctcttctctttgtaatgaaaagacaatatttacaaacccagaagctaaacaatgatggtacctgctatttcatcaaattaaaacaagctctcaactaagatggaaacctgaatccaatcaattatataaatggctgactctctaaggactctcttaggattaagcttttgtattatagattgctaaataacaaataattccagaacttggtaacttaaaaccaataaacgtctattatctctcacagtttctgtgggtcagcaattcagaagcagctttaactgggtgggtctagctcaaagcctctcataaagtttcagtcaagatgttggccagggctgcagtcatctgagagcttgactagggcagaggatctgcttccaagacgtgattcaaaaatctttcccattctgtagctcatcttttagccttgtttagataaacttcttgtcataagaggttttgcttttgcatatagttgaatttatcaatttattttatgatttatgatttttatgattagtttaagaaatcatttcctgtctcaagatcataaaagtgttctattttaagttttatagctttgcttttcacatttaggtctttattccctctggaatttattcttgtgcacggtctaagagaaagtcagaatttctttttatccatatggacagccaattgccctaacattttttattgaataatctatcctttctgttcttgaggtctttcctcttttccactggtcaatttgtctgctgttgtgccaatatcacacaattttaatgaccttagatttatgttttgaaatctggtaaggcattccttcccctcttctatttaaaatgtgtcttggctattcttggccccttactacagcatgtgaattttaggatcaatttccctgaaaaagtctctttgggtttggattggcagtctaccgaatttatacattaatttggggagaatatatctttacaacactgaatcttcccattcaagaacatgctgtgtctctcctcatatttgtcttcttttatgtccctcaatagagctttataactttctccaggcatgtctagcccttgcattatattcaacagtttttgttgctactgtgaatgcttttctaagaaatgataacatttacgaattgtttgtggctgccataaagggataccttgattactgcatatagatcttatatatgggaagcttgcttgaaaaatggaaaactctagttccagtcactttgggttttctgtagcacttttttcctgcaaataataatctccatgactcttatttccttttcatatctgttacatgggggcacaattacaatgctgaatagagggggtgatagtggggatccttcaagttcttgactttaaatctttccccaatacattacttacgaggtttgtagatttattttcacattaccctttatcaagataataaaattccattgtatgcctcattgtctaagaggtgctttttctgagacggagtctcattctgtcgcccaggctggagtgcagtagcatgatcttggctcactgcaacctccacctcccaggttcaagcaattctcctgcctcagcctcccgagtagctgggattacaggcgcccaccaccacatcacatcctaatttttgtatttttagtagagacggggtttcaccatgttggccaggctggtctcaaactcctgacctcaggtgatccatccgcctcggcctcccaaagtgctgggattacaggtgtgagccaccgcgcctggccttaagaggtgcttttaaaatcattaatggatactggattttatcaaatgcttttctatatctattgagatgatcacactgtttttcttctttattaatgtggtaaaaatagattaatagattttatagtaaatttccttgtatttgggggataaaccacacctgatcatgatgttttttatatacattgcttgattcattttctgaatatttcacttcatgtatttaatatcaatattcataagtgactttcctctgtaagttttatgttttaacatgccttgtttgactatcatggggtattggccatctgaaaggagttgagagctgtctctctttatcttttatctgaaacagtttaagatagggattatctgttaatcccttgcccctctgtctacaacaatggaggcattgtactcactgggcaaaatgccagctctggctaaatctgcctctgccaactctgagggtgcacccatgcagctaaacgtggctagagaaaaacacacagccacactgactgaactcccttaaattaatgacccttaatgctgtccaacgattatctagaaatcccttgtccattcattccctttttctcctaaaggactgtttcgtaccttctctctcaaacctccaataactcctccccatcctcactctcagctagtgaccgtgcttcatatttcgctgagaaggcagaagcaatcaaaagggaacatggtgctggtgtgccctgcttccctcgttttgatggatgtgctcctctctaaggtcacctgcaatatatatgctacaatctatctgctctcatgcacgccaagactttgctccttgcattatcagtttttccctgtctactagatcatttccaccagaaacataatttctcatatttaaaaaaaccctcccaaccccatatctccacccaaccactgctcttatttacagcagaactcttcagaagaacaatttaaactcagaatcttcagtttctgtccttcccttctctcttgaattcgacttgcccaatttttgtgtcttatactccacataaactgtcggacatggtcaccaataacttccacatccccaaatctaatggtcaactcttagtcctgatgctacttgaccttgtctcattattagccttttactcatctgattacttcctcctccttgaatcactttccgacttccatcttagtcagtttgggttgttttaacaaaataccatagatcggggggcctaaacaacagaaatatatttcttgcaattctggaggctaggaaatccgagatcagagtgccagcagggtcaagttccagtgagggccctcctcttggcttgcagatggccaccttcttgctgtgagctcacatggtggtggtggtgagaaccatctctcttgtgtttcttcttagaagggcattaatcccattcatcaggaccctaacccttatgacctaatcatctcccgaaggccccaccgcctaatgccatcacattgagattagggcttcaacacaggactttgaggggacactgacccttggctgcttttcctgctacttccctgatggcttcttctcatcccccttggcagtacctccccctcataatctggatctctccacttttgggggtctcctctttgaacctcatctctcttctgtctgtacttgttcctgtgatctcgtctcgtctcgtctcagggccttttaacttccacacatacaccaatgactcccacatttctgtctctagcccagacctctcccctaacttctagactcacatattcaactgcctacttatcatttctacttggatactgatatgatttggctctgtgtccccacccatatctcatcttgaattgtactcccacaattcccacatgttgtaggagggacctggtgggaggtaattgaatcatgggggcaggtctttcccatgctgttctcgtgatagcgagtaagtctcacgggatctgatggtataaaaaggggagttttcctgcacaagcactgctctctttgcccgctgccatccacataagatgtgacttgctcctccttgtcttccgtcatgactgtgaggcttccccagccacgtggaactgtaagtccaattaaacctctctcttttgtaaactgcccagtctctggcatgtctttatcagcagcatgaaaacggactaatacagatacctaacagacaccttgaacttaacaaaactctatcttccaccctaaacttgcttccccacaattttctccattgcagtaaatggtaattccatcctaacagttgtttaagcctaaaatcttgaagtcattcttgacttttcttttttcacacacccaatattcactccaccagtaaatcctgttgtctctaccttcgaaatttactccaaatctcaccattccacactgtctccacttgaacaaccgttgtctgagtcatcatgctccaactgcagaagcttcctaactggtcattcattctgctttgctccttggtcccctacagtcaatattccatgcagccaatggagtgactcttttcaaacatgatttgaatgatatcatatcattcccctgctcaaaaccctctcagggcttcccttctcactcagaataaaagtcaaattctttttttttttttttttttttttttgagacaaagtctcactctgtcgctcagactggagtgtggtggcacgatctcggctcactgcaacctctgcctcccaggttcaagtgattctcatgcctcagcctcccgagtagctaggattacaggtgcctgccaccacacccggtcaatttttgaatttttagtagagacggggtttcactatgttggccaggctggtctcaaactcctgacctgaggtgatccacctgccttggcctcccaaagtgctgggattacaggcgtgagccactgcacctggcccaaattctttaacttccaagatacataaagaaatcaatctctaaatgttccttggtccttctctgtaaaagcatcttggactaggactttttggactcattccatttctttaaaggttacaggtctaatcaggatttaattttttcttaacactggtaacctttatctggaaaacagcccactcttaatatagtagtccttccttatccgtttttgctttctgtcatttagttactggtggtcaactgtggtctgaaaatactacatacaataaaatattttgagagagagagagaggccacattcacataatttttattacagtatattgttttaattgttcaattttattattattgttcttaatctcttacttataaactttctcataggtatctatgtacagggaaaaaacacagtttatatatggttgctactatctgtggtttcaggcacccacagggtctggaatgtatcccctgtgaataagggggactcctgtattattcatttgtccctcctccctctcctgatccctctcaccaaccctgccagaagtctgcctatttactagtcttttcaaaaaatcagtttttcactttgtccatctttgctgtctgttttatagtacattaattgctgcttgtacccttatttcctttcttctattttcttgaatacactctgttgtccttttcacaactgtgagtttattaatttttaaatctttcttcttttccaatatatacatgtaaggatataaatttcacttcaaaccccactttagctgtaatcccatacatttttatttggaatgcttttgctgtcattcagttctaactctttcataactttccttataatttcttttttgatccatgacatattcagaagcaggcttgctaagtttccaaacatatatgacaggcatcagcaattgtttgttattgctttctaattttcttgcattttggccaaaaaaaaatgtggcatgcataaagttgatctttcagtattttttgacatttcccttatattctaatctgtcatcactttttgaaaaaatatcttgtgaagctgaaacaagtaagtatttcctattggttcagtgcggaattctatgtaagtgtacttaatcgaatttgtttcttacggtgctccaattttctatggcctaattatttctctgcttgatctaacagtatctgagagagggggtttaaaaactctcactaagattatggatttgtcaacttctcctatagttaggtcaaattttgctttacatactttgaagctatgttgttagtattctgcagatttaaaattgctatatttttcttagtgaattagccctctgtcatctagcaataccattctgtatccctaatataatttttaaaaaatttcaaagtcaaaaaaaaaattttcaaagtctactcggtctgatattcatacatcaacgtatttttggttagttttgtccagtatatcttgtcccactatattactttcaacctctcagtatcctatgttttaggttttgtctcttacaaatgacacacaccttttaaaaagttttaaaaaaataatttctattacctgggccaggtgcagtggctcacgcctgtaatcccaacactttgggaggccgaggcgggcagatcacctgaggtaaggagtttgagaccagcctggccaacatggcgaaacccgtctctactaaaaatacaaaaattagctgggcatgatggtgactgtaatcccaggtactcgggaggctgaggcaggagaattgcttgaactcgggaggcggaggttgcagtgagccaagatcatgccactgcactccaccctgggtgacagagcaagactctgtctcaaaataataataataataataatttctattatctggtggatttcaacatttatactcgttgtgacaggtggagatactcaccactatactaatgaggaagactcttgtgattactaatactgtatagttggatttatttgcatcttattttgtactttatatttaccacacttttttctttatttcctaccctccccagcagccttttcctcccttcactcagatgatcagattttctttattctgcaatcgtttttaaagttatatattccagaggcctggcgcggtggctcacgcctataatcccagcactttgagaggctgagtagggcggatcatgaggtcaggagatggagaccatcctggctaacatggtgaaaccccgtatctactaaaaatacaaaaaattagccgggcgtggtggcacatgcctgtagtcccagctactcgggaggctgaggcaggagaatcgcttgaacctgagaggcagaggttgtagtgagccgagatcgcaccactgcactccagcctgggtgacagagcgagactctgtctcaaaaaaaaattaaaataaaaataaagttatatatgccacatatattaatggtaatgcttaaacacaaactcttatcttaaaagctaggataataccttcatcctccttcttaatgggataaggccctcagaatgctttcactcctg

SEQ ID NO: 6899 - DNA, 1092 bp, artificial
  synthetic oligonucleotide
gaacagcttgtcctttatctccagccacttgttcacctctcttaccttctccacctcttctgggtttctaatgtaggaaaagtgcccttgttggctcctgttgatgaaaaataaagggcaggcccctacgacctagaatggattgggcccagagcttggcccctatggtctggtaacaaacaacattaacatctcagtggcttattacaacaaacgtttgcttcttgtccatgccttgtgtccacccctggccggctgtggttctgctctgtgttatcttccctctagaaaccaggctactcaagcaacttgtatctaaagcactgactgttatgatgccattctcatatttgctataaggaaatatctgagactgggtaatttataagaaaagaggtttagttggctcatggttctgtgggctgtacaggaagcatggggcatctgcttctggggaggtctcagggagcttttattcatggtggaaggcaaaacggaagcaggcacttcacatggtgagagcagaagcaagagggagatgggggaggtgccacatacttttaaactaccaaatctcgggagaactcactattgcaaggatggcaccaaggggtgctaaaccatttctcacaaatactaaaccattcataagaaatccatctgcatgatccaatcacctcccaccaggctccacctccaaaactggggattacatttcaacatgagattttgtcagggacaaacatccaaactatatcactgcccattctgtgcacaggagaagaaagacacagcgaaccatgagggtcagttcatcatgaagataaaacaatcttagacgtgtatgaacctaacaagaggtaaaggaataaacacatagatggacagaacagaacagagtctagaaatagatccacatgaatagggcaaactgatttttgacaaagatctaaagacaatccaagaaaggacagtctttttaacagtgttgggacaagtggacatacacatgcaagaaaaagaacctcaatctcaattccacagctgtagaccagtttgaagaatactaccatctcaaccatattgagtctt

SEQ ID NO: 6900 - DNA, 1606 bp, artificial
  synthetic oligonucleotide
ataaaaggacttcattgtcctgtatggtgaataatataggcccccaaattggataacaccaatttggttcaaaattaaagggtgaccataaattaataagattgctttcctggaatggttcaaattagaaacgtatttttaagggaagtttcaaaaatattttaagcagtggcaataatgtttggataaatatccttccagtgtgactactctgaagagtacatgctttggaatgtgaagctgtggtgaggtgacttttaaaaaacatatcagtttatgatgatgtcttgtgtataaatatgtacaaaatggataaagtacgtgtgaaagaaatgtaactaattatacaaattgacactttggggttagaaatgtggatgcagccaggtgcggtggctcaggcctgcaattccagcactttgggaggctgaggtgggcggatcacttgaggccaggagttcgaaaccagcctggccaacacggtaaaaccctgtctctactaaaaatacaaaattagctgcgcgtggtggcagtcgcctgtaatcccagctactcgggaggctgaggcaggacaatcacttgaaaccgggaggcggaggttgcagtgagctgagatcgcgccactgcaccccagcctgggtgacagagtgagactccatctcaaaaaaaaaagaaatgtggttgctttcattttctatttggtgtgattttggatgttgtcattgttttatgtgggaatctccaaactcaaacagaaagaccaatgtgaggttgagataatctaagtacctccccaaaatattctatagcagaaatagaggagaggcctacacccaaacagttctgcacacacagctacttctctgtgggtttttcagttcaaggagaaggtggctgagcagccgagatacagctgtcagtcactattacctgctccagctcgtaggccttggccttgtcctcatcgcggtctgcattcttacggtaggccatgcccaggccccacacggccaggatactgtagatgttatcccgcacccaggcatccttctgctcatggctggctgacagcagccccgtgacgggattctattagagaagagacacaaaatggctcagtgccatccttcatgcagtccctgggtaacagatgcttgtcctaacagggtagatgaggaccgggacctggagcagggagaccaaagttccagtccttgctctgcccctaacagtgtgatcttgggtgagacatcacatgccttctcagcaccttagtttcctcacttgtataatgaggatatgtgactagaaaatctctcagaaacattccagctcttatgttcttttgctttcagacgagaccacactgttgtaagtggtaaaacagaagaaacagcaaacaggaaaagactgcaaggctttcacaaagctgcatattgcagaccttaggtcttcttcagtcttcatgtgtccgcactaataggtaaagcattgaacctgtgagcaagaaacctggaggcagggccccactccgctctctagctgtgtgtgcccagggaagccactttccctctctgggcaatccagatacttcatgtgcctaaac

SEQ ID NO: 6901 - DNA, 611 bp, artificial
  synthetic oligonucleotide
atattgttcattaaattattgttattagttataatagttctagcccacaagaacagtatatacataagaaatgttaaagcctttgattgttttcatacatgacacattagctactggaagagaatttatgttattcttttttatgttgctaaaaaccagcagaaggattatgatttgacgttgactaatacttcatattgagtagttttaactaagaatcggtttagggaactggtcctttttcatatctttgtcactgaacttttaggcaatgatggtcatcagatctatggaagggacggtagaccaagcttctcttttttttaaagaatgaaaacaatattttaattttgttcttaagtaacaagactgagtcttcataactggaagggatggaactgatttgctgtgtcagttagccgatgggaaagggagagatgacagcatgggtggaggcagtgattgggaaaataaaatgatttttgctttattgctcacagagttggggttactaaataaatcggttataagtatataaataatactgtaggtatcgtgtagcatagttacattttaatatgcagtaaaagtgtaatggttaagagtttgag

SEQ ID NO: 6902 - DNA, 1321 bp, artificial
  synthetic oligonucleotide
tcattctcccttcacaggtaggttctccaataaggagctactgaacagctggtggagtataaatgtcttatgacccagtggctgctccctcaaacccacacctttctagaaccaaggaaaaatgtttagtttttccacttctcttaattgtaccaggttaatgtaacgttttctaaaaattatcctcagtttacctaaagagtgcttttctgctcttatttactgaaattctcttttctattttgtattgatggcagattatgcacacaatagcgtggtcctgcccatgcggagcctggtccctttggaagcagtcacgtggccgctgactttgcagcccattacttgagtgcatctccaggccaggaacagagcagggctggggcagagagctgtgctcacggccagtgcattgtctcccagattcgtggctctgggcttgccttcccggctgaaaggcaaagcagcctggccctgttctagttatttctttgtgtatatatgtttgtttatttatttaagcaagagctctctctgcagagtggggtgtgtgtgtgtgtgtgtgtgtgtgtgtgtgtgtgtgtgtgtttgtgtggggtgcttcagagagggctgaaattgtacctcttttctttcagccctctgcatttccccagagagaaggtttttttctcgtcttcatttcctttgaaacacctggggtgaggaaaaacctctacattggccaagcagaagaaacaggtaatatgtttgtttattcttaggcatttggggcaagcagaagtctacatcataaacatatatcgtgtggcaatggaacagggaatgtgtactccttggagtatatcttactgctttgcaatttctcggaatgattgttctcaaaaatgctggttgtaaatcagttgccatcagttgaagaagacgtacagatgacttggcaatctgaaggattgtggcctatttcaaatgaacttgatatttggaaaatctccacagtcacttggattgagagccagaaaatgagggaaggggtcctttgagaaacccttctaggtcccctcagggagtattctccaaactccactgcacaccttcatatttagaaatcttcctttagttcccttggcgtcttgtcgtcttagaggtttctagctatctgtaagaatggaaccagaattccttacagtgttcaaaattctctttagtgatttagttcgtatgcgaactgatcagattggatcctgaaaccaaggcatagccttttagtgggcagacatttttgttctttaatgattaaacagagcgagtcttcagttct

SEQ ID NO: 6903 - DNA, 2714 bp, artificial
  synthetic oligonucleotide
ttgatagcttctaaaattttttcaagttatttttaagaaccaccattggcagggcgaggtggctcacgcctgtaatcccagaacttcaggaagccaaggcaggaggatcacttgaggccaggaattcgagaacagcctggccaacatggtgaaaccccatctctactaaaaatacaaaaattatgaaaaatacaaaaattagtgggcatggtgatgcacgcctgtaatcccagctactcaggggctgaggcacaagaattgcttgaacccaggaggcagaggctgtagtgagccaagatcacaccaccgcactccagcctgggcaacagacagagcaagactctcaaaaaaaacaaaggccagattcggtggctcatgcctgtaatcccagcacttggagaggcagcagaagtggatggattacctgaggtcaggagtttgagaccagcctggccaacatggtaaaaccccatctctactaaaaatacaaaaattagccaggctcggtggcgcacgcctgtagtcccagctacttgggaggctgaggcaggagaatcacttgaacctgggaggcagaggttgcagtgagctgagatcgtgccactctactccagcctgggtgacaaaacgagactccatctcggaaaaaaaaaaaaaaaaaattagctgggtgtggcggtacatgcctgtagtcccagcaactgggaaggctgaggcaggagaattgcttgaagccaggaggcagaggttgcaatgagccgagattgcacctgcactccagcctgggtaacagagcaagactccgtatcaaaaaaagaactaccacaaactctttttataaatggtaaccaaagcctaaggtacttagagtctaaaaaatgtacttaccactaaattataccagtatttatataatggtataaattatgccattttaatctaagataaacgccagtggtttcttttatctatttccccaagacaaagagatcctgaatattaagccccaaagccagggaagggtataaactcttccttcaaaattaccaacacggccgggcgtggtggctcacacctgtaatcccagcactttgggaggccaaggcaggaggatcacctgaggtcaggagttttgagaccagcctggccaactaggtgaaaccccgtctctactaaaaatgcaaaaattagctgggcatggtggcacacccctgtaatcctaactactcaggaggctgaggtgggaaaattgcttgaacgcaggaagcagaagctgcagtgggctgagatcacgccactgcactacagcctgggcaacacagcgagagcccatctcaaaaaaaaaaaaacatcaccaacatttgccattttcaaaatgtccaggtttttagttcctggaatcaacaatcagttcaaattctaaggtattatgtagtaattctcagacattaataatggttctaaaattattagggatgcttgatttgcccactgcaaactacaaaacaccttctggcaatgacagactaatctttgcaccacagctcatagctctaaggctgatagctggcagagcccactttgttcttgtatatcctaaaaatcaggaatatgactatgaggagacagtgagacctaccctccccaccccgagagggtagctaatagagaggacctccgatttccattcacaagtggaatgagaatagagggagaaaaatggcagacagaataaccaggcaaaaaaaaaaaaaagactagaggtgactaataaggcaaacagcagaggatactgctgtatccacccgtgttccagttactagagttacaaaagtcattgctattaaccccaaaagaaaggcagtaaaatagtcaagtgaaacttttctctcgcacccccaagagctcaaactaaaattgggatttggctcttccttaaatggaacaagtggctacatcaagttaattcaaaagacttggtatttactcagccttttcaaggcactttaccatcattaattatttctcagtgaagcagcaaaggattaccctgaccatttcactgatgcggaaacagacaccaacagcaaagggaacaggggcaggaagaggggtgataggaagcatctgggaggaacaggcaggcagctaaaaaggaacaagcccaaaagaaaataagagtcacatctggcttatagctgaggatcataacccttatttgttatttctgagctcagagatttctgcaacattttgaaaaaacaaagtgctttaaaataccagttaaaacttaattacagcttaaactacttagtaatagaaattgcttagtattaaaaaatacccaatcttcagagcacatattgatttccatttataccagcaactcatttttcccctcaagcttaaccagtatgttatctatttgaaccagaaaataatctcatgaaaatatatagctttatataatcctaaccaaaaaatcacaaagttaacatcacgtaagtcagaaatagtttgcagctacactcagaattttgtttggagaattatgacaaaaatactgacttctcgagttcgccctttgaatgaaaggaatacttgttctacattcgtattgatttttttagctataactccctgaaattttcaggaataaactatgggtggaaagccttaaacaccctgaaattagcacacgtagtgggctctga

SEQ ID NO: 6904 - DNA, 3839 bp, artificial
  synthetic oligonucleotide
cattttttcagtcgaagttccataaaaatttatgtcacgtgaccttgagactgtgcatctgacaccaaaccttagctaagagcaaactgtttttcaagtatctggagccaggctcccaataaatatcgaattgagttttgacttgtcattaaactttaaaatgatcaggcttctctcatgggtatacatgcttcgtcttctgcaaagaacaaactggaagcacggggtgcatagtagaggatgcaggaaatgaaaggatccaatggtaaaccaagaacacgccctctccctactgcaaagggagactatgttagtgggctgtcgaactgaacagctgatttaaagggatacgaaaggctttaaagcaaactcagaccagattttcccagagcacacatggttaatcttcactcagggatagaaactggggcaaggtagacaggaggatctgcctcgcctttgaagtgctgcagagcccagtatattacagtcagaagcaagcaccccttccttcaggtgctgattggagtttattagctgtgatttttatgagatactgaaagaagctgaaatactgctgcgcagccacagaaatgtgtagtgtgggagccaagagtcattaccagttgctgagaagttgacaatggagtcttcctgaaagattcttgcagtctgtgtcaaacattaacatagaagcctttgtttttcttttctaactaaaaagctctgcccatataagtcaggaattattgcctgagatattgtacattatccttcccgagcaggttcacagcttccaaaataccatcaggaaaagatgccatctaaggaggcaggttttaggggcatattttctgtccactgtggaaagaagggagtaggagtttcatgacaaagaagattcattttgtcccatatgccgtggactgaatatctaataagggaaatcaaccacttacagtcttggaagtttggagcccatgaatcgattttgcatctattcccctttctcaacaagggcatttgtatcacaggtcacatgacaaagtaggtctttggatttcattcctaaacactattaggaatgacctgcagagagtgaacaatgatcatatcataccctttgacacaaacctaaaattcacttcctcaggaaaggaaggtgtgggctttggagtataacagacccagatttgaatgctgtctctgcctcacactgactatactatagcaatagttctcaagtgtggtggggccatgtcaatcagttagttatagctgcattacaaaccactccaaagctcagtggcttacaacaatcatttactagcactcagacatctgcagagggactgggatgcaactcttctaggtgggtctgcctcaggctgcaatgactggggaggtgggcttgccactgcagatctatgagtcatctgaggtggctctgttccacatctgtcacttcctttaaccaacaggctagccaggatggattctccacagatcattggcagaggagcgagagaacgcgtggaaacctgtggggcctcataaggcttagactcagagctgactcacatcactcctgttggcattccattggccatgagaagccacacgtggctaagcccaaggttaagaggccttcagaagaactacaaagtcacatgataaaagatgcagatacaggggaagatgaagacttggggccaagaaaggaagataggaatcttccctgaaggccaatcttccacttattactctcctttttttcagaattatcttatttttactcatttacttttccacataaaattttaaattattgtattaaattatcaataatgtctcatgggaattttgattgggattgtgttgaagatatcaattaatctgggtagaatcattattactgtttgtaatattaagtctttccatccaagaatatcctatgtcttcatgattcattcaagtgtgattttatatccacagtaaaattgtgtggtttaattcaaataggtcttatattttatgaataagaatatttccaggtatggaccaagtgactttacgctcctttctggccatagaaattagtttctcgccattgagtttttaatatgaccactactcagtgtttaaaactcattgtctctcataaccattctagatgatgaaacttaggtttgttctctttgagatgtacacaaacaaataagctttctttattcaattgactactatctacttaacacgaaccaacaatcaccccatattaaaaatagggatgatgtgaaattttagtttaataataccttatttatagaacttagagtttacaaagcactttccatatagtatctaatatgtttctcattacaaccctacaaatgagaccaagtggctaaatatctcagtttttcaggtagaggcagtgaggtgcagaggaattaaatgatccccccggggtctccaagacagtgataaagagcttgctgttttggcttatagtcctattcttatccctttactcctagccttcattgaattcctccttgccctttaatccttggcagctgactctcccactttgaggacctctcagaatctaggataaaacccaacccttagagcaggcctgcactttcggtgtacatgtagaattgtgtggctctgaagcaattcttgctgcgtgtctgaaaaggagacaatgagttccaagggaaagaacttagactttggagccagacagacctgttttgaaatcctcctagtctacttgctacttagaagctttgagaccttgggcaaattgcattagcatttgaaccacagtttctttatttttaaaatggaatgaaaatacctaccttgcaagaatataataagaaaagagtttatataaataaagcacccaccaggcaaggggcatttagcaattgttgtaatgtggcacagtaaccgagtccatatacacatgggtattacccaggaatctcagtggcgggtttttttcagggtttttttttttttttaagatgaattttccctctgtcattcaggctggagtgcagttgcacaatcacagctcactgcagccttgacttcccaggctcaagtgatgctcccacctcagcctcctgagtagctgggactatacacatgaaccaccacacctggctaattttttaaaattttttgtagaggcaggatcttgccatgttgcctaggctggtctcaaaaccctgggctcaagtgatcctctcacttcagcctcccaaagtgctgggattacaggtgtaagccactgtgcttggcctgtttttttcttctttaaaagatttgcaccttataggccctaaagaaagaaatctggactgtctcagatggtatggggaaaaaatggatttgcaatgaaatatactaatcaggactctgaaaagtttgccagcttttccaaattcatttgacttcagttcattcttttcctgtccaaaaatttcatataaaacaaaatatatatatgcattttgcagacattaccatgtaatgacagaatcttacaattctctccaatgcttgactgtcttagataatgtgatatgctccacagagaataggagagcccatagggacaatcgcaccaccatgagtggaagtctggacagaaacagttgggggtttcattgatgtttgcctcaagtcacctagtgagtatgccgctacaaaacctgttcttgtaaagcatgtacccccgacccacctcatctccacaatgcctttctctttgcctgtgtctacccagaaaaaaaccaggccagcaatctaactggctg

SEQ ID NO: 6905 - DNA, 1269 bp, artificial
  synthetic oligonucleotide
ttggagataaatcagagcagacagctatcagtggtgggaaactggaacaacaacaacaaaaaacaagaaatgtttctggggcaacaccattttccgtctgtgtattcttcctagactaatctctcccttagttgcccagtttgagtaataatatgtccttggtgctgagcaaagcaggttgatttcatctattctgctttctgtgttcctcttgtggggagggcaagactgtaaaatgatggtggggatagtaaatttttgttatttattggcaggactttctatgccctttactaaaagctctcattgggagaagccagcagcaaggaggaaagtatttctttagcatagttgtcatttttcagtgaatggaatgtagttaaaaaggtcataaatgctgcctctacctattcacagagtagtatcatcacaagtgccaatatttcatattgaagttaaaatcaattaattctttaaaatttcctgtttttgagtaagtggttacaatggggctacctttcaggattatattaattggagtatctgcaatctttagaggctcatttaaaaattaccaccctgaggatcaaagtggtggcatgtgcttcccaaattattgaaagctggtttcatgtctggctgtaaaaatacaaatcggccttttttactcagtgtcggctcagagagcagctgcttatgatataaaaaatatcacggctggctggtttacagcatctactataaatacaggaatattttattcatctgaagaaaaccatgaattggatcaagacaagttagaaaaaaaggcagaagtttagattttagtgagtgtcacaaaacatggaccaggtggaggatttgagccctgagctgcttttctggcagaaaaccctctccctctccacccgtctcccctcccctgcctcttgggattctccagagttaccatcttcccaaagaattcatcttctccaatagatattgtgtctggggacttgtggggagaataggagccgttgtgatgtgtggaataattgaaatcatggaatttccatactatcaagactactaaaagccacctgagatattatccagtagaaaccacttcatggcagaagcaccatgtcagaattccacagacaaggtgaacagccaattctaaggtcagaaaagtcactagattataagatgagccatttcatgtcaggatattagactatttgtgtattagaataaaatgcaattctctataactttcttgcattg

SEQ ID NO: 6906 - DNA, 496 bp, artificial
  synthetic oligonucleotide
tccatcattacattgccttatcctcatctattatccaatctccctctgtcttcctcttataaggacacttgtgataacatttaggccccacctgaataatccaggataattttcccatctcaaaatccttaacttaatcacctctgctgtaaagtcccttttgccatgtaaggtaacagtcacaggttctgggattcacacatggatgtctttgggggctattattcagcctaccacaaatctctaattgaaatttagcatttccttacattagaaatgtagacaacaacctatagtaggagtacctggaactttgtcaccaatagaaatcacagacaataaatgttcatttgaattgaaaaaaaaagagaaatcacagatattttccatattatattacagtttttgcagatatctcaaatttatgtaagtcattatacctaccaccagatcttgttaatgcattactaaaactgtacatatagtgctgtttcaa

SEQ ID NO: 6907 - DNA, 1149 bp, artificial
  synthetic oligonucleotide
tcatggtatcaaacatagagcaaaatggttctaattgagaacatacttggcatacgattggattaaaatgactgagaattataaatgttggaaatgtctatttcaggcatgagtaggggaaatggcactaatttctagagtatgcacataatgattaaattagcctacagagatgaagagtatatcagccttcaccctggagaagaaataccatatgaataagaaaagagccaatcaattctttagtgggcagcaatcaccatgagaaagtcctttcccactatcacatgtttccatatctagcccatttttctacaattccattagcctcccctgtcgtatccaccaaactaaataaaatgctgtctacaagcctgttccttagtcaattgctctgtttggtcatatttagacccttttaaaggagtcccagtagatgcattgggcttatattggtatagtggaaaatgccaacttttgactttgactttgacctttgactttggccttaacctctggctccatggataccaacatttatatcttctcctcagcctcaattgtttctggaagaagttggtgaaccataaaaatctggatgtataaaaagactcagatgcacacacacaatctacatgcacacacatgtacatgctttttgctgctctttctcccttcgatcctgactcctgggctcttgtgtctgcctacttcaatgtatatgtggttggagaatattctaagatgaaaggaaacattctgaatggcagcaggattggggtgtgggtgttagaataaagggacagtcactgttagtggggactctgcccctatctgctgtgcattaacctttccaaaatatactaacagtgtcctactgcaagcagtgtctgcaactctctgcctgagcgtttcctgtttgcccaagaactgagttatctagaggggccatggaataaacacccatgagagcagccctcattcaatatgggacgggcatgagaggtaaatacacgagcttcttcgcctcctgattaagtaggacaggactccaaggcatactctattgcatctcccagagtcccctcgtgggactgagccccagttgctcacagagacaatctgctccataatgtactcttccctgcc

SEQ ID NO: 6908 - DNA, 2920 bp, artificial
  synthetic oligonucleotide
ttggaaaactgtcttttcatttgttcctcagatgaacaggttttcctgggcaaaacatcaccactggaggtcttggctttttttcatcataaaggaaccccctcgggtggctgaatggtcccctgggctggtgccaaagtagtcactacccccaagttccagtctgacttggttcatagtgcctgggctgccctggggatgcctctagtgggcatctgtcaggacgagaagcgagtgcccatttgaaggagactgtgtgtatgtgggggtgtgggggcaggtggcttctctgggcttgtaagaggcagagaaactgggatgccaccatcttacaattctctgccttccagcccacccctggcttctcatgttcccgtttgagaagaaaactagcctccatactgtccccttccgtattgtccccctcccaccttgccacccctctactgtaacaaaggcatgtccacaccacattttcaaagttgtcacaagtctctcggtccaccaacaaccaattctgatgactccaaaggagcaagagagacatccagaaaacggtgggaaagattccctgggaaaagcacagaaaaccttgcctgatgcttgcaaggctaagaattgttttctccctgctggctgcttttctctctgttctaaagagaagcttccaagaatcagttaaataaagggatcacaccagaggatgcgagataatgctaaaccaacaaaaacaaagacccaaatgaaacagacagagccatgagaatacgcggttatcaaaactttgtttggccatatctatttatcatcgctgcacacccgggctctgcggaatatcattctgttgatgtcacttatcctcagcaaaatatttacacatccttaaaaacgccagatgaggggggccggcccgcgcactgccgcaagccgcccctcaaaccccatcgctgggttctgaacagcccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccatccgtcgtgccccaaacctactccaaggacttctgatagggaaacacaaagcagcagctgtttggcaacatttctacccctcgccagcaactgtggtgggatgccatttccccacccaggcggagcttatcctgaacaatagtcgggctttaaatggcaaacaagcaaacacacagagcacaaccccaaccccgaaaaagccaccgcggagagaagcaataactccctccgcagcaaaaggcgccactgaaacgcacgcaaaaatgcagcgagaacgttgctcggtgcctaacatggcagaaagcccgagctggtgcggccaccccggggctgggcattggggggcaccggggctcccggggcgccgacgcacactcacccggctccgggggggatgcggggctggccgcgcgtcacaaagaggagcccggcgcaatctggcaaaacccaactttccaccaggctcgccagggccgccagatacgtcaacagaatccatctttcgaagggcctggaaggcgccgggttttccgggccggggcagaacggcagatccggagactgcccggtgcggtgcctgggcgcggagtccgccgtgcaccgccctctgcgcccgatgccagtgcgggcggcggcccgaaacccacttcggggcccccgccccgccggccggcgccgcctccccggcagtccccggccccgccggccagtgcgcggcgccgggaacgggagcggggccccggcgcgccacacgggcggcggcctcggcccgcgtccccgcccccgcccggccctcccagccggccccggcctccgggcgccgtcctgcccccgggagcaggcccctccccgggcgccgggccccgccaggcgcgcccagcccggcgcgccccctgcgtcccggtggcagctccgcgcggggagggcgggggtgaccccggcccgcacgggggcgccgcggccactacctcgcaatcgcggccgccgcctccaggaagccgcggggtggtcgagtgtgctggaactctccggtctggcctcgccgccggccgcctgaagggggtgcgccgcggtgggagccgccgtcgccgctgtcaccgagtcgctgtcgccgccgccgctgctggttgtgcgtgagcgtgtgtgcgcctgtgtcctggcgagtgtgtgtctgcgtgcggcgcccggcctttactatatacaccaaggggtgggaggaggcggggaaggggagggcttgggggaggcggcggaggagggggagcaggaggggggcgaaagggtacccgaggaggcggcggcggaggagggacaggtgatctcgcccacggggagggcgtggccgtgggcggcgcggggtgccaggaagaaggggtgtcggggcggggaggaggaccttggggggagcgccgggggagggccggaggagctgggaccctactgcctcccggcgggctggggaccattccagaccccaggatggagaagagcgaggaacagagcccagaagggaggaagtggctggctgatggaagcgggggaggtgggaagggctc

SEQ ID NO: 6909 - DNA, 994 bp, artificial
  synthetic oligonucleotide
aggatcttagaacaaatggccccatattgatattttcacattcaataattttatatttggtctagagggctagtgattctttttttcataaaaggaaattgcatccagagctaattgctcaatctgaaatggatctggacattgtttagatgttggaaaggaaacggtaacattgtagagctttcacaaagaggggagcattattttagaacaaaatttaaatggaaattaataggaaatgtaactctgtatggttttcaaagctttgatgtgcatagtcgaaagagtatccctattctgtgctttccttgacatttttcttgtttataaaatgcaataggaaattcatcggcacaggctcaatccattcccatccattgattgctagccaatcaatgaccattgtaatctgaaaaaaagtaacactggtttctatgaccctttccaagcacagcactgtttagctaagcttaataaagagaaaaacagcaaggaccatctggaaaacactcttccggagtctcgaaagatagtggcagcctctgcccaacctgctataaataagtgtctcagaaacaaaacaaaacaaaaaaaacacccgattttcaaatctgtttctacttaatacagctgcaatagggtttatttagcttttccctatagaaggaagactgtttgcatttttatgacaagttcctaaatgtttttcacagccatttccattgccattattttgaggaacaacataccactcagatctgtctgtttgcttctgcacacacagcggtggccccagtggcctctgcaccacgaaactggcctccaacgcccagatttatgatcctatttcctctcccagtgttgcaaccatcacctgaatcctggcctgcaacggactggcaacttagaatgtccaagtgtcacgtgctacaaatcaattatttatccgcctgagcccagcacactgtggatccctaccagcttgttgcctctc

SEQ ID NO: 6910 - DNA, 1695 bp, artificial
  synthetic oligonucleotide
gtcactacagagctgcccccagggcatggctttccatgggccctgtgattggacggtggcctctggataagggactgtccctgggtggggacacctgaaagtcccatcctcatctagcgtctatttgctgcaagcaaggaagggaaccctggcccgtgtgcacctcctactcatgggccctgggcgcttgcgttagctcatcaatccccatgagaaaggcagctgagttgtgcggttttactgatgaggaatccaaagcagggtgaggtctaagaacacatgccactttgattccaggcccaattttgccttcaggcttctttctcccagcctgtgtcactttttctcctattctaacgagttcattttcttgctgatagccaagcgatcaacccttttctcaggccaatgggaaggaaatcaaaatgacatttacattagttcaaatattggtcagtagtctggaagcaggcatgaaagtgcctggctggaaacccactttcatggaacaaagtgaaatctaaaactctgcttactggaattaaagtctttttaaaatctagaattgtggtgaccttgctccctattattatctgtaaacaagatataatacaaatacatttatttatcattatttatatcatttatatcccttgctcatgcttactgtgtgctcatttattgagtaccctgtccttggtaccccagtgcacaaacccagatacttgaagatattttattatttccatttcacagttgagaaaatggaagcagagaagttaagtgacctgcccaaagtcatacagctagaaaggagcaaagctgggaattcaatccagactttgtggctctaacactggcactcttaacttttactcagggtctccagccatccccctgcttaggtgtagtgacaggcactcattctacttctgatgcagaaacctcttgtgcttggttatttctcatatttcaagaaagaagaatgcatggatctctaagagaatttaaaggttgtgttcagccagttgaaagatgtataatagtctcatttcattatgacccggtgggatacataagataatgaattggggcgtagaaagaaaatattgaacctatttatgtttgtttcatttttgtccaacatttctatttttgcacttattttataatgtacatatttgtttggtagtccatgcatgtcatttataaagaaatccacaaactctggggaggtgaatgctcaagcattttctttgtatgccagtgatgagatgttgactattgcttgctttatgttttatgtatatttttataagagtgtagaaaccacttttgaagaatccatcttgttttgaaaacatagtaagccatacggtttaaaggaatcaagtagttcatcttcttttgcaaagtcaattatagattccagatatttgtttcgtatgtttgggtttccatatattgtactggtttggctaagaagggcacacttgcactttccacataggttcagtgcagtccacacacatttattgagggtcccctacatgtcaagcactgtgttaggtgtatgagatacaatgacaatgaccttggccctagaggagtgtgtgacacagtgggatagacagagtcatactttcaattgaatgagatggatgagttgatatacagatgtgtgcatatgttgct

SEQ ID NO: 6911 - DNA, 3374 bp, artificial
  synthetic oligonucleotide
ctctgtcttccgggggacttccaccagattctctgtcgttgccagcagctggcagccctccaaggaggctagtggagaacagctaacccagactgacttgggttctaggtgatacttcatgtgaccacaatcattaattcacagtaatgccaattaggaaatattctttatttcacacacaggcaaaccccaagatttcttatgaccttggcaagtggagtgtttcacaattgtgaattctggagaagttacaggcctggtggatatagtattgcccacacatgcaaatctgcccagcgcctaaacatccctagttgaaaataggcaacccagtcagaaaagagtcaagttttccctaaataggtttcaaagacatattaccaaaaacaacatcccacaagtcatctttggataatttcattcactgggtttcttcttgttatgtatggtattaggatatatcccataagtgttgtctttgaagtggccctaaatggctctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacctgtcccctggggtcaccatctgtgcgcatgagtggggcagcctgacccactggccattccagggacagtgagccaaagctggacttgctcagggcatgctaggccaggaatgtgtgggcagtgaaagagcaacacccttcctcacccccctgcggggaagactcagcaggccccgccatgatggtgcacagtgttttgccatactgtggtatgctctggagttttggagctcttgttttatgaggcttttattttacagtttcttgcctcttggtgaccagtttgtttttcacagctgcttgtgagcaaggcaaagataacgagcatctaaaaatagccctgcagttggaggtacagcttggcttgaccccgctattagaggggtggggtctccgttaccagctccctgagggtgggccaaacttgggcccccagacagcctcagaccaggtccacacatccttcagagcaattcaccttcaggtctcaaggcaaggcagggatgctgagtgctggtccatgtgagaagggcagcagctctgagaagcctcatccattcccgggtgaggcccaaagccactgggctgcaaggctggaggatgggagcctggacaggggtccctcttttgcccccagcc

SEQ ID NO: 6912 - DNA, 1799 bp, artificial
  synthetic oligonucleotide
ttatttttttacacaaaagacatcatgggtaagaagaggagattttattttgaagaacaatgaccacattaacaaggtgacaacagataagctaaaagtcactccattttctgccagggaaaaatgtcctttgctgccaaatcacattctgcttctctttgtctactctccttttataggagggtggcaggcccagccactgatggactcagaagaaatatctgggagataagatacacccttgattcatatgagaaaagaagcttttgagttcaatgataaaaaataacttcctttcctgttccacaacattcttgtggctggagccctctgtaggacaacgacatttctctccccttggtccaacatatcacgctgaaaataactatgaatttggaaacttggtaaagggcaaaaatccaatttcttgcatttaatagatatctaggcttagattagattctgtaggtatagaatctgccctacatcctgctctatatttggggcaaagctgagaacctctctatctttaaagtgtcacagctgcatttagagacccaacccattcagcattctgtgaaagaacagtagaaccaaatatccatgtgtgattatattcccaagtgtgtctatttaaaaaaaaaaaaagaaaagaaaaaaacaaacttcaaaatgattggagaaagaaaaactggatgtgggatggaggaggtgacaagggaaagggaaggaagcttctaaggaagtgagatttgagctaggctttgatgaattggtagaaatgtattagccagagaaacattttagggtatatctttttgttgttgttgttgttgttgttggagtcttgctctgtcactgaggctggagtgcaatggcacaatatcggctcactgcaacctccgcctcctgggttcaagcgattctcctgcctcagcttcccgagtagctaggattacaggcgcaggccaccaggcctggctaatttttttgtatttttggtagagaaggagtttcaccatgttagccaggatggtctcgatctcctgacctcgtgatccgccctcctcggcttcccaaagtgctgggattacaggcgtgagccgccacgctcgacctagggtatatctttctaagttttggtttcttctataaaatctcataggcttgttgtgaagatttaatggcataattaaaatagtgcacatggcacactgcttgggacataaggactgaataagtggttgtagttgttgtcattgctactgttattatcattgcaattaggaggtggtattggaagtatgtgaaaagaaccttcgtagggacatgatgctattaccacaggtaattaaacccctttttcctgacccctttttctctgatcttatcccgttctttctgagactgtcatcttttatattttggcatactttggttaatattagttcgcttctggcaagatgaaagcagacccaaccaagtatcaaaagattttttttaaccccgctccatttcccaatataacatcttatacactgatttacaatttcagtagtgggtggatattcgagtgaagatgtaaatataaaaccaatagcttatgctataatttctccaggggtctttgtttttagcaacttattttagcaatttcaaaaaatattcactccggttattttgattttcttctaatctgtttatcttccagtgatttcattcaagtcacaaaggaaaggtgtttctggaaataagcaatgaaacatttcttttttaagtttagtagttaatatggcagt

SEQ ID NO: 6913 - DNA, 1581 bp, artificial
  synthetic oligonucleotide
agtgatttcccaataagtggtgtgagaggctcccctcttcatttagctccaatggcgagaatgttttacattgcacatattggcagctccgttgtcctcataaaaagaagcatgatagaaagtaaaagctgagacttaatggccaatttaagcttgagataactctgctatggtagatctaaagaggctcccaggttacctacgtagcaccagtctcaaccttatgtgcactaattcaaacttcaggggacacacattttgcatttctacaaactaagcgagtattaggaaaaataaacactcaccagttctttttatgctatcacattctatgttgcacataagaaaaaaatatgctttctagagagttgtaaacattctgcacacaacatccattatgttatagctggcaatggggtccaaatggaataatctgcagactaaaccctttctttatccccagagctgaggctgaggtcagtaggacagtgtgggtgaaacagcttctgaggtgccctccgactctgaaatgtgctgacctggagttttgccagttggcccaggttggataatagactgttagatggcctacatctaagggatgataaaatagcagcccagaccttgatccctgctcctgccaggttctaaagcatcagctctgggtggtgggggtggggttccggatggactgcttttcaattttcccaagccccagaaaagcagtcggctgttacagaccaggattgctttagcctgaaggagaggagaaatgcaacttactgcctttccgatcgtaggtttgtgctgggttgtattgagcaaaaacatggcagcgttttggattctgaacatcagtggcaatttgaaggctgtagagctttctatagggctgagaggatcctggccactgacagccttcctgttgagcagacacatggctggctaaagactttggtggattccagtggtgatcatggcatgcaagccttcctcccctagctgggactaatatatcacagggcacaacttggcttctaagaatcagcatattaggcagcaaaacgtgatttcactgcaggaactaaacggagatggtcctgaagcatgtgtttccccagcacctagtgtgacatctgtctgcatgtagtaggtgctcagtaaatggtagttgagtgaatgaacagatgctcattttatgtatcctacaaggaaaagacaacaattcctcctgttgtttcttttaataatgagagttggccagaaatggaatggagtgatttttaagatttaacattacaacctcaaagtatacaagctgtagctagatagtaaaaataacagtagctattggtcactcattgctgtataacaaataactctaaaattcagtggcaagtatctattgtcatgttttcagttttgcagatcagccatggtgacgctgcttcaagctgcaggtctgtgcattgattagctaatgtacgctgggcttggttctcatcttcaggtttggttccagtctgttccacgtggctttcttgcttctgggacagtgggctctccagggcatgttcttct

SEQ ID NO: 6914 - DNA, 1231 bp, artificial
  synthetic oligonucleotide
aacagagaaaggaaacaaagccatgggatttctagacatgacatgtaattcttatactcttctcaccttccataccctctgctggtttttcccatcatgctatttgccagtgttaaaaaaaaatgaggaatgagctcaccatgtcatctaaaataaaaaaagaaaagttccttgccatcgatcacagtttgtaaagtactttaaaatctttctcttggagcttgagatgtgagcctttggcagcttcagtcatatatgaggggcctgaaagaaggtgtctcgcagtgtggaagttgctgtttccattcactctcagctcatcatttaaagatattgggagagagctttttttttttttcttactgagaacaccaaaaccgatgatcaccacaggaagacttagttactatcacagctcagcctcaccaaaaattctttttcatttttttaaatgtttatttatttacttacttacttactgagacagggtcttgctctgtcacccaggctggagtgcagtgacatgatcatggctcactgcagcctcgaccttctgggctcaaagtctcctcccacctcagcctcccaaatagctgggactacaggcacatgtcaccatgcccagctaatttaaaaaaattttttgtagagacagggtcccggtatgttgcccaagctggcctcaaacttctggactcaagcaatcctcttgctttggcctcccaaagtgctgggattacaggtgtgaaccacctcgcctggccttaatacattttttaaattgaagcataacatacacatagaaaactgtaccaaaattaacagtatagcttggtgagttttaccaacgaatattataagcaccccagaagcccttcctgtctctgtccacctgccctgcccccaggatagccactcttatgacttctaaccccatagattaattttcttgttttgaactttatataaatggaatcatacagtatgtgcccttttatacctggtctcttttgttccacattatgtttgtgagagtcaaccatgtcatggtgtatagtagtggttcattcatccatattccattccatggtgtgaatagaccacaatgtattgatccagtctgctctctatgggcatttggatattttccagtttggggctattactagcagtgcttctgtgaacattcttgggtgtgacttttggaaaacatgcgtttgtatttctgttg

SEQ ID NO: 6915 - DNA, 2497 bp, artificial
  synthetic oligonucleotide
tttccctgtaagaacccaaaggtcttgtacagagctggaattcggcgaaaaacttgctccaacacgccaaatctgccgcatcctcaataccccaccctcttccctctgcgcttactgcccacacccctactcccaacttgaggactccccgcccccaccacgctgacagtctcaattccaaccccttggatgtgaggaagtgtctttgcgcctgaacgcgcccagcacggcgaggccaccagtgactcccagcggccgcacagggcgctgcgcccccctcgccccggcctcccccgccctgcgtccgccccgtcacccccgcgcggcctcctgcgcccgggctggaggcagattcctctctccgggttttcagagcgcctttccgaaacctcctccccgcccagccagggagagagatcccgggcgcaatcgctccccggagcggccgaggggcgcgcggggagaggcctgcgccggggtactttcaaactgaggcgcgcgcacacactcacacccacccacccactcacccacacacacacagacacacgcacgcccatttatataggcggcggcgacggcagtggccggggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcgtgagtacccgcgccgtccgcccgccaggctatgggtttctgcgccgcaccctcgcgccctccccagcagcggcaatcccagccccgcggcgccgctccggttgcagcttgcaccttactactctcgccttcccacccttcccatcccctgggacccaccccaatcctcctggggctgagtggctgggctggaccccgattcagtgatgcagacgtggacggtggaaagttaaaagggcgacctctgaagtcgcaggcagcgtgggctgagaaggagcagaaagggagcgtttatggggagcacaggaggcagagagggtctgtccttcaccaccggggctcgcctttcacgtccttcacggggcgtagggaggagggttgcaactcctgtggtttccagaagcccagccctgagccctgtagcccacaccatgcatgttcagggttgggggttccaggagtagtgagtgttcttttgagactgctgcagcaccgcggctgtttcgtcactcgctgtgacctcaggtgctgccccgagctccgaacttgtgccttgccctcgtgtgcgacgtagcgtggcgctgctcgcctcctagactgaacttcgtagtgcttctgccgaaaacccttgtggcccggaggggccgcggggagggtcagggagagatgagggtgggagtgtcaggggccccggggagatggaggagacccctgggcatcttttctgctctgaacagcccagggttcctactaaatggctctgtgccatctgcccgcagaggatcccacagactatcttcctcctccccggtgcactgtcgcccaaatttactggcacgtggacttaggtatgaactagtctgctaggcgggctgcagggaaacgacgaggaaggaagtctgggagacccctgggcgtctttgctgtccgttgacttcgcttttacgacacccaagggctcccaataaatagtcattctatgtcatctcccttccaagggcgg

SEQ ID NO: 6916 - DNA, 1890 bp, artificial
  synthetic oligonucleotide
taagaaggaggagacaagaaaccatacaggagtagaagtgccaggatccaactttgtcactctctcctccactatgatctccacatggccggaggataggacttagctgctgggagaaattccctccagaccaagtgacccagtagaatttgggcatggtatttgcaccatcttcagatctgctgctgctttcattcacatccaggaacatttgtaaattgtggattgcctcctggaccactagtaaaagtccagggttgaggaggtcctgtgttatcattgatcatcttttttccaaagttgaattttagcttgtcttaatttggggatccacagaagaccctgacacaaggattcaagtgcaaatagtttattcatgggtgatcccaggaaagactggtagagggggtggtggggaagagagaagaaaaggaaggaagccaataaaggatacactatcaagcaaatttcaaagtagaaactctgggatccaatgcctcagagttatcccactgaaaggcaagagagcttgggcatttatccatcatctcccaatggccactgattgagggatgctggagagtagggtacaggagcactttgggcctactgtatgcaagagaagagaaagccctcaggtggagaaatgcaggtttggtcactcaggccgacatgcagggaaatagcaattaatgtgagatacaggtgcagcctctacaatctgcgacatgatttatttttacttttaagcaggcaatatagaccaaagcttcttagagtacagcccatccgtgtcccagtagggctgacccactggcacagagaagataatgaattactgccaaatgcaaaaacaaaagaacctttaatgaacaatgcagcctttggtcaaaacatcttaaatagttgagagtgaggatgaagcctttggtattaaaggcctctgaattgaaagagtggggaaaaagtgttctggctttcacaccaaagaagacatcaaaaaatttattttaaccacttgccagaggatacatcggctgcttgtggattctggaatttttgaaagagaattatcaaaactttctgctgagtctgatgaagccaagctggggcacctgtgggccaggaataagtatatatatgtatttatttatattatatagatgcatatatatatatatatatatatatatatatatatatatatatatgttagttgcatctgtgccattgtttatctgtttgcaaaacatgccatatgttgacagccagacatatgttcagctatatggaagatcagtcaaagagaaagaagagctgaagcagcaaaaaaagagaggtagaaggaaatatatgaaagagaggaaaacaaactcttgtgactttggctagatggtgaattccttgagcataagggatatgtttgggtcatccttaatcctcattgcctacagttgtgctgggtacatgagcgatgtttagtgtaccctgaggatgaaaagaggtagcatgtgtagggtggttagacccatgtctcctacatacataatgcatgacaagtgtaaattgaattaatgaaggagaagctgtttagagctaaaaagactcttgaaatttctttatatcagtctctttcttttacacataaaacttaattttggaggtgtactgtggcaggttgggactgattctgatcccattctgtatccttttcatcattacatggaaggaatataagaagaaaaaattgaataaaactttaaaatgtagccagtcagggatcattttgtagtgcagtccctgagctgcctgtggtatctgcaggaagattttgcctgtctttgaccgtttgctgttccatgcacattcttaaatctgcttatcaagttt

SEQ ID NO: 6917 - DNA, 2814 bp, artificial
  synthetic oligonucleotide
tttcttgctatatctttgaggttctacctgggatcattttcaaggcaaggatgtctattctcatcactgtttttcagcgttgtgctagaaattccaaccagtgcaataaggcaagaaaaggaaataaaaggcatacagagcagaaaggaaaaaaaaaatgaaactggccaggtacagctgctcatactttgagaggcgagctaggaggattgcttgagcccaggagttccagaccagcttgggcaatgtagggcgacccccatctctacaaaagtaaaaataaaaaaaaaattagcagggtgttatggtgcatgtctgtggtctcagctacttgggaggctgaggtgggaggatcacttgggccttggaggtgaagtgagccatggtgactgtatcactgcattctagcctgggcaacagagtgacaccgcctgtctcagaaaacaaaacaaaaacctgtctctatttgcagatgacatgattgtctacatagaagaccctgagaaatctacagtctacagaataactcctagacctaattaagtgagttcagcaaggtttcaggatataagataaacatacaaaaatgagttgtatttctacatactagccataaacaaatggacactgaaattaaaaatacaataccatttacattcactcaaaaaatacttgggtataaatctaacaaagcatgcacaggacttgtatgctgaaaactatacaatgctgatgaaagaaatcaaagtctaaatagatggggaaacataccatgttccgggtttcaggatataagataaacttacaaaaatgagttgtatttcacatactagctagaaacaaatggacactgaaattaaaaatacaataccatttacattcactcaagaaatacttgggtataaatctaacaaagcatgcacaggacttgtatgctgaaaactacaaaatgctgatgaaagaaatcaaagtctaaatagatggggaacataccatgttccaggattggaagactcaacatagtaaagatatcatttctcccccaaattgatatacaggtttaatgtaattcctgtcaaaatcttagtaagatttttttgtagatataattataaaatttatatggaaagggaaaagaactagactagctgaaacaattttgaaaaagaataataaagcaggaggaatcagtctgtaagattttaagacatataactacagtaatcaagactgtgtgatattggtggagggatacatgtatagatcaacggaacagaacaaagaacctagaaatagaccaacagaaatgtgcccaattgatctttgacaaaattgcaacagcaattgaacggagaaggaaagatagcctttttgacaaatggtgctaggtcaattaaacatcaatatgtcaaaaaaaaaaaaaaactcttgctgtaaatagtacacgttatatgaaaaataactccaaatgtatcacaaacttcaatgtaaaacataaaactataaaaataattagagaaaatcttcaggatctaaggctaggcagagttcttagacctgacaccaaaggtatgatccataaaagaattgataaattggatttcatcaaaataaaaaatacttactctgagaaagacctcataagaggatgaaaagacagactacagagtggggggaaatatttgcaaactacgtatccgacaaaggactggcatctagaatatataaataactttcaaaacttaacagtagaaaacaacccagttagaaagtggaaaaaatacaagaagggacatttcactgaagagcatatacagatgacagataagcatgtgaaaagatgttcaacataattagccactagggaaatgtaaattcagaccaaagtgagctatcactacatacctataagaatggctaaaattaaaaatagtgacagcatcaaatgatggcaaggctgtagagaaatggaatcattcatactttgctgatgggatgtaaaatgatacagcccctctgaaaaacagtttggcagtttcttaaagacactaaacatgcaactaccatatgacccagcaattgcactcctgggcatttatcccagagaagtgaagatttatgttcatataaatgccagtatgtgaatgttttataggagttttattcataatagcccataactggaaacaatacagatgttctttagtggatgaatggttagacaaactggtatatccatagcatggaatactacccagcagtaaaaaggagtgaagtactgatacatgcaatgatctggatggatctccagagaattatgccgagtgagaaaagccaatcctgagtggtttaaataccatatgattccatttatgtaacattcttgaagtgacaaaattatggagatggagaacagattagtccatgccaggggttgagggggcaagggttgggagtaaaatggatagctataaaaggcatgatgaggccaggcgtggtggctcacgcctgtaattccagcactttaagaggccgaggcgggtgaattgcttgaggtcaggagtttgagatcagcctgaccaacatggtgaaaccctgtttttactaaaaatacaaaaagtagctgggtgtagtggcaggtgcctgtaatcccagctactccagaggctgaggcaggagaatcgcttgaacctgggaggcagaggttgtagtgagctgagattgtgccactgaactccagcctgggcaacagagcaagactctgtcttaggaaaaaaaaaaaaaggcatcatgggtccttgtgagcatgaaaat

SEQ ID NO: 6918 - DNA, 1683 bp, artificial
  synthetic oligonucleotide
tggggtcagtgggaccctgtttgtacagacgtctgcgtcttccggctctttaggacataagcagtactgctatggaagaaaggaaacctaatttcccatgccttgtccctttctggaaagggcatggcgtggtgtgggcaccacacctgccccagccttctagcaagaaaacaacacaaccttccccgctccccgaaaagagcttctctccagttgggtctagatgcccccttcccaaccagggcggatggccaaaggctccgctcccttgcagggtaggcttggaaaggcacggggcccgccttcctgggcaccggagcctgtgacgggcggagggcgtgcggcgcgctgggttagttacctggcgctgggcggggcaagcgggaggcgggggcggggccggggtgacatctcaggctgtgattgggccgcgccgcgcctgtctccatgtgccgcgcagctgaggcacaacattcaagcccgggggtggggccggcgcgcgccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcgggggcggaggttgcgagtggggcgacagggctgcccccagggacccggaggcctcggccagttctgagagagaggactctgcagccggggatggcggcgacgcccttgtccccgggggacaccagcctccttcgcagctcagctcctcgcccagtgctgggtgcgctctccccatcttccttccctgagacagtctgacactctctcccctcccccggccatttctggggttctgcagccgcccagacccaaagtttgtcctgttctggaagtggtgtttgttttggctgctgcctggtttaacctctgctcgctgctcctgcccctccctctcctgagtgggttctcagggtgccttgctgggatttcaacttgaagggtgtgtgtgtccgtagggttcgaggcccagggctgaatgttgtcctctctatgtagttgtaatatataagtatctactatatgtaattgcccataacatatttctaaatattaatattaaatcgaaaaccttaatgacaagttgcagaacagggacacgggactgcaagaggacgtttgtcaagtcaaaaccaaatttcccatttgagattagaggtggacttcagaagtccaccatgggaaacagctgtagtttcccatctatcattacttggacttgaaatagaattgaaaggtaagggatgtcat

SEQ ID NO: 6919 - DNA, 918 bp, artificial
  synthetic oligonucleotide
aagaagaaacctccttgaattagaggaatatgcaggtaagaaagcctgataaggggaatgccaccttctcccaggaatgtattccctcaagaaacgcagagaaatcatccgcacttagagaagaaattaagcaatgtagcttaaaatttaagagacaataaatcttactgcataacatctagggacatctttgaaaaaaaagcagacagtaactgtgcttttgtatcactacagacagatgctgagcaatgtaatcatgtaatagccagggacagactatgtgaatgaatggatcattgctctgaatcactttatccaaaaaatcctctatgccaatatgaggagaaagtaaaaagtttttattttgatgatgttctatcagttagataaaattatctttaaaataatgctgttgattgctttaaaccaaattctgacattatataatattaatctcaagctttgttgttcctctcagaacccttcaggaacagtggagattcgtggatatgtttccaaggggtatctaagatcaaaatcttctggggaattttccttaataactgcttgcagtccgcttttaaaaactgcaaggttttatagcagctctcatttccttttcaatccacatgaaatttgaaagccccagtgggaatctaaatccttatgatgaaagaaccttctaagtatttgatgacaataatgacaaccagaagaattaaaagtgaataagtacttaaacaaagtaaacaaatagtaatttgcttaagaaattttctgccttctcacatgctaggaagatttaagaggcttcaataccaacagcgatccacactttaattctaaatgatgggcatttccatcagaaagactcctggaaatgcgtacttactattctaattcaaaactctaggcatg

SEQ ID NO: 6920 - DNA, 921 bp, artificial
  synthetic oligonucleotide
ctgaggactgaggcaggaagacaccaaagaggagtaagacatctgcaccccaaccacccatgctgcctcctggaggaagcagccacgtttccgcagtgaaataaacacacagaatctttctgatatcaagataatcatggctgggtgtggtggctcacgcctgtaatcccaacactttggaaggcgaggcgagatcacctgaggtcgggagttcaagaccagcctgaccaacatggagaaaccccatctctactaaaaatacaaaattagccgggcgtggtggcacatgcctgtaatcccagccactcaggagcctgaggcaggagaatcacttgaacctgggaggcggaggttgcggtgagctgagatcccaccattgcactccagcctgggcaacaagagtgaaactccatctcaaaaaaacaaacaaacaaacaaaccatgtagcagtaaagggaattggttaaactttcctacaacactatcttgcttctagagaaaaatctatatgatctgtaattctgcagggaagccctgttgtcctctgacctaatttaaaccattattaaattacttcttctcaactgatgttgaaaacagaaaagacctcgctgaatggccatgtcttaacattgatttttacaccaacaactcctgactctggggccaacctcccagcctgcattttcagggaggttctgggtaaacatcaacgaacaaacacaaccctacacagtgacactgaaactatctgtcaggcttgctttagctcaatattctaggtgacattaggcaaaagaacaacaatgattcagctccagtaattaaaaacaattgcaatcttcagataatgggacattttaattctgttatggtaactttctggttttacaacatttaaatcatttttacaccatccag

SEQ ID NO: 6921 - DNA, 1351 bp, artificial
  synthetic oligonucleotide
ctattagcagatttttaaattgctttaattctttgctttgattgttttggtgacagattctcaagtcatacttgaaggaacgtttgttgaggacattgtgggacattggagtatagtgacatgttatatattgtccaaaaccgagtggttttaaaagtttttaatattttttatactacacattgttcagcttacaaatggagacatttgtatcaattatctgggatgcccaaagggaacattttgttagatgatgctatgatctggatatggtttgtctgtccccacaaaatctcatgttgaaatttagcccccagtttggtggtattgggaggtagtgcctcgtgggaggcgtttgggtcacgaggtagatccctcatgtatagattaatgccctctcttgggactgagtgatttctcactccattagttcctgaaagacctggttgttaaaagagcctggcacctttcccctctctctctctcttgcttcctctctcaccatgtggtctctgcacatgctggctcctctttgccttttgccaagaatggaagcttcctgaagccctcaacagatggagatgctcaatcatgaactttccaaccagcagaattgtgagctagtaaacgtttttttctttctaaattgcctagcctcaggtattccttgatagtaatacaaaatgaactaagggagatgagaatgttacactaaagcacaaagcagaaatatacttccatccacagtttcaagggtacacagactatcacttttatatttttttgtactttaacttaatttctgactccaaatacccattccaacaggctaatggattactaagcctctgtacttcctgtggtgccccaccttctcctcaacattgtatcaggcttcttatgtcttgggacaaaatgttgattggaggcaggggtgaggagggcttagaatgaccatctgattttcagtcatggcccatgaaggcttctgctgagtcatcctctatctctaacaacatctccactgggacaaggacatagtttgctactttcaactgtaaaatgcaccattgagccaatcagctttgggggcttgccagcagaacatccaggaagttatcccaagatccttaggttcaccttcttgttccatttctcaggggaaattaatttctagtctgggagagaagaaaacctctcttccctctgctttttcaaaactctgaaaatggctgaaaacacacaaaaactactttttaccttctttgataacccacgaggatatcctcagaatatcatggagaccctacaaacttagtcttttggataaagtcagaaaagggattacttc

SEQ ID NO: 6922 - DNA, 1252 bp, artificial
  synthetic oligonucleotide
cttccagctttcctgcatatttgctttactttttattacatttaatttttaatacatcgtcaatttatttttgttgtagggagtgagaaatgaattaattgtattttcccccaaacaggagctttgttgttctagtatcatttattgaacaatccatattctctccactgatataaaatattacccttatgatttactaaattcctaaatcatttgactctgtttctatattatattttgttgcattgatctatctttctattaagtttcagaatcgaactattttcattgcagtcactttataatgctttaatttctgatggtagggaaaatggatatttttaaggtattgaatctttccattaaaaaaatagatacttctttaagttgattccaagtttttgtgctctggagttttaaatttttctccatatagattatgaaactataagtaagtttcaaaaatatttttcaagaaatggataatggggttcaggacataccactccaaaatatggcaccttggcttattgaatattttgatttgaaggaatttgagaaaatggcagaaatagaaagggctttctgactctttcctgcctttctccattacagcaggtcataaaacctaggaaggattttctgaccttcccctgaagcaggtcataagactctcagatgagatatgcctgcattatgcacagaggaaaggagcatccttatctctgaagacacagaaaagaatttgaacaaacaggccttgcttggtttcccccaatttataatatttatcgcactctctccaccctttgttgtatcatatttcttcatgactcttaattcttcatcaaatctactataaaaacactcgggtttaactctttcttcaggtatttatttccttatgaaggctcctgtgtcacatcaaacttatattaaataaatttctatgcttttctcttaatctttttattttttatttatttatttattttgttacaggggccccagcaatgaacctaagatgggtagaaggaaaggtattttcctcctctatgtgatataactcccaatccactaaaattaattttgagccagaggcagcaaaataaataaataaataaataaattagcctatgtaactttatccttgatcataaatgataaaaataaatatttgtcttgtgtaatttcttatggaaataaaatgcttctttatttgacatgattagcaaatgtgtgctactttatc

SEQ ID NO: 6923 - DNA, 631 bp, artificial
  synthetic oligonucleotide
cttgagaatgaaagagatgaattaactcatccttggtaaatggataatatgtggggacagggcctttgccccaagtctttggatcccaagtgccctcctggtttcaccacctcttgctgctctcctccccacaggaccaccatcaggatcaccaccaccactgggcattttattccctgtcaagtggtgaaggcgttcttacccagaaataacttctccttctgtatctaatttgcaacgaatgctcagaattgtaaaaatgaaagtaatttattcacgaggtaaagcgagttttctgttgaaattatttatgctttctgtttctatttctagcttgagcaatttcggaccctgcttttcacttccgaaggggagaaagagaaaagaatggtggacaacttccgcccccttcagccactgatgaatcgcactgttcgttcatccttccggcatgattatgtgctgaatgtacaagcgaaacccaagccggccaccagccaagcaaccccctaaaacattcatatctaggcagtattttgcttttgctttaatatatactagcttactataaattgttaactagactattctaagtgcctgcatttgataatatttacagatgtgcatttct

SEQ ID NO: 6924 - DNA, 2234 bp, artificial
  synthetic oligonucleotide
ttggataaatgtgctgagagaaatttgcattttattgcacacaaaagaaaactggacacaataatataggatataaaattaagtcaagagttggcctttaacaattgtttgtagcttgttatgtagttaaatcttgatgttatttggtcttgtccttatacgtgcattgacttcatgaaaatcaaatttataatcacttgtatataattcagtgtaatccatttaagacagttcacatggagggtccattggagatttggcctttcacccacattcctccactgcacaaataactcttccctgaattgttggatgtgccattttagtgatcaagggaggacccctggaacacaactaccgattgaagcagttccattttcactggggggccatcgatgcctggggttctgagcacaccgtggacagcaaatgcttcccagcagaggtatgttgagaaggtcaggaacagtgacaactgtagagaagtggggataattctgaacttttagttgtaagacattattagaatcaggtgattcctataaatgctaaatagctttctcaggcagttttgatcattctcagctaagacatgtaaaaatgttaacttctctcatctcaaataatatagttgaaatgaaccttaagatcctgaaactgaattcttctggaattcgaaagtggactcaaatagtagcccaaagtaataacccagggaacattgtggagccacaggttgaattaatgcaagtttgcggtggtgggagcctaaatgaaggctgtggcaatagaaatagagaaaaagggcaagatttatcaagcatttctgaaattaaagcaacaggacttgaaggtagggttctcttcaggataggagaaggcaaggttaaccacgactttgtggtgtctcacttgggaggctgggtgataatgcactcataactgatgaatgaggaatgatttgtagggaaataaagggagattttaaggaaatagaatttcttcttacaacttttttcctaattcaattgtaaatgttatgtaaaaaaagcccatttaaaaatttattttatattttttatatttgtttcattttattttgctttgtgagacagggtctcactctgtcacccaggctggagtgcagtggcacaatcacggttcactgcagcctcgaccttaagcaatcctcccacctcaagacaacaggcgcacatcaccatgccctgctaatttttttttttttttttttttttttgggacagagttttgctctgtcgcccaggctggagtgcagtggcgtgatcttggctcactgcaagctctgcctcccgggttcacaccattctcctgtctcagccccccaagtagctgggactacaagcgcccaccactgcgcccagctaattttttgtatttttagtagagatggagtttcaccgtgttagccaggatggtctcgatctcctgaccttgtgatccacccacctcggcctcccaaagtgctgggattacaggcgtgagccaccgcgcccggcctgccctgctaatttttaaatttttttgtagagacaaggtttcactatgtcgtccaggctggtctcatactgctggattcaagtgattctcccaccttgacctcccaaaatgctgagattacaggtgtgagccaccacacccagcctaaaagcacattttaaatggttattccttgaagaagaaatttgtctttaactcctgcataatttccatatggaggatctatttctctcaatataaacatcttctctcctgtagatgcaagtggatttcgaatattggtatttcattcaaatcaagatgggactggacaaatgttgattgctcactgaagtgtcactttgttatatgaattttctatttttctccccaaataaatccctttattctaaaataatattaattgctgctcttgcctaaatttcttcctgatctttgtttctatctcattttggattgtcatatggttttcttggtggctttactttgggtgaggaaacatgtttaaatgtcataggttgactgaggctgtgggtttattctggagagattctgtatagtcacgtgttaaccctcttttcatggtgtttcagctgcacttagtgcattggaacgcagtcagatttgaaaactttgaggatgcagcactggaagaaaatggtttggctgtgataggagtatttttaaaggtaaaa

SEQ ID NO: 6925 - DNA, 1315 bp, artificial
  synthetic oligonucleotide
atgtttccttaggtaaattataaagtttataagaattaaaaatagttagaaaaattatcaaatgccataattaattcatttccacaagtattaattgagtacctacaattgcctagcactatgggacaatacagagacatgcaaagtagattcctttcatagaaataattcaaaatcctgctggagcaaactaaatctatacacacaaaataatcagagaataattcaactgaaaaataagtaagttggacagctattgaataatagctattgaactctgaataagacccttgggtgggggtaggggggagggatagcattaggagatatacctaatgtaaatgatgagttaatcggtgcagcacaccaacatggcacgtgtatacctatgtaacaaacctgcatgttgtgcacatgtaccctagaacttaaagtattaaaaaaagaccctgttctaaatgttgtgggaatattcaggacagatacatttccatctcttctatactgaggtttacaaataaaataatacaaatgaaagtgtctcttaaaggcaacgataaattcataagcaaagttcaataagagaacaggggtgatgggggcttgtgcaggtctagggaccacagatatttgttgtggaggaggtaagacttgaacagagctctgtaggattagataaaccacaagagggaaatctgggggaaagggcattctagacaagagaaaagattgcagtgaaaattctaccattcttggaacagtcttttgggaagaacgatggaaatgtaagctgtcttcagatcagggaaagcctttaaacccatgtttatctgtataaaattgacagcccttgaggagggagggtgtgtgtgtgtgtgtgtgtgtgtgtgtgtgtgtgtgtgtgaaattaccagatctgtgtcttggagaaatgactatgatggcagaatgtggagtgaattggaggggacaacactgaagttaggatgacctgttaggagtttgctgtaacagtctaagtgaaaatgaattacactctgaattgagaaagtggcaacagaaagatagggatggatttgacaggtggagttgaaaaagaaatctaaaggatttggcaacagttggagagagaaaattctaacatgattctcactaggagcagaagaatgtagtgacttgaagattgcaagagtggttctgcaagagaaggctacagactggagaggccaaagtgcaccacagaaggctgtagagagggggtgagatttggattaggtcttgcagttgggaaaaaccctgatatgttaatgggcag

SEQ ID NO: 6926 - DNA, 1022 bp, artificial
  synthetic oligonucleotide
atttttctagcacaaaacctttaacacctaaaaggtatacatctgctctgacaacgtggaatactctgcttctactgctttagagagaagtcagtcagtcctactccgccaagcagtacgataagactcaaataagaatgtgttttttcaaaaatctggcattatgcagtattcttgaggaaacaatcaggcggatcaaaattgagagataatcacataacaatgggactggactcttcaaaaatgccaatggcatgaaagtcaaaagcggggacgggaagctttctagattaaaagagaataaagagacttggtaactacgttcgatgcatgatcctcaaagagatcctgaatggtggaacatgacagaaaatatatcattaatgccacaagtgtgagaacttaaatctggatatacaggatagttgtgcatcagtgtcaaacctcctgtgtgtgattactacaccacagttccacaggagaatctctgtgttcttaggagatgcacactgaactgctctgtgctgaaccatatgggagcaagaggccaaaagggaaatgtatgcctttatgcatattttgcaccaagtataaaaagttaatgtaagctgcgcagtcaaaacacaagtatgtataaagcctgcgttgcccaatctgtttgcatggcattgtcactcctcaaaaacccagcagccacatatcccagaaccagaggctgattggaaacactattctcattgcacaataatgcagggacataaacaacaagagcctgtcttgcaggctattttggctatcatgggctttttgccttaacattgacttttcaaaacagtgcactaaaatatgcacatcaatgactttttttgccctcttaaattttttgcctcactcacctaatcctgattctagccctggtgaaggatcatgatgcccacaacttacaaatcgttcatttttttaatatatggatatgtgttaatcatatatgagtttacatatatgggtgtgtgtgcacatgt

SEQ ID NO: 6927 - DNA, 565 bp, artificial
  synthetic oligonucleotide
agaagtgatatataaaagctgcagtgatcatttttcatgctatcaaaatagggtaaatttctaattttatctgagaagtagcctaacttcttttagctagaattagtgttataatctatttataatagactgctgctaccaaaaatggcttaagatagtggcttaggatagtatgaaatttttctttagaaattattttcttataggaggacttcttactctagataggtctatgaaattggattttttaaagcacatttattctcactcagctctatctgaaatttagcatttccttcagttcagaatgtagacaacaaaccacagtagtaatagtattatgtagggttatctccaatagaaattacagatattttctattgtattacaattgctgtagacatctaaaatatctcaaaatctatactcatcctatttagacgttatggtagttactagaatcaccactaggtcttctatttaatgaattaatttaaaagtccctatgttattatgtcacacatttgttttaatattttgataggtttcttctgtattgtatttt

SEQ ID NO: 6928 - DNA, 1106 bp, artificial
  synthetic oligonucleotide
gttcatgtgtggagggtgttattggcatgtagtcggtataggcccaagttgctgctaaacatctaacaatgcacaggacaacccctcacagaacaaagaattatccagcccaaaatgtcaacaggttctctacttgagaagctcttacaacctctgtcaacctttaacacagtttacgcttttgcacagttcaatgtcctaaaatgtgctctcctaacaattatgtaacattttagcctgcagacaacttcagtgcaactaaagttcccatcataagttattcattctggaaataaaggcatggatactatcaggttataaaggcaaatcaggccccaaacctaaagtaaccagcaaaatcagcaatccacagcccatttttgactgtttctaaaattctttattttaaaaaacaaacaagccaacctaaataaacaagccaattttcttcttgtaatttcatttcctgttctcagaatttcaagtttctaagagttagtgtcatctgatctcactttcggcttgattttgttttcctgtgaaaggatatgtcatatcagccctcttgagtttctaaatgagagaatctaatattctgacatatgacatagcaaaaactacgcctccagatgaaatctaaatctgaataatcagaaagaggctacgctggaaagggttatgtcttttcagttctcatacagaaagataccctttattcttatccacctcattttcacaatgagttacacttggaagaaaatggcatcctctcagttactgacagcgatagctttctaaacccagtctaatggccctcctttgcttggcctggtgtcaccaaggactgttggctcactccaaaatcaatcctcttggctactctcttattttcattatgaagaacccttcaacccctctctgggatgatatccaggagccactttgcctaaacaaagtcattgattttaatggaacaaatgagagggtcaatttgtattgtatggcaccctgacaaagatggaaaaatgctaggactcatttctcccaaattctatccctaattataataacaactctgcaaacaaagagatctttcaaaaaagtaa

SEQ ID NO: 6929 - DNA, 1728 bp, artificial
  synthetic oligonucleotide
tccatttcttgcagggcctgtactgcacagggaaacactggagctcagatgctgaagtgcactctggagccaaccacatttcatagagtctgattgcatatgcaaacagaaccatttattttgtgccaaaaacaagcactttccatgtgtgcactcagattcctcataggcccccatgtgtaggtactattatcattcctattttacagatgaggaaactaaactttaagaaagaaatgtatggaaggtcacatggtaagtggcacagtgagtatttgaacgcagatcatattactccaaagtccacgtggtctggagttcagctgcctattagtgaactcttattgatctgtgatgagataagaagcttgtgccaccatgtaaatcaactatgtcagtaagcacattatttaattcatctaactttttttgatatgaagatcttcttgataaggtaagcagtgcactgatttacattctgatgcaagcttcttatcttgtcatgaatcagcactttgcatagtattataagactcctagaaaaacagcatcttacattactgtagagcttttcttctttcatatttatggaagaagagtattaaagtgcacttgtcttgagacagaagtaactcagaggacctcagctgccactgtagggagtctgttccaaatttccatacctgctagtcttgtttatttttcttcctgcctctgaaggaaatacacattttagagggaattgccagccttaaaattggcctggggagtttttttgtaatggtattattggccaagctcctgaatactttatcactatgatccaccttcctggctgcttcagtgcccaggacaacagaggtggtctggaccagctctccctctctgttggcacctgctagcatccattcctatactcaggaggttaatttttcctttcctcacatgattttctgccctcaattaagaagacatatttctaaacctacacctactctgtgatccagtaattccaagagaaatgagtgtaaatgcccaggaaagacacttataagaaggtttataacaactttattaataatagccccaaacaggaaacaacccaaatgtccattaactggagaatggatatataaatggtggtattttaaacacattcgtacaatggactaatatatagcaattataaagaacaaattactgatacgtacacaacatggatgaatctcacagacataattgatgcaagaagccatacacagaatacatattttatgattctgtttatataaagttaaagaataggcaaactggtctgtagtgatagaagttagaacagtggttacttttgggatgtgtatgtatggtgggtacagattggtaggaaccaaaaagccttctggagggctagaaatgttctgtatcttgacccgaaaacttcgatgaaaagaaacctttttaaaaaagtacccatggagaataaatatttaaaggatttttgagttcagttaaactcaaaatgtacacatcaattgattcagcaattctgcttctagaaatttctcctaaatagccatgattgtgcacaaagatacaacatcaacatattcgcagagccctgtttataattggaaaaaattggaaataacctaaattttccacaatagggacttggttaaggtaattatgatatggtcatataatgaactactagaaagaaatacaagt

SEQ ID NO: 6930 - DNA, 3235 bp, artificial
  synthetic oligonucleotide
atctcactccctgtcatcattagactactcacaggttaaatatatatattcattcaaaagatgtttattgagcacctactatgcttaaacatggaaagctgtgaatatagtagagaatgagagggacaaagaagtagaaaatgaggttgaaaaataggtaatttcaagatttatttgcaagccagtataaaggattttattttattctaagtgattggaatccactagttagtttcaatatagcaaataggctattgagtggatagttgtggtgtcaagagtagcagcagataagttaggaggctattgtagaactataggtggaaatgttgatggcttagattatggtattggtcatgagaatgaaggaaagtggttaggttcaggattctttcatttgttccacaaaaatttatttacttcttactatgtgccaggcactgtgtaaatccttagaatacgttgcttcacaggacagaaaaaaatgcagccttttgatgaaacttacattctagtggttatgctttggaggtaaaaccaataggtcatgctgatgcattttatgtgaagagatgagaagatgaattgaatatgactcacagatttttggcttaagcaactgggtaagtagtgttaccatttattaagatggggactattgtgacaagcgcagatttggagtggaacttgagtcacatttttatgctcttaagttcagatgcccatgagacatctcgatagagttggcaagtaattagatagaaatatatgttcaagaaagggataaaatctggaaatgtatatttggcagtgaccagcaaacagatactgttttaaatccacaaaactaagtgagattacacattgagataacagaaacaaaaaaaaaagctctgagaatggagcattccatcatttagaaagcctatctagagtggattgggcagaaaaaggaacaaaggaaatggtgacaaaccttagatatcacttgcaattgcctttactgtgcaggggaacatagaagatggtatggaataaaatgtgtgctcatggggggatatattttttccaaaatggaagataaaagaatgcatttggcaaaggaaaagggaggtattcacattgcagtgaaaggagggcataatttcaagaacaaatgtcttaagaaggtgagaaaaaataaaattcaaagcaaagggtcagggttggcattacatggagacaactatttcacccattttaataatgacttaaattattgccagttcatagatggagatactgaagcacaaagaggttaaatagcttgctcattctcatgagccaagaagtggtgtagtgggtctgaagtgagatactgtgttcccagagtctgtgtgcttcaccattgtacaaacaaaatgggagaatgactatggttgctagccaattggtatgtccaattatgataggatgtaggagctcctaactaatagctcctatcatgtccatgaattctgaggctatcagctaagagtatggtggaaaaaagaaacataggtttgaggaagaaggatcaagtattaaatagtagtttgggagggtaaaaaagccattcctccaagaagagtaatggggcagaatgctgaggcagaggcagtgggagtgcccatatgagaactgtggttatgactttaaagtgtgaacaatcaggaggtatgtgtttccccccagcaagcttccaggatcagattcaggtactgagataacaggtacttcggtttaactacaattgaagttttgccaaatgagcaggaaagtgagtggaagacaaagagaagacaatagaggagttgaaagaagagaatgtagaagggaagaaggaaggaagaaagaaaccaagaaaggagaagaagggagggagagtgggagggagggagaatgggatggagggagagtgcgagggagggagggagggagggacggaagtgaagttaagggaggttgcatggcagtagttgcagtgatgaaccagaaattctaaggtggatagagaggggaaaacacggaagagacactgtattcaagagagagaaagagagagactcaaaattaagatttcacaggaagtaaagacaaagataaggttatgatcataaataagcatgtgtgactaaggttgggttgagaaaaaattattgacagcaaggcagtccaggaattggaaggccgaggatggggtctattatccatatgaatattgaagatcccccaataaagatgacattagtatgagtgttgggttgacagggaaatggatgctaaagtcatcaactaataaaggagtacaactaataaagggtaacagcacagataggtaacagcagtgataaggaaaatcagtagtgaagtctaatgacctgagcttcagagacgccaaaggatctgggtttgaggaaggaggaaaaagatatggtttgggcattgcagtggggagcaaaaaggataccttagattaaaagatgttttagagatgccagttggcagttacaatccctgctatgtttattgagaaatgcaagtttgcatgtttgacatggagatgttcttaagtttgtgtatggctattcagaacataatgttttattaccaaagttaagtcttggggggagttgaagagcaaatcaaatcatgcttaagctttgtggtcaagtttcctaattatcaccgatggttgaattttgaaaaaataggcaagaaatatttccaattatttgtcccttaggaaaggcagcatttttcagctttttaaaaaagtctgaaccatggttagaaaaaaaaaaatgataacaagagctaacatttattgagggcttactatatgccaggtactcttctagatactttacatatagtaattcatttaatcaccactacaactgtgtgagtaatgcaatcatacagcccagtttacctgggaaagtcttgatttaggcctatttttccaataccttgtgtgatttagaatttgtcctggattactcattttaaacaaaatgttttttattaatagttgcattaaaataagtggaaacgggtttggttgacctccactttatagacctggattctgtcatagggtgatcctccggtataggggtatgcatgtgcagtgaacgagttctcaccttaacacatggtgaaatcgaaaaaataataataatcactactatccaggcatcttttcttcatatgt

SEQ ID NO: 6931 - DNA, 1256 bp, artificial
  synthetic oligonucleotide
taagtcttcttccctacctctcatcaggatacatggatttttactgcttactctaaaaaacatggagtttaaaaatgttaagcagatataaaatgattttctaaaagttgatcattaaaacacttcattgttctgaattagttgacaactatgaaatgattgttcaatgcaaaaattctaggtaagccaaaaaactaccaagttacagattcatatgacaaataatattcaagcccaggtagtattgtgttgcatacattaaagcttaataggaatattttagtttctgattatcacaggactactgaactaatcatcttcaataattaataaaacattggtgcgaggaaaacaaaatctaaacacaccataattactatagggaaatctttgatgcaatattacaatatataataaataacaattttgaaagctttttaaaactgtgttttaatcacgtttgcctccattaagctgctaagttaattaaataggcaaaccaacttgagacaaggaaattgattttctacataggacactctcaacagagtagcagacataagaaaacgatcaatttttcttcatggtgtgcaaattaagttctgttcagaaaaaaaaaaacaaaatccctgtttccttgttctcttctgctcttttgttctttagtgacaggttaatcaaataaatatggcaggaagggaaaatacatctgaatattccctgtacctttcactttcgggaagtctctagtgtcagagagagcttccaaccactccttccagcctcctctctaacaaagcctgggcacccaggctttctacccattgagaaattctagcagcaatctatttaccatggaccaaaaaaaatgtaacttgtgcattgcaatttttaattataatagacagtctattcctttgtcttccctttcatcacaatttcccccatctccacacctttcccaggtgcacaagggtcttactttcatttgcatcccaaaagagaaatcaggaggatccacatttgcctgtatttataaggctagagaaagcttaactgtggcatcccaagcttgaactctctgacatgggattttattgttttaaggacttcatcaatgtccacttataatctggaataagtgaatggagggatctttgctttgatgcataaaaatcaaaagaatatccctttgtgaattctgatgctgaaaatgtgttcttgtttggagggtagaaaaggggaattttcctatg

SEQ ID NO: 6932 - DNA, 6600 bp, artificial
  synthetic oligonucleotide
cctgcagcacacagtccttatggagacatttaattagtgcattttgcatgagtgcctatagacacaggagggacactgtgccatctagcacttttagggtcaattgatggctgaagagaaggccaacctgcaaaatcatgataaattgtttgagattagggacttcatattacttccatttttaatacacttcatgcctagaatagggcctggaacacagtaggcattcaatcaaatatttgttgaatgaaaaaaatgaatttcaaggtcaccaattatagaatacctctagaaacatggttttgtcattggtttggtccaggatacctggttctgctaaatggtagaaccaggattcaaacacaaagctgtctaactccagagttcatgctcatcctactacagcctgctgcagagatgacaccagaaacaaatgtcatgcttttcacattagagtggccctaggatatctaatctaggccacccactccccagatttcactgaggctgtgttacccctcacttctctcactcctctctaaaaaggaatgtatagtggcacttcttaaacttactactaggaagataaagttggatgcttttactgtgggcaagaaggcttccatttctctgtcttcatctatggaatgtgttctggctttgtcttaaataacctaagctagcccttagggatacaaaagtagagattactgtaatagattgaagaataaagccaaagtgaaatttgattctaaaaattctttctagtcttatctttatcttccctgttccaacagcttcatgtattatattacccttgagcttccttcacttgaatatttgtaatacagtaacagaactaacaacagtgtttagtttaagtaaacatgataacattttccaagaaaacggaccacctttcattgatcagcaaaacaaccaaaaattagatgagctctgtattgtgccctgaggcgtggaagactcagactttgttatattgaggaagaaaaggactttcagactcataaactcagagttccttgatttgacatcaataatctaatgtagtggcttcataaagtggggcttagggcttaaagtgttgtaaaagttgaggccaagagaaaaatagggatgaaggcgtaggttaaaatggaaagaaattaacgaaggctggaaaggaagagaaacaaatcaaggaataatgaattaaaatttcaaatccagctcctaactagtgtctcttcctggattagatgctatgagaagtgtgaagaatgaatttctttgtcatcttttggatgaaatgtatcttacacctaagttaatgattatacctgagtttatagtaaagtgcaaaggcataatagagcagaaaaaatgtgtgctagaggtgattccatttagaagaggggaaagtaatgtttgctcacagctagcaaaaatagaaggtgacaaatagcaaagtgagttaaaatcagagagaagagtttaaagattatctcataggcagtggtaggcttatgtgggaaagggtcctggcaggaaacaagatggacccaatagggtaaattagagaggatttattaaagggactgtatataaaagtttgtggttaaaattaagggaagaaaactagggatggtaaaacacccagggaccaacaatagcagggagccgttactgtcctaggtctaaaagcacaggagtagaaaaccatcactgaaaactaggaagagctgtagcgatagaagagagtcatctttcaggaactgtggccttcaacagaaggacaaagccaccaccaaatttctgctgagctgggaggaagctggtgaaataaataccccaatttgtctttccttctcaactcctgctggtaccttatattggctgagctgaattgtaagccaaatgtcaatgaagcctaatttttgcagtccattaacattggcccccagaggtatagagcaggatgaaaggtggagagggaatctggagggacaaagggggaaaacagagtgctcaggagtcatgggcccttggtgatgaaaaaataccagaaacagaatagactgtaggacataactggaaagtaagagtgtaccatcctgatgcaaggagctggaactccatggtgaagggacatattcctggggaaaatgggtctattcaacaaaacagaataaaaaagtctgaagtccacagtcagattgtttttgatatcctcatggcacaaaatatgaattatggcatcattttattttaatacttaagtggcttctggagactcaagaaaatgatttgtcatccattgttcatatcccatttctcattcttattagtatcaatgctactttgtagacaagacactgagaattacattcatccctcctttataacactttggtttttttttatttatttttatttttttattattatactttaagttttagggtacatgtgcacaatgtgcaggttagttacatatgtatacatgtgccatgctggtgcactgcacccactaactcgtcatctagcattaggtatatctcccaatgctatccctccccagagtgtaaataaatagaaaagcttattttctaactatatgataaaagcctatacaactggatttgtctagtatttagcaaaaacctgatttagttttgtaatattatttggccttatctttaaggctttcaaaactctaacagaaatagttttccttaaaaggagaaagagaaatgattactcacttgtttcaatctctttagttgattatgtttttggtgtgctagtcaagaagcaaacacaattcaatattttccacagacttagtcttatatgtacattaaattatctgaagccccctttaaattttttctgactagaatacctttcctttgtatcaatagaattcttccctttattcatatttagcaatttatctaagtcatttgtcatgactgttaaacatgcttagaattactaaagttagtaacttaaaagttgaattagattttctctccagaggctcatatgataattgctcagctgaaaaataatagaatcttgttttcttcattcacatatattttgcatgtactattcatcatcactgaaaatgcatctctttttatctattttcctaaattaatgtgaaagttgaaaacaaattataatcatctctttagaattaaggaggttattacataaatagcttcatgtgattgtgataatgaaaagtatttattcaagaataacaacttacatttattggagtctttgaagtttatatagccctacaatccgtgtcattgcatccttgctacaaccaggatggtcaagaagaaaagtggtattatttcccattctactaaactggggctcagagagttaatttgtgtaagactgcatagctagtaagcagaagaggtagaactttaatatatatcttctgaatgttccaattaataccatgtgccatagccgcacaggcctgtaagaggataagtgggtttatgaaagatatacatgttttttgaaaagcactgttgatggagattccacccatttctttgctagtacagccatcaaccatttggcaagaattcctaccatttatgtattttagaattatggcccctatatggctgtccagaaaggagatggagatatgctggtttgtcatattttagaaaatgaagctgatatccctttatgattaaaaccctcagcaaaacaagcatagaagggacataccttaaggtaataaaagccatctatgacaaatccacagccatcataatactgaatggggaaaagttgaaagcatttcccctgaaaactagaacaagacaaagatgcccactttcaccacttctattcaacatagtactgaaattcctagccagagcaatcagacaagagatagaaataaagggcatccaaatcagtaaagaggaagtcaaagtgtcactgtttgctgatgatatgatcatatacctagaaaaccctgaagacttcttcaaaaaactcctagaactgaaatatgaattcagcaaagtttcaggatacaaaattaatgtacacaaatcagtaactctgctatacaccaacagtgaacaagctgagaatcaaatcagtaactcaaccctttttacagtagctgcaaaaaaaacttaggaatatacctaaccaaggaggtgaaagacctctacaaggaaaactacaaaacgctgctgaaagaaatcatagatgacacaaacaaatggaaacacatcccacgttcatgaatgggtagaatcaatattgtgaaaatgaccatactaccaaaagcaatgtacacattcaatgcaattcccataaaaataccaccatcattctcagaacagaactagaaaaaaaaatcctaaaattcatatggaaccaagaaagagcctgcatagtcaaagaaagactaagccaaaagagcagatctagaggcatcacattatgtgacttcaaactatactataaggccatagtcaccaaaacagtatggcactggtctaaaactaggcacatagaccaatgcaacagaatagagaacccagaaataaagctaaatatagccaactgatcttcaacaaagcaaataaaaacataaagtgggggaaagaacgcctgccctattcaacaaatggtgctgggataattggcaagccacatgtagaagaatgaaattggatcctcatctctcaacttatacaaaaatcaactcaagatggatcaaagacttaaatctaagacccgaaaccataaaaactctagaagataacatcagaaaaacccttctagacattggcttaggcaaagacttcatgaccaagaacccaaaagcaaatgcaacaaaaacaaagataaatagatgggacttaattaaactaaaaagcttctgcacagcaaaataatcagcagagtaaacagacaacccacagagtgagagaaaatctttgcaatgtatacatctgataaaggattaatattcagaatgcacaaggaactaaaacaaattagcataaaaaaaccgaacaatcccatcaaaaagtgggctaagaacatgaatagacaattctcaaaagaagatatacaaatggccaacaaccatatgaaaaaatgctcaacatcactaatgatcagggaaattaaaatcaaaaacacaatgcaataccaccttactcctgcaagaatggccataatcaaaaaatcaaaaaataatagatgttggcatggatgtggtgaaaagggaacccttatacactgctggtgggaatttaaactgatacaaccactatggaaaacagtgtggagattccctaaggaacaaaaagtagaattaccatttgatccagcaatccccttactgggcatctacccagaggaaaaaaaagttattatacaaaaaggatacttgcccatgcatgtttatagcagcacaatttgcagtttcaaaaatatggaagctgctcaaatgcccatcagtaaatgagtagataaattgtggtatatatatacaccatggaatactactcagcacaaaataatggcatttgcagcaacctggatggagttggagaccattattttaaatgaattaactcaggaatggaaaaccaaacatcatatgttctcactcataagtgggagctaagctatgaggatgcaaaggcttaagaataatacagtggactttggggactcgggggaaagggtgggagggggtgagggcaaaaaagactacaaattggtacagtatatactgcttgggtgacgggtgcaccaaatctcagaaatcaccactaaagaaccgatgtaaccaaacacctcctgttccccaaaaaaacctatggaaataaaaaataagtttttttaaaaaaagaaaagagaaagaaacattaaaggcacaaaaaagaaaaaggaaatggagcttaaattgctgaagacaacatttaaattgtcatttaacattctcatataaggtaaaataattccagtatcttggactctgagaacctgtttctctatttggcaacacctttttaaagtggtagagagttttggagtaggattaataccaggcaagccttgggttagggagaaaagccagagaaagaaagattctttaattctccagttaaaaatgttaattctggtcaacaattttttttagcatttgaaaacttctcaggaggccccttcaactttttactccctttatttttctctctacttgtcttcatcttccttggtttttctttctgctttattccagtgtggtgtcatagtatagttttaatcagattaatctgtgtacaatccttgcctttcctaataaaatctcattttttgccttaaaacccattaatatgctatatactgtttatatttacccatttgtatagcaatttctatgtttaccacttttttttgcatcttatactttcatcttgagagcatttttcttcttcctgaaatagtcttttactcttattttatttttcttttattcccttcctcgagttctaatggtagcaagaatttcagttttgt

SEQ ID NO: 6933 - DNA, 1306 bp, artificial
  synthetic oligonucleotide
agttgttaatcaatcctttaacaatgtaaaaatgcacactgacaacgcttcctggctctcaaaaggccccaaatatattagtacacagtgtgcatattttccacacacacacattttcacttaattattataaatatatgttcagattcaccatacaacattccctagcctacaaatattatagtcatgctctaaaagagcatttcctaagcagtttgaaattgcaatgtactaatatacagatgtccctcagtaccagtggaggattggttccaggaccctctcgggataccaaaatccaaggatgctcaagtcccttatataaaatggtatagtatttacatataacctactcacatcctccattatactttaaataatcttgagattacttataatacctgatacaatgtaaatgctatgcaaatagttatactgtattgtttagggaataatgacaagaaaaagtctatacatgttgagtccagatacaaccatgttttttatttctgaatattttcatttcatggttggttgtatccacagatgtaaaacccacatagacagaggcccaatatttattgatgacatcattcttctcccctgaaaatgtcatatgactttatatgttaaaactcacatgattttgttagttctttatttcttctcaagataaatggaggcatcctgtggtactacaaagccagggtggaaagcacaaaagaagttgcaaaaactaaatcctagggtgtattcagttagcaagaagagaatagagttgaacattaagctttgtcttatctcttggacatagtgatagggtgggaagtaccaaactctccccaggggaggcccttctgatagagaaaactagaaacctaaagacccagatctaagctaaataagaaggaagtgaacatgaccagatatcatagacaagaataggggataggggagagggtggctcaggatattttactaaatgatttgcatgccaccttggctggcctttattaaatgagtccagcagtccatatggcatttattacttctgggacatcttgaaagttccacgtggcctttgaaacataagttattagtcaataattgtatgcagtgagcttgaaccatctttggtactggaaagtgctgttcttgacctttgttccataaataaagcaggttgataagaatagaagaaaaaagtggaaatgaagagacagatgagagagaagtgggagagaaataaggtagagtactgagtggtgaggcaggagagaagcggtgaagtagaggagagtaaggg

SEQ ID NO: 6934 - DNA, 1653 bp, artificial
  synthetic oligonucleotide
aatgttaaagaatattagcgagttaaagttgccaagacctaatgctaaaggcatttatattaagcatatagaagcctagtttgaaaacaaaattagagtgaactcagaaagaaaattcttggttctttctcctttttttgaaatctgaataaagcctctgacattccctccccaaagttaagtggtcctatgttcacatggaaagtttccttttctttcttttattgtagctcatctttgttttggcatacctctgctatgtcttcaatttttatgaccttcaatagccctctatagtaggatatgcctctctccatagtctgacctgtataatttggaagcttgaggatctctaattcacccatcccagggaattccggaatacaaatcattttatcaaatgtctgagaaaggagctgaggtaaaacacaaaaaatgtccttttcaggtttcttggttaatgcctgtgtgagttgtcatggtgactggggaagggatggagatcggagaagagattagagaatatattgtcatattgggacctataaagcctttgtgaacatttgcttcttggaaattaactcaggaaattgcatcattcactgacgtggttctctgaatatcacaaggtcaataaaatctcaacattctatgaactgggatgatttcttctttttcttattccagagtcttagacttcatggctaggagaaaaagcatcctgggcatggtaacattaaaatgtaaacatttgaaatgtgcgtatttgtttattaaattgaagcctcccacttccctcttccagttgccagccgtgttttcaccaccaaaataaaacaagtaagagaagtagacacacaaagccccagtaattctcagagcaattaatcacaatctctgggggagtgagatgcaggcatcaatatcatttgaagttcctagattattccaatgtgcagacaagtttaagaaccactgttctaaacctcattcttggtaaacttgcattctgcacattacaggggcaccaagaggcaaataatcaccccattataagagggtaggggcatttagtacaaactggcaagtgtatccattaagatattttcagtttcaaagtaacagaaaatccaactcaaaccttttcacatgacaaaaaatgtttagagtctcatataaatgaaaagttcaatagtagtattctttttgtctctctatgcttccacccatggcattatcgctggtgcttctaggggagatttccataagcatctggtgctatatgctttcccttcacgttcagccccaagagagaaagctttctttccctcaactactagacaatgtctggcctatgctttgattgaatcaatataggctctcccatttacatattaaccaattactagccaactagctaggaaactcttttttactcttgacttagaggtacattacaacatatttctgaaccagttactgggacaagcaatggtttaggccaattaggattcaccactagagatgagaggcaggataattccacccacaaagcaggcaaccccataatgggataggagtaggtcctgttagaaagggagaagtatgtaatagctactgattaggcaatcaacaaatatccaggaaacaaca

SEQ ID NO: 6935 - DNA, 1068 bp, artificial
  synthetic oligonucleotide
attaaggggatttgtaaaaactagaaacattctgcaccttgaataaatttgcaagcagcttcaaattgtcaccccacttaagactaaactaaacaagaaactttagtaaaagtactaagcaaaaccatttgaactttggcagacttctgctaaaataaaaagtcatagcctcacaaggaaagaatgggtaagtgtatatacattgatgtgctgttatttaaagtagtttattaaaatgggtattatttttataattccttactttaaatgactttttcggtttaagaaccagcttccagtcctgagtgaattgaagagaaattccaccctctgacctagagcagggattagcaaacaacagcctggggatcaaatcgagcccgtcccctgtttttgtatgacccatgagcaaagaatatttttacatttctaaatatttgaaaaacaatcaaaagaatattttgagatatataaaagttatacaaaattcaaatttctatgtctatgaataaagttttattgaaatacagccacgtccattcttttaagtactgcctatggttgttttcaaaactacaatagcagagtgagtagttgtgacagagattatatgaccacaaagacaaaaatatttactgtctggtgctttacagaaaaagagtttgctgacctctgacctacagcattatggagaactttcttccctcccttctattttccttcggtttgatggtgggaggcgtttaaggtcaccttctcccctccaggtcaactggataaatattgccttcctgtgggctaggagtcacatgaggatgacatgcttttctcagcaatcaaacattttctatgtcaggaccaagtgaaaagaatcaagagtgactttttaatgcacattatttactcacaggaaagctttatttaagtatagacaactctgagttcatcttttttcttccgcttcttttcgggccaggttgcctcaaagaacacagcaattcttttgctttgtttctattctgaaagaatgatgtgggtgaatgagctggagaaaaatgattttttttt

SEQ ID NO: 6936 - DNA, 3557 bp, artificial
  synthetic oligonucleotide
accaacaaatcaatggaaactgaaagcagagtcaagaaatcaatagttataaaaaaaaaacccacacttggatttgctccattctgtttccatgacacttcatccattccattcatagacttcatcctgggacaaatttacctccagttgagaaagaagcaatggaatgaggaaaagaagaaatgataaaagataaattagagaatcataatttatggaattcaaggatcttttccttcagccaatcaataaatagcccatatttcaaatatataagacatattttgaatgtgtaaagcaggttgctaggtgctgtggagactcaaaagaaggatgtatttatgctccctaccctcactcatttttaattaaaaaaatttttttgagatagagtcttgctgtgtcacccaggctggagtgtagtggcatgattacggctcactgcagcctcgaactcctagggtcaagtgatcctcccacctcagcctcccaagtagctgggaccacaggcatacaccactacgcccagctaatttttgcatttttggtagagatgagtttttgccatgtttcccaggctggtatcgaacttctgggctcaagcaatctgcccaccttggcctctaaaagtgttgggattacagtcatgagccaccatgcctgcctggcctatttatttatttagagataagctcttactcttttgcccaggctggagggcagtggcacaattacaactcactggagcctttttttttccttcctacaaaagaattaaaaataggagtagagtggaccctctgtgcaattaaaaattaattaatttaatttcactaaattgtacattaactctgtgaatataggtgttatataaattcaggcatttctgctacccagggtgagtgctattttcttttagttctgctgtctaaaataagactccagttcaaccttagccacagtggatgtgtgggtattttattgaagagagtttatactataatttgttgagcttcaccctgctcttgaaagtatttatgcacttccagggcttgggaaaatttattacacttccaagccttctctttcttccaaaaaacaaaaaaaatacccaacaaaatttgcagtaaccacaaaacgaataagcaaacccacctcctaatcttcagaatggtggttggaagataacttgtaatgggacataatttttggtttctattgcttaattctcaagaaccttacagattccaaggatcaatgtataaaaagtcatctacactttgtaggggagaaggagtgtctttcctcactcattataaggttcatgactataggggagaaaatataatttcttatttttacccctctcttagttgagacactcctgaaaacgaaagtcacgttaacaagagaaaaaccagcagaagtttattgacacgtgctgtacccatcacttgggagaggcctctgttcaaaagtatttctctcttaaggcagtggcttaggggacttgcttaaatagtatttcaacaaacagccttaaatcctatagtgacaagacaaagaagagagcattttcaggcttccaaaaggtgggcaaatgtgggaaggtaaacttatgggaagagtcaagtttgttcctaggtcctctggcactgttatctctcagctgatgagcaagtgtaggcaggaaaagtcagggaggaggacaggaagacctttgtctttgtaaattgctctcctgtcatcaggcaggcagagggaggggcagagtgtcctctggtgttttaaccttcttcaggtcaatagtcctcagtgttttagacagaaatattttgggttccttcatggctgaaaccccaataacaaatgacagattaaaaagagaaaagcatagcaagtttactcaatataaattttacataacacaggaagcttcagaaatgaaaacccagagactaagggaaaaccatatttttgtggacagtcatgcagaagtgtgattggaggacaaaataatatgacatagtggtagtaaatttgggggaacttagcaaggcctgtttgttcagattctttttggcctctctgtgtaacatttctttcctctaggtatagggcaggacacctgtcatatgagggtcttcaggggagaaaggaaggagagggtcagagactgaccttcctagattctatggcctgtttcaggggagaatggtgggagaagatgagagagaccttcctgcttctgccattttctcaattgccaagctactgtattttggggtattgtgttctgagcctgtcagcttagattaatgtttgagaagtgaccattttgtaataatcaatgctaatcactggacaaattattgtacagtgtaattagaaatgatcatcaacactggataaattatctgaatgttcatactgttttattgcttgccatgtgcaggcatagactgtctatggaaggaaagggagtatatttggagtgaataacagtgttgtctacattaggctagatttgctggtcattgttatagaaagccatttaagcaaatgttatcacttccgtagtttgacggctacagtaatgaaaacctaaggtgtcttattgttatctgaacatattacatattagaaatgaatgtatctattgaattctgaattattcatggtagtagtgacaaggttaatgtttagaaaaattacttaatcacacatattggaataagccaaaataaagtgtttagagtcttgaaaccattccaaaatcacattttacccaataactgaaaaaatattcttccatcacactttgaaagcactgtgaataatcatgaaataacagtaccctttcaaattttggctaattttttgttggaaatgatgatgggggacaagatggtccaaaggttaggaactagagaatactttctcttctggctatatgatcctataaacatctacaaatttggtgatcagtagctcagtgaatgttaagggtaatgtacgctctcaatttattaggtatccattggttttctattaaactaaatgtatgtaatcaatttaatatgcatgattgataagacccatagaaataaaatactagttgaatcctttacagcagtggttcttagctttgaattcatattggaaacacttgaacagcttttaaaaatcccaaacccaggtcacattccagaccaattaaactagaatctcttggggatgaggcccagatatccgtacttttaaagctcactagatagttctaatatgtagccaactttgagaaatactactttatagaacatctctgcttactcttagttaagtttaagtatttcagggactctttctttaacaatcattaacagtctttttcttaaacagtctttagggactgtttctgtttctttttctttaaatggaagcaaatcattccaaaataatagtttatttgttttattttattcctatctgtttttttttgctcttgtttcattttgttttatttttgccaagttgatcaatatagcataatggca

SEQ ID NO: 6937 - DNA, 3148 bp, artificial
  synthetic oligonucleotide
gtctaccaaaggaaatcagtatgtttccttttttacatgaagggaactttctttttaatgtaaaaactaaaaccaaaaccaaggatactgccagaaccagtgaagtatgcacaaattaacataaattggcaattgaaatgtggagccaacaattgtccaaaacacaaagtacttccttaagaacaggtctctggctcgggcctttgcttcatgagaactgcacccaactccacacctgtttaaaaatgaagcccaccctacccctaaatcagtccaaagtattgtgaaagctgttctggagaaggtccccgtgtgataattccacgtacaaatccaaacgcctagcgttaaattaaaataacgatttcagaaaaagtagttgatgctttcctcaataccacacttgttcgtaactgtaacatctttggtggcaattatcaccaaagtgatcacaggctgagtagcagtcatcctctgagcctcattttgtgtatgagcctcatttaaaacggaggttgaatggtttgactgctcacatgggggacattaagagaagtaggaacctgagttacaggccactcgattctgccctttctagaaggatcttatgctagttcttgcctttttagaaagaaattttcctgttggatttggtgggccttatctcctttcatattttgatcacctagtaaattttttaaaaatgtaaaccagaaaattatttgagcttcctttgaaatgcaaaaaagtgccccctttactcctcaccaaaattttaatccgtacaaaattatcgcccccccacacacaattaatagcaaagataatgtgaaagagggggatgaatgattaggggaagcggaggagcgggcaagcaattcccaagccctcaccattaactcgcaatggttaaacccactgacgtcctcgttaggaatgctcttcacagtctttgtggcttgtggctggagtctgtcactagagaaagataacggagcaggaggagaaaaaccctttcccaagcacagctgtcacacgttttcaggagtgctgcggaatgaggctgatttccacagcactctttacgagttttcctcccaatacagagtccccacttaaagacatgttgctgacggcagcatttcagggtgttaggaagtgacaaaaagaatcctacagccgccttacaccagcctcgggccaggttggagatttcagattttaaccctccggagctgagccttttgccgttgctagtcgttcccccgttgcattggaacccgctcagcacaccgcctccacctgcacccgggccgcattttaatagttggaacaagggacaaagaggagagactcagcctccgtcccatgctgtccagagtctctcctgtcactttcctggtttcaagggtcatggtttcgaaatgagctcccggaagaccccaggcttggggaaccgggtgtttgtttcgcgcgggcttaaggagaacagaagcacggcggggcggggcggggcaggactggactgggagctcgggcgacagggagagcgtcccgggaaacaggcaagaagcgactctctactggccccttaaaataaagcactagcccgggacgcgccgtctgttctctctgcaacccctcccgggtacccagctcttaggctcccgcgagccgcacgtgcgggggtgcagcctggccgcagccggagcggggaccaccccccccacaggatacaacagggaagcgcacctgggcgttccggacacctgcgccgcgcccctcccacctccagcgtcccggcttcgtcgcagaggtggccgaggaggcgccacctgagcgggggaggggcgggaccctcggaagggcgcgccctcccggggcgggggcgcgagaccgtggccgtggcgcgcagccagcgcgctcgcttacccatggctggagactggcgggaggggtgagggctgcggggcgttcgggctccccggggacgggcagagccggtggcacaagtttgcaggtctcgcgggcacgtgcgctgaccgggcttctgcgggctgcgctgcgctgcgcggggctggccgctggctcctagctcccggccggggtgggagcgcggcgcggctccgcctgcactgggggccggccgcgcggagaggggccctgacgtcagcgccgggggctttgtgcgcccggagctagggcccgattgggggcagcgggcgcgcggagtctgcaggcaaagctcgcggcttcctctgggacccccccgggcgagcgccgagggtcgcgggaaccggaaaagccagcgagggggatgggtagagaggggagtgggcttctaggatcgcggaggcggcgatccgcgtcccagatgaaaactattatggcctggggaggttggggggagcggggggctttgaggtcttagccacacccgttgtatagataaagaaactgaggcccgggacactggaccaagggcacttagtacttagcgttgcctcaatccacagtctcagttccttttgttcagatacgagtcgttacttaattcagtggtctcaaccctggctgcagaggagaaatcagctggggagcttctggaaaccggatttcatcatggcctctgcgggtgggacccaggcatccgttctttaaaagctccccaggtgattccaatgtgcatccaaggttgcgaaacattgacataagtaacttgtcggtggctaatgacttagaaagacacaggtagcaccctccaatctagagtggtgccagatttgctggtgtccgttatcacccctcttgattcctggaagtccacccctggaaggctcttggagactttgcaggctagctccagtcaaccatttctcccgctgctcaggcctcgcgcttgagcctttaagtgaattaaatggtttaacagtgtccagggcttaaattccttctgtctccttagagaattttcctgtctccaaaggtattagaagagtcatgggacccttgcagtttttgtaggactaacgctctctgtgacatttctgagcctgatgttcccccctgatattttttgttgtgttcttttattgttctgaaaatacatcatgttatttgaacagagggttacataaacagtgacaat

SEQ ID NO: 6938 - DNA, 1555 bp, artificial
  synthetic oligonucleotide
tttttaaggaagtcaataatttaaattcatttcttactttgactatatcctgtaatttattttaaattacacattgtttcccattcactatatttttcttcctgtgtggttaggaatttaatttgatgcctgtaatttatttcagcaacgattcataggaagttaactaacctgactataattgtttcagtagaattcaattacctacatataatgaaaataattttcataacagatagatttttcccccataatagagcatacaaagttgttatgattcaattgtttttctactcagtgattatccactctcagcaatttcagatgcatttattttcacaaatgaaatgacaacaagtaatactccactgaaatcaatggaaaccgactctccatctttttattattgggttccatgatctatttcttttgattctgtcttattcatttcctctgcttattccatgtcagtgaatctgcttactcaatcttcacactttaatgcttttaatttaaaaactatcatttgtaataatttggcatttcttacatccatctaagaaaatctgcttgttttccttaaaaatccctaaatatctactaaatactcttgtgaattttggtatctggtagcatgctgtgatgaaaactatcagactgaaaaaacacaaatgctttccttttttaaggacatggattaattttgtctaaagtagaaacaaagtcattgtgattaagtttaaagaaagagctctctttgtaggagttagtgaatcacaatagctgggttgtgttgtcccgctgaaactcccaggaaagatcccaactagaaaagcaaggtcaatttataaagctaagtttaatttacattcttagttcttaatagacactgcaataattatccaaagatattaattcacatgctattgggtattagccattgggcaataatgccccaaattaagagacaggcatcactccatcaccaaccactgaaaacagatgggaaaggagaaacacaggaaaaaaaatatatatgtgcataaaaaactctgcgtaaagtgacaaaatttacaggattaaatttaatgaataaaatcctttgctgaaaggcttaaaagaaaaacataaaaaacggatccaccagctcaagaattatataacacattctataaataattatgtcaagttttcaaatgttaatttcaatggaaaaataattttttaataaacttaaagttaaatctgaaggaatactgatgtgacaatcacgcagaaacatttgtggctatcattttatcctatgtgtaccttaatgatgatgggtgagcaaattgggaaactacaaagtgtcttgtgtgggctttgattttgtgtagccagcatatgaacttgttcatctaaatgcagattagataagccaccctccagatcaacaattatggtgggtcacacaacaatcacaacccctcttgctgtagatcaggaaaaacaaatcccctggcttgtattcttattcaagcatgtaccatacatgtcacactagcttctggta

SEQ ID NO: 6939 - DNA, 1398 bp, artificial
  synthetic oligonucleotide
aaaagatgaatgcctgctttcctggctaacaaagttgtatctggttcttaaaggataaagatgtgaggccttggggctgtgtggtccaaaatggtagccactaagacatgtagctatttacgtttatttaaaattaaataaaatgaaaatttcaggtcctctgttgcacaaaccacatttcatatgctcaaaagccacatggactagtggctaccgtattggacaacacagatataggacatttcatcatcacagaacacactgctttggaagatacattttgaattgtcacatatttgattttctataacccaggagctgggttctaactgggttttctgttggatttcattaattcagtattttgtgaagacctactgggtgccaagtacacaaaactgaaataagatacctttctggcttcaagataaatccaatactgcaggcagacaagtaacacaattattatagtccagcatgatgggggcaaagatacagacccctgcagagccagtggaaagagagtggagagaagggggacagggaagatcagaagggcaaataattcatactggatgggtccttctacagaaagatctagtatccagaatacttaaacagctgatgtggtgacactgatatataaccagataaaattgttcattaattctctgtgtgtatatatagatgtatacatctatatatatttttaaactaaacccacaccctttttcatcatttggagttagggttaggtgttatggtgcagcacactcgccctttaacgatagaactcatccttccaaatccacagttgccacttcaaacggtctttcatccaaatggttagagcattccaaagaaatatcacagctctcccaggctcaaaaagccaagtggggttagaagaatgatgctgttcaatcccaaattcaatactagatcaaagctaaagtttccctccaatttatatctctcaaggactctgtatatacctcatgctgtggatctagttttataacagcagggaaaaccaggaactcaagaatttgggggatcacttcaatgaatcatgctctctcagcagatgccaatgctcttaggttttcagcagatgattttatttgtggctgtaggaaccctggctcctatagaacagaaatcaccatctttgctccactggcacagataaaactcttacggactgtgccagccaacatgactagaagctagtgacataaaatatgggaaaaatttataggacataatacagctggatgtagagcttattctagcttggttgaccagttatcttcagggttaagattgcatgtgtggtagatatccaacaatctataaatggatcactctccactgtatcttctatgtcagtataga

SEQ ID NO: 6940 - DNA, 799 bp, artificial
  synthetic oligonucleotide
ctttttggaatgtaggaagcagtatattcattcaaatctgttttgctttcattagcttgcttgctaaaaattaatgcttttctatacagattgaaacaaaagaaatttatgctcaaaggcaacttttactaaaagatatggatttgctaagaggaagagaagcagagctgaagcaaagagttgaagcttttgaattgtaagtaatgcatgttcattttggatattcagaatgatgagattaaaaagaattactaaatatatatctaaatattctaatgttcattgccaagtagagttcttatttgtaaaggggatatcacctagaaggtacaaattaagaggaacaaacactagggttttgtttttgaaatattaaacattaagatgaaaagacgaatgagatgctatcatcaggctacagtaagaccagacagattatttggagaagctgttaatactggaacagatcgtatgttttgcagttacattcagtccctcagatctgatagttccgtgtgtgtatgtatagtaactgaattccatatatccaggcctgcagcttttaccagctgtgtgctcagaaaaggaagtatggtggtccaacttgacttgtacttggtgaaaccatttctttgttactcactgtttctaagtgctcacaaatgtttcatccttgagatcttacctgggattgatggcaagttcacctgtctatagtttgtgcaataagccttctcttcctttgggaatctgctattgacacccatagatactccaggaatcttagttcattaaagaa

SEQ ID NO: 6941 - DNA, 1878 bp, artificial
  synthetic oligonucleotide
gttggtgaatttatctcagtacattgattttaattgggatacaaaaaaaactcctttgacaagtctgaggccctctaaaaatgtcaaaaaggcttagactgggtcaacatctaaaaaaccaacgtaaatgaactcaaccttttttctctttaattccatcagaccatgactacagatactaaatagctgtgttctgtctctattcaaagtgttgtcctggagttgtgtagatgcagcttcatcattctgtctggtcaaggaatggtaaggtaatatgaactttgggatttttgtacatacaagcaagggtcctttttgtgtgtggagaatggggttctaggttgacctttttagaaatctggcatttttaaatgtcatatctatgcttcataaaaaattctagtattaatatgcacatgaaaaaaatctgtaaaatgatttatagatgtaaaatagacttacatcttgggaggcagtagtatagacttacatcttgggaggcagtagtatagacttacatcttgggaggcagtagtatggtgtggtggtgagtctgcctggggccagaaagagctgcccctaagtgggcttaagacagaaaggttacatatgcataagatagaggggttacatatgcatatttttgaccaaaataattatcttgtgtatatctttaatcaatttggtagtgtcatataaattgttttacatttctatgttgtcttatttgtttgtttggtttggtttcctccactctgtggccactaagagtgctgaatgtcattaggtaagagctaattaccctttctttctcaataatttctttgacggcctatatatttattttaatgacaatgttgctcaaaacacatttgaaattgcctttttcaggtacacaaatcatacaagagacttggcattgtcaatttatggttaaaatttttggtcatcatttatgaccaaaaatagcattaccaacccagaattccactgctaggtatatacctaatagaaatgaatagtagcactatttgtattagtcccagtggaacaacccaaatatccataatgtccattgttagaatggatgcactgtagtgtattcattcaataaaggactatgaagacatgagaatgaatagcttaacgctgcccacagcaacacagacaaatttcaaaaatatgtaattgatcaaaagaagccagaaagtacatactgtacacttccatttacttaagtttcaaaatcaggcaaaattaatctatagcggtaaagttgggattctgtttatgcttttacccgtggtgggggcgggatgctggaagggaacacaaggggagaatttctggggggctggtaattctgcttcatggtgccttttgaatggacatgttcactgtgaaaattaacaagcagtacacttacgatttgtacactgacttttctatatatgtgtcatacttcagtaagaacttctttcaaaaataaaagtattactccccctaccccttaagatgaacctcttctgtctgacattgtgctgaatgactcgggacacctagagtgaattcagctctcagcgccaggtaggttgtggctgaagctacacagactcaggtataatccagccacggatgacttttgttgtgggtgttcactggcctgccatccaggctgctggaggtgaatggcatgggaatctggagaggaagttcaacgggcccaggggctgaagtttgaggaaatattcctgctgctcaagagcctggaactctcacctgccccacatctattagtctttctggacaatgatggaagtttctacgtctcccttttctatccctgttacttcttttaaaagtctttttcctcctagg

SEQ ID NO: 6942 - DNA, 1210 bp, artificial
  synthetic oligonucleotide
gaactagaaaaagtactagaagctgaccagagacaaaacaaagagcactggttcttttctttgggcatctgctgaaagaacatcacatgcccacctaaatagggtacgcctctctgtattctatcattaggagcagcaggacatctggggatgagaagatggagagatcatccttatataatgttgcagtctggaagcatcactctcaaaaaggtaagtttttaggttatttttagtttggtttacaattaaaaaaaatccttcattgaactctgactctgcagattctagaaaatagaatattgtgggcaagactggcttcagaagttttatggcttaatagaaaaagaaggtgggcagacctggtaaaaatctttgcagggtcatgcatgcctcccacgtcaagtatttgccactcttattattatttttttttccagacagggtcccgctctgttgcccaggctggagtgcagtggtgcgatctccgctcactgtaacctccacctcccaggcccaagtgatcctcctaactcagcttcctgagtagctgtgaccacaggcatgtgccatcatgcccggctaattttttgtatttttggtaaagatggggttttgccacattccctaggctgatctcaaactcctgagctcaggcaatccacccgcctcagcctcccgaagtgctgggattacaggcatgagccaccatgctcggccactctcattttttttaaaccaaagaaatcaatcttaaatcaattttgcacttgatttatgcacatcaattttgtttgcttcttaaagagtatatgattagctgtacaagagactataggttaagaaaatccttagtcttgagaaaagcactgaagaggaagaaaaagacaccaggccccaagacatccaccaaaaatagatccaacttacattgtctggcagggcaaacaatcccatcacaatcacatgccagcccctatattctggctggtccccagaatttagtcaagatcaaagtaaaattttttggtttctggggtgagccttcatccaggtcaaaatattctggaagaaggcttgcctggcacctggaattccacacccttgagctctccttttcacggaacagcattcgtcagatttactgacagcatagcagtggcataattaacaaataatccagttttcagcttccctggcctccacctgc

SEQ ID NO: 6943 - DNA, 993 bp, artificial
  synthetic oligonucleotide
accttgtgtttgtcatgcatgcagttaagaaattactttttccctaacattactagtaagagtgagattttactgtgttcttgtttagacataatgtgtatttatcaattgtagtgatatatggatatgcgagtatccaggtaatttatcatattgtccatcactgtaatgctgagatttttgtaggtatcacttcaagagaggaaagtttctcttacgagtgttttcccttggcattatgcaagcatccagttacctttgataggccctgaaatgatgaaagagacgaagggaatttgcaggtgtacaggtagaatgagacatttaggaaacacattttcaacagtatattttttaggttcatttgaagaggtcacagtgagcctatcagtaatagttaacaggggtcattgctcgtatggatgtgcatgataatgtgggcctaaaacacagcccagcccatctgatcttcccttatataggtaagtggtggtgtccctaacacttctgttactatgattttgttgtagctgttcaagtaagaaatgatagagctcttaccaatttaaaaaaacattatttttctcactttttatattttagaataactttatgattaacctctgagttttgagtgatagtgcctatcctggttattggtgtttcttaccacagcagtaaccaggggatttttacaggtgtcctgtcaagaaatgaccgtcttacctgacagtggtattgatcttgcattattacaagtatccaggtagagtttatgtgttctgtaatgatggagtgacgaaggttattttcagatgtcttggtggaaatgtttgtgtcctttaacacatatttcacaatgtgtatttcaggtttctgtagtgagaccctgataaacctaacaatggttggtatggcagacatttctggtatgcaggcaagtgatgatgtgttctttaaccacatcatagaccatcagatcttcttatatct

SEQ ID NO: 6944 - DNA, 393 bp, artificial
  synthetic oligonucleotide
gggccaggcggagggagccagagggaggcaggctctgctctccctcttcctgcccttcagtttccaaccacggcctcctattggccaaacccaaccagaagccagcgagcaaggggctactgatgaagcacatatagctcagcctccagagacacagaacaggataaaaggctgagacagtgggtctggtggggcaaagagaaagcttgcacctgccaggtaaagcattatagtccccatcctccccccaccaccttagttcttgtgcatttcccatcagttttcttccaaagcatttcagatctcactgatttgaatgggacctcttcttctattaccaatttggatcagtaattatttatgtatgagaaaactattgatttttacatatcg

SEQ ID NO: 6945 - DNA, 1060 bp, artificial
  synthetic oligonucleotide
ggcaccagtgtaatccagcattactttcttctgtccgtggaaggtgatgttggtggactctttccttgtgtttgctttcatggattcctggaagatttctttgttgagttactcctattgcagcccgcttgtgtcaggcagaaaccaagggcgggctatgctcagtgctccttggattctgtatatttctgcgaaggccctctcatccctcaaagtagctcagttgatcaggaggtcccaggccaatgtttctactgcatcttccaagagtctcatactttgggcctgcctcagtgtaagggtagtaactgcacaaatgtagcctctgctctttgagcatgtgctgcttctgacagcctcttcctgctgccttttttttcagtttgtaatgaagatatgagtcagatcccaagatgagtaaggggtaagggttccaaactctggttttcaacacctttgaaaatcttgcggcacccttctttggcatgtgggaatgattggcatgtattggcatggggcctcagctgattctgtctcagttcatcttagcaccctgtaacatatgaacacatatggcttccatctttttttccacctaggtttggattaggagtcctaagggatctgtagtgctatggagttaattcttctctggaagatgatgattatgtacttaagatgagagaaaacaaaagtaaaagctctttctcagaatgatgatcgatatcctgctgagatcatttatgtgaatgattttatttctagcaaaatggtgaacaaccagccctcaggaatggtggaaaccaggactgttcaggggattactggcatctgtaatgtttactctggtgctcagtcgtgaatgtgacttggctcccaactctcttagtctctgtgtctctaagttctgattctggagaaaggatatctgattggctcattccaacattcaggtccaatgagctgggcccattgcttgctcctgaggactctgggatcagactcagacaggacaagccaggcagggcagatagttccactaacatggctaccacgctca

SEQ ID NO: 6946 - DNA, 3008 bp, artificial
  synthetic oligonucleotide
taagttcaactgtaatcatgccatcaactggatacacaggttctgcatttcattttacatgcaatttttagaaattgctttttagaatttagagttttataattatgaatactatttacatgatatctaagtcaaatctacaaaatgtatattcaaagaagtatacacgctttgttctctccatcctatttcctcccccatagataacacttatttttatattctattttatggtccattcttctattgtttaacgtgagcacatactctgatccctctccattcttagaaacagtattacactagacacacttttattcattttgcttttttcacgtaactgtatatcttagcattcattgcatcatgttttctcaaacacacaagtgagaaaaaggtgagtaggcacatgtgtgtaacatttagaaattagatgtatatttttggtttgtttttgtttttattttttgagacaaggtctccactctgtcacccaggctagagtgcagtactgcacctgggctcaagagaccctcccacctcagcctcctgagtagctgggactataggcatgccccatcatgcccagctaattttttttcttttttagagatagggtcttgccatgttgcccaggctggcctcaaactcctggactcaggcagtccgcccacctcagcctcccaaagtactgggcttatagacatgagccactgcacctgacctggaagacatacatttttattctagtggttgtcattagatcaatgcctttgtataatagcttagtccacccacccacccaccacacctgcccaccttttgttccctggctattgtctattggtctccttctatgaacattattgaaattagctaagtaataacctcttagctctctttgctctctccttgaacacttgacttgaactagtttctttctactgccagttagtattaatacctataaggcaagcagctacctaactctgttcttcatacagccagtacgagtgctacctgtctcccagatagcatcagagtcatagttaataccggtaaaaatgtgcttgatcctcaccactctacttcggtggctcccacgctggccattatggctgtccgcagcttgttttcttgtagattcccaggatgaggaatctcccacttcttgtgaggacctgtaggcaattccagggttcttctggtctccaagtcatcagaagccctttttccttgcctccatttccttccacatggatactgttggtatgaatcatattctggcattcatgggaatagctcaccacttatttttgctggtgatgttgtccatggggttttggctttaatatctgagttgctttctctcttttttatgggagaactcaaggagatccaaaaatgattttgccaactttccataatcctccagtggctgcagaatttatcaaaaagttttgactgaagaattatttataaatattcaatatctcttgtggtcatgtagcactttaatttgactaattaaacttgaattaatcctgaagtcctggcagacaaatacaaacaaatggtaattttcacaagcttaggtaaaattctctcttttaatgaagaagaatcaatcatctattatggaaatataaaactttgttgtcctgctgaaagcaaaacttttttccccttgaaagtgaatagcaggccactttttacgatacatatgtaatttgctatatacattgtaaacgttgaaaattttatacttatggacatcaaagaaagcctaatttttaaaaagtacctatttataaggtagtctggatatatttgatctattgaagttattgttttgccagtataattttcacactatgtgttcttccatgattaatatatgtgagtatataatgcttcacaaatagtagactcacaaatacttcagaaaatagtagactcacagaaaaggtcttctttcgagggtgaagaggctcaaagaggtgtagtattttcccagagttacacagccagtagatagcagagcccagagtcaaatacagaagccaagtgggacaatggactgggaaccattgtagtagaccacatgaaaaccataacgcaatattttcaacagaagaagggattctaaccattaccattggagaggaacacttacacttttcatttgtttaaaaggtaggaatgtggccaggcacggtggctcacgcctgtaatcctagcactttgggaggccaaggcgggtggatatcctgagctcaggagttcgagaccagcctgggcaacatggcaaaaccccatctctactaaaaatacagaaattagccaggcattgtggctcacgcctgtaatcccagctactccggaggctgaggcacgagaattgcttgaacccaggaggtggaagttgcagtgagccaagatcacagcactgcactccagcctggacgacaaagtgaggctgtctcaaaaaaaaaaaaaaaaaaaaaaaaaaggtagtaaggagagaagggggaaggaggaagtagtcgaaaggcttatacactctaagcattgcaatttaatatattttaaattttttcttccaagttttataagccataattcacagaggcaccagggtggtatctgcccacctctagattgaaaaagaaatgaggaatcaaggctattttaggcatctgtcaagctgtaattacctctttgctcagagaaacctttatgtaagactaatgtagattggcatttcttctgtttaaaagaacatttccagtcattcttttaatagaaggatccctattatgatggttatttcaatatgttttggtagagggaatatgttcccagtatggccttgacatagaaattacacttttaatctggtctgtttcttatttacttacaagcttcaatacttcttagagtcttctttccctaccctttctagttcagaaattgttgaatggcttttatttaagcttttcaagtaa

SEQ ID NO: 6947 - DNA, 2647 bp, artificial
  synthetic oligonucleotide
tttctgaaaacctgccacatcatgttactttgcagctctgtgcgtggctgtcattgtaaacactgtttagagaacctttatcagcatttataaagcatttagtataatttgctgtgaaaccactggtgtttttttagcttaatagagtcagcacatatggagtatttggaagatagcagtttacatcctataaaatgacttttgagtctaaagcacttttatctcagccatttaaaatgattgattagttaatttacactgccaggtactgttctcattttacaaatgagggaaatgaggcaaaaagaggacaggggacttcttcaaggccacgcagcaaggtaggggcaattgaaaactggaactccccaggctgagctctcctatctaatatttccctctggtgcaggagagtaaaaatgcaagtctctaaaccccagcagtctacatcctgaatgcaaagcacccccagcagatgcttatagtaaaacacatgaccgaatcgctgctccttgcttgaggaaaacttctgcaaactttattattatattttgcttgaaatggtgtaaacacaaatagatccattgagaaacagacattttgctttttaaaattaaactgggactccaggtaggtagcatcatccatagaacagttaggagttcatttcaccagtgttctaaaggggcaggtgataatcagcatatgctttcttaatggcatggtttagcatgtggttatgttgtttatttaattcagaagtcttttaaaagcgatactgtaaaatgtgactagccagaagacaaggaaaacaggaatgttcccaacttaatcaactgtacctggaaagaataactaaaaactgaaaaaaaaatccttattaggagtttattaaaatttttaatttgcagcctaagtaccaacagagaaactttgtcctgtacagtgtaatcagatttaatattcatgacactgaccccaaggcaaagctagactcagttatcaaacaagattcacttttctctatatactttctaaggcagcagaatacattttttaaattgtagaaaatattccataatcatggctaagccagatctactcatcaaaaatttcagctaattgagtttattgctttgacactttaaatataaggagacttggcttgagataacaaatgtatccagcaatgtatgtcctggagaacaaatttttgtaaaattataccttttgctcacttattgggtggctaagagttttcatagcagagtcatacctgataaagaagtggattgtctcatttataaattataaacctagtgggtagacgtatacagatggtccccaacttatgatattttgacttaggattttttgactttactgtggtgggaaagtgatatgcattcaattacccacacaatcattttattttttactttcagtacaatattcaataaattacatgagatattcaacaccttactataaaataggctttatgttagatgatgttgcccaactgtaggctaatgtaagtgttgtgagcacatttaaagtaggctaagctaagctatgatgttcagtaggttagatgtaccgaatgcattttcgacttaagatatttacaacttacaatgcgtttattgggatctaacctcattgtaagtctaagagtgtctgtacatttatgttaattaagattttatcattacctgatctctgtcctcatgaagcttacaagttgggggagtttagtgacaagcaggaaccaactaagtaagtccaggtgtggttaatgctataaagaagcatcagacagaccttaggaagcagcatatctgctgggctcactcttcacacttgtataaattcaatcagtgaggaaactgtgaactcagatggattgacaccatctgttactcaaggcacagcacgttcacatcagttccctttgccccctaagttctgcagggtgatgtggaagggggcctgggtagatgctgtgcagtcagtgggtttgtgtcagagctgagaaacactgagttgagaaaactcccagttgtatatggggtctgctagcaaacttgcccatcttcccctccagagagagatctcattattaacttggaatataagcagatcttctctggggattggaaggagaatgaaaagggaggaatctctgccttctctatcctggtcaggaaacaaatctgtgacccaggactatactatctctagcttccaaggccatttgctattgaaacatccttgtacaaagctatcagtactcttcactcagagaacatgcagaaacatctgaattatctcccaacaaggaaataagtgatgtgatacaaggtaattgaaggatgtcaggggaatgagaagctgaccccagagtggatatatggagaggggcaactggtcctaggaagaactgggaaagggtgtttccagaggcaacaacatgaggtggatgatgtgcttggtgtgttcaagggatgccaagaagagcagcatggcaggagctgcatgggcaagcagaaaggtagctggggcaaatttgggagggtacaggagccaggtcattcagggccttgtaggtcgtagtttgagttgggagttcatcagaagagtgatg

SEQ ID NO: 6948 - DNA, 659 bp, artificial
  synthetic oligonucleotide
catcaaatgatctttaatcttgaaagctaatcatagcaggaaaagaaaattatgaataggctaaaacaggggttggcatactgtggcctatgagccaaatctggcttgctgactgttatggcatagcctgtgagcaaagaatggtttctttatttttaaatggttcaaaaatatcaaaaaaagaataatatgaaattaaaatttcagtgtccataaataaagttttattggaacacatgtccattcatttatgtattatctatggctgcatttgcctgacaacagcaaagttgaatagatgccacagagaccttatggcctacaaagcctaaaatatttactctctggctctttacagaaaaagttaactgacccctgggttaaacaatgcctttttcctgttttctcttctttatcattagcagcacacatgtgggcacacacatgtcaaatcgagcatattataataaatacttgaattcactgacccctgggttaaacaatgccttttcctgttttcgcttctttatcattatcagcacacatgcgggcacacacgtcaaattgagcatattataataaatacttgaattcactaatgcacattaccagttaatatagaccttatctttattgaaacttctgatctcaaattactt

SEQ ID NO: 6949 - DNA, 2851 bp, artificial
  synthetic oligonucleotide
cccttgcaggagcgcaactttagcttgacggacaatggggagcttttacatattttagatcagacaagtagccttatgtgatctacgttaaaacacacacacacacacacacacacacacacacacatacacacacacaaaacatctttttgtctggtatgttgagaatagattatggcataaaaataaaagatttctaaatatattgccttatatgaaaaggttgcgatgagactccaatgcaaaaaaaagctttaaaaattataaagcacagtgcagacccaaactataattattttacaaacaatagagttcaaaagccaaggtccctctcgccccttccgatccttgagtagtaactgcgttcatgcaattaaactagcctgtttaatagaagctgcaggaaaactgataactatgtattcaaaaacatgtaattttatgcctgagttttaagtcatttagattttgcagattgctatttattttatgttcagtttttgaaataaatgcttaaaaaaaacgctttagtactaggcttgaatactgaagactttaaatataacaacagaccaggagaggagcagaagtgtgggaactttaaacctatttctttcttaatcccctcggagagctagactggaacactggctggatcttccaacatttctgggggtgctctctgttctttgcggtggccctgccgccaggtgaacgctgccggtgggagagcacacacttagtgcggccagctgaccttcacagtctggggggaaattttaaaggattgtggagaagaggccttgagacttcaagaggaagaagaaaaaggggcccaatgaagcctgagcctcccaggaggtagaactgagttaatgaacagggctgattatccaaggtaattatgtaaaagagaaggctaggaggagttctagatggctgcaacttggagtttactctgcctaaggtgagtgtttatgtttctgtgtttttgcttctccggcaaggttttgttttgttttgtttttttcttccctgttcccttcacccaaggctcagtgtgcaaaagcagctcgctctgcgtggcagaccccattctaatccttctctttccttagattctgagcccggttagaattagcctccgcatcacgggctcctgggaccctccgctctatgctcctcgaggagggagcagctgtgttcatccccctacccgcaaatgcctccggttcttatttggcagacactcccgcggtgctgctgtccaaagacacaccttcccagccagcccagtggtcacgtctcgccccagcgattcgggagaagcagtgggaactctgagctccccgaatcgagcccgctgcgcctggcatctcccttcccttccccttgacaaacgacccaacctcaatcatccctgctccttccgaacgctagttttgtttacggagcaaaccgaggctttgagcaacctgcggttgcacggctctccttcggcttggggagggaggggtagcgttcacagttctccagtgtgccatagactgttagaccagatccttcagatctagaggcacacgcagtgggtgacaggagagtgccccctccccccgggcgggtgggggtggggagaggagcagggactcggcttggagaaggaggcagggaggcagctgcagtgctgcgaggggtgcgtgcgcgtgtgcccagctcgcctgccgtctcccggctccgtctgcgctcctcggtgcgtggggcacgagggtccgagggccgggaagccagagcagcgcctctcgcccaggcctcgctttctctggacgcccggcagtccccggggctagagcgcacggggcggggcgcgagacccgggccgcgctccccgcccccgcctcttgcgccctgcctggctccctctccattgagttttcctgcctcgggtgcctatcaatggtcctgctcggggatgcacacgcagctcgcggccggaggggggtagcagccgccgcctccaggtgcaggttctctccggccgccgccgccacccgctgtcgccgcgactcgagccccgggcgcactgaggtcttggccatggggctgcggaggctgctgttgctggcgtgagaaggggcgacggagttgtcgcgctcgggggtccccagctgcctgcatggatgtcttcagctttgtgaagattgcaaagctttcgaggtaggggctgcgcgggttccgtttgcacccagggccgctgccgcgggcaacttggtgccttatttttcgggaggctgggtagaggcaaaagctggaaagcgcgacggggcttaagacaaacgaagtggccgggggcttccacgttcaacttatttctcactggctgctgaggcttgtgtagcggcgggtgtagaccacacacagagaggtacatacatgccctcaccaacacaccgacattcacgacagtttgttttccctaaggaaaagccccagcggtgtttggggtcccatgtataattcagggctaagagaagatggttgtaattgctactgctagggaaacccagaagtgcttggagcttgggtgcctgccttccaagctgcaaagaccaaaagtgccgccttcccccaactcctaaattacacctccacacctccacaaagtcagctcctagattgaccaggtgctcccaacggtaacctagatggcgaagtcatgtagatagaagagaaagactttcagcctttttttttttggggggggggtaactatattcttaagcctcgaaagatttagaaattttcttctaagtggccatgttgttaaaacagtagctaaaactaaatcatcgat

SEQ ID NO: 6950 - DNA, 1140 bp, artificial
  synthetic oligonucleotide
gatgatagatgtagcttaaggcttgatgacctcatttagagacaggaagcagggaggagggagggaagtactggatgctggatgggaggtgggtcctcaggtggtcttgagaaggaacttcatttccacatgaaaagagtaggcaccaatgtctgctacagcccttgaggacaggagtcaagtctttatcttgattccctctccacaatgcctagtatatagtagatggtgtatggtagatgttcaataaatattaattgaatgaattaataagtaaaataataaatttatgaatgagacttcaaaaacttggaataactggtctcaagtctgccatttttgtacatacatcttccttaaagttcaccctcataatagtcttcaaggctagagcaatttatccatcaagcagaagtgctgttattcaacgtgatttgattagtttttgtctagtcagggggccaaggtgaaggaacattatgtcagaaagacagcataaaagtgattcgggatctgagaggtttaaaatgagtttgaaatattaaaatatgtctcagacaaatatgaggctttgtcggttatttgaatgttgcataagaattcaaaatattgttacagggtatgtcacattaagaattcatagtctgaaaattatacactggcagaatcttttaaatgacctcctccccgtgcctctccatacctcatcagacaagaggagattcagtgggaaagcagtaattataatcctacattggcagacttttggtatgtgcctgagcaaaacgggtgagagagggtggggttaaagaaagaaaggaagttaagtgacctaataaggcccaggggaaggcccatatagcaaacgtggttcttaaccttgaataaaggtcagctgctagggggctgagctaatcattgtgtattttatagatatacagttatctggtaaaagtttctgatattggatttgttcctgtagaacctagtcttcttgattacagaattaccaatgtagatggaatctcaaaatattatacatctcttggcccttaggaagattcacttgtgtatctgcattgcatcagaaggggaaggaaacgagaacaggacatgcacatttattttaacctataaagc

SEQ ID NO: 6951 - DNA, 3865 bp, artificial
  synthetic oligonucleotide
aaatttgtagggcattttgtatgatgatagtagctaatggcaatatgctctatattcttctctgtggcatcctaatttgtcatgcctaaaatgcacctgggtgattgagaatgtatttgcttcctttcaggaagtggctggtgactatagcaagaggaatgttgcagaataatttgttattacagaagaaaatgggtgaaaagtttatggcagactaaaacctgacatcaatcctaatcttatttttacttgctgtgactcacgagtgatgttgactttttttttttttttttgcagctgacactttgtgctgccaacctccctttcatttatttgcgtttgtttttgctttttattgttaccccagtgacatctttctctttcctctcatagagagaaggattaagatttaaaagataatataatatgaacatgtttatttagccatagacgctgagtccccaataatattttcatttttataaggagttttgaatataaggacacattcatttaaaaggactattacgtgaaaaattttcatggctgactaatgggttggtttctgccaacaataatgagcataatttcaactgaacaatattgctgtttttcaccaattctgttattcgccatcagtctagcatcatactttcttcaatcattttctgctattacaatctgaatgtaatacaaaatactgggtattaatgtattatcctaatgcagtctttggaaaaatactaaatttgtgattcagtggtccatacttctgaacaatgttttttctttcaaaacttgttgattttatttttatttatcaccattgctataccctataggtataagatttggtcgctctacacagttgaccttttttccacagccccttctggagatgtaacagatagttttaggtctctgggcctccctatgcacagggcttacttggattggtggagttatccgggggtcttttggttttgatttcatttcttatttaacatgtggtaacagacaattattgttggctttttcccctctcttatgctttcttgattgggtgatagatgtttcagaggattttttttttttgtctgaagaagggggaaggaacaatttatatcctcatagttgtcttgtgtacctggtagggcaagagagtgaacacagaagggcattggtttaggggaagaagacggagacaaaatgggaagcgggggcttcataaagggtataggttgaggaaaggtttttgccaggccaggacaggataggactcttgggagaatgtatggggaagaagagaaggagcatgggtagggttatctgacctggcaactgtttctgtatttgcactggcaaggggtcgtcccctctttcttttcttcttcagcacttgtggctgattcttctgctcttgtggttggttggtccatatctgtgctgaatgtctgtggtttgtctgtaatctcagccatgttgaagccttctagtggtctgtcccagggagctccccctgcctatatataccctcccctaggcaaggcaaagacacactcttaagctgtgcttggtcatccaggcactgctgcagccaatggtagccctggagtgtcttggacatcatgaaacacaaccccgacacctccactggtggttgggtggtagtggggggatgctggagaggctaagatgctgtgattggagaaagggggtttctttaacaccacataaagagctttcccaaactgacttgccaccccctcctcttctcatattcaattctgttgacccccatcgcagaaagagggtgcttccttcaagttgttcccccatggccaccacatcagtggttcattcttttctctcccacccttcaccattatttagtattttggatgtcttgcctaaaatccctctaaggtaatgtggccatatttaagtctctgtggccatgtgaatcatcctacttgtccctaatttgtgtgcttgttttgatttatttcaatagttttgggggtacaggtggttttttgttacatgagtaagttcagtggttatttgtgagattttagtgcacccatcacctgagcagtgtacactgtacccaatatgtagtattttatccttcaccccctcccaaccttccccttcactgagttaccaaagtccattatatcattcttatgcctttgcatcctcatagcctagctcccacttataagtgagaacatatgatatttggttttccattcctgagtcacttcacttagaataatggcctccagctccttccaagttgctgcaaaagacattatttcattcctttttatggctgagtagtattctttggtatacatataccacgttttctttatccactcattagttgaggagacttaggttgctcccatatctttgcaattgtgaaatatgctgctataaaccatgcgtgtgcatgtgtctttcatataacttcttttcctctgagtaaatgcccagtagtgggactgctggatcgaatggtagatccacttttagttccttaaggaatctctatactgttttccacagtggttgtactaatttacattcccatcagcagtgtaaaagtgtccccttttcaccacattcacaacagtatcttttttttttcttttttactttttaattatggcctttcttgcagagtaaagtggtatctcattgtggttttaatttgcatttccctgatgattagtgatagtgaacattttttcatatgtttgttggctgtttctgtatcttcttttgagaaataaatgtctattcatgtcctttgcctgcttcgtgatgggattatttgtttcttgtggatttgtttgagttccttacagattctggatattagtcctttgttgaatgtatagtttgtgaagattttctcccactctgtgtgttgtctgtttactatgctgcttatttcttttgctgcgtagaacatgcttctgaacagttttctataggtcagtttcaggtctgtcaggaactgactttaatgcttcttttttgcttttttcatcaaattgtaagcaattctctatgaaagatgcaatttgacaaattattaaattgctgtctttgtcagcttggctgctataacaaaatggcacagacttggtggcttaaacagcagacatttttttttctcacagttctggaggctggagagtccaagatcaaggcaccagcagatttggttccttgtgagggctctcttcctgaagcacatggccacctttgtgctgtgtccttacatggcagagagagagctagagagcaagtgagtgagaacgagagagtgagaacccaagagagcactctggtccctcgtcttcttcttataaggatgctaattccatcgtggggactccagccttatgaatttatctattaataaacctaattacttcccaaaggccctacctcccctcctccaaattctatcacattgggggttaggactttaatagatgaattttggggcgaaacagtccataatcatagcctttcagtaagatttgtcaaagaactctcacttcaggaattttctctgtggctgctcatacttggcatgggaaataatctcttagaatggaatcgaaatggaaatggtgggggcctcttacctccatttcatccaatatgaggtagaattctcaaaaggaacatgaatggcagaataaagagcaaacgtgagggcaggaagacttgttgggaacttattgcagtaatttgggggagtgatgatggaggctaggaccactgggctggttgtggggttttaagagatgtgtagattgtggatatgttttaaatatag

SEQ ID NO: 6952 - DNA, 508 bp, artificial
  synthetic oligonucleotide
atgtatataggtggggatagacagatttttcaagtgctgtttagttggtcagaaatgacgctgcatttttattttcctggaccaaacttccctttttcctccctccctttcttttcttcctaaattcttattttggctttgatgtcaaaatcctgcctcggagcatatctataggcggctttcatgctcacagaaaagagtaaactggcttgaaacccaaggcccttatcaagtgaaatgacaaagcatttctgccgtaaagatggtctttcaacaattcaaactaagcaccaggacaggcatttcacagtcttcctagggtgagtgagtggtctgtgggagtggaatccctcttgatcttgtcctgttggagaccttgaggtctgatagccaccagctccttcactcccgcacatctggaaggaagacaagatgagcagaaagccatagaatcagtacatcaaaatctgccggacaggaaatggagttaccctgctcaataattagg

SEQ ID NO: 6953 - DNA, 200 bp, artificial
  synthetic oligonucleotide
ataaatgaagttctgttggaacacagaaatgctcactcattgctgtagtgccttatgcactataacagcagagctgaatggctgtgagagactatatggcccacaaaacctaaaacatttgctatctggccctttacaggaaaactttgctgacccttaggctagagaatgtcacttaacttctatgggcattgattttt

SEQ ID NO: 6954 - DNA, 1596 bp, artificial
  synthetic oligonucleotide
ccttgggaacaattggcaaatatgatcactatattgtggaagaagaaatcagtctaatgtgatattgctataatagtgaatgtgccattttggaaccaaaacatcaagtaggaagttgcttctcatttctgccgtgttggtatatccactttcattggaaatgatctttgctgcccaagttctgtctgctgtaagacttcttaaattcagacactaattgatgtgaattttttttaaaaagttacttgaagtatgaagcaaaacaagctattattaagcctgacctggtctatggaattcatcagttcttaataatctgtaccacacaaagcttgctaaaggttgagacttccaaattgtgaaacagtggagaactgtcaaatcatttacatttgcctttagatgttattttagtctttatcttagatatcctgaggacttaacaatccttcaaagtaatggaatcatcttgttaagatattatggtcttccctagtacgctttctctccaagcacctttctaatattctaatatcagaaaaccaagcaacaacataaaacagagtgtgagctccctaaatggtgcagagcatgaaagaagaaagttttcaagagcctactgcatgcctgacaccttccctacatcctctcacttaatcttcagagcaattatacttggtcaacattgccatcagggcaaaggaataatccgaagtcaaacagctgaaaaaggctttaaactcaaagtcatgtctttgcacatcaactttggaaatgtctttttttggggctggggggttcataccatccctggggcacagaagtaattacgttgacttgatatttttgtttatagcctctaatagactaaagttcccatgtatattgactgactgattcataaagttggtggaaatgtcaatatagtctcaaataattgaaatctgattttattattgacctctaatttgacacaatgaggtatgaattttgtttctcttccccatttccatagagtgttcaactttcttacaaactaaatctgcttgtctttttcctgttatgaattcttatttgtgcaataattttattagacatccactaatttatttgccatgagttaaatacattactgtaacatctaagatttcttaaaataggagctagagttatttttactcaaataattcctccttagaagcatcatttgcaaaactctattttaggcacgccgtttgaacttaattttgatctgtgtatcactagtcttctatttatagacaagggattaacattcccatgttccctttgacctattattcttgacatctaattccttcactaagagctaatttgaatataaattaaagtatttaatttgagcccaaattatttaagtgagtgacgtggtctgtgttcagtaagagtctgagcattttcttaaggaattgaaagctgactttattaactcacaattatactttgtgtattaagaaatatcatattagacttgtgtgatatataagagctgagaaaagcaattcctctactggggcagctaagtaaaccttcgaagggttaccaagtatcttctga

SEQ ID NO: 6955 - DNA, 5329 bp, artificial
  synthetic oligonucleotide
ggccattaaattagagatccaagggttatgttaggatatcttggcctttattaaacaaaaccagggttggagctacatgctagagttctatccaatcactccatgcctgcctcaagcataaaggaatttccaacacacacacacacacatacacacatattctatgagaaaattctggctttttgctagatggctacatccttagttttaaccaccatgaaaaggtaaaaatcatggtagatgagttttgtgcagactgcccactgtatggaatagaagccacccagtatcactgcagttcagatccttgtccattaattatgagatgctaatggataagaagataatttgcaacaagtgaaatcatctacagccacatgccttttggtcataacagtaatgagcagcatctgtatactatattccaagtatgtatatggttgctaagaaaagcagaaatgttcttaatgatgcaattagttttaagcacgaatgttagctagctaatccaaaatgctggcttgcttttgtatttctctttctctcaacttgtacagattaatctgataatgtgtgcttctgaaatacaatgagaatccagcccctcctaaagaccaagagaaattcaacatttcaatttttgatgctctttctaatcttgagttccctggtttggaggtaacatcttgccctctgcctcgactttcctttctactgcctatctttctcaagaaaatgggcaaaagacctagcaaaatttgttagttttttgtaatctgcacccccaacacctaacagcctcagttactttgacacagtaactaacattaataatatgtgatgctaataattctgataaatgatgcttatttttctaaggcggtttactaaagccaaagtctaacagttatctcacattaacacagctgagtatgatctcagatgctattttcaaacggttttccttggttgtgtatttagcctaaatctccagcaattacatggtatttcatttcatttctgtaatgctaactgtactttaaaatattaaattacaactgatggaatctcccttcccttatggaaacagatccaaggcaaacctatagagtttgtggaccgaaggggataggggctgttcatttttaaaacaattactattctctgaaagtgtgttattttcaaagcgcccatcagtgacagtttcccaataggtcaattcactatttttcttaactggacagcaaatattttaagggtatctgatagctccctctgagtcccctatgtattgttgattcttcactaaactactaattgttctaaatggaatttaggcatcagcatatttccatgatctttcacacccctacacagagattttcttcttctcctaggttaaactaatactcagtaccatagatttctgaaattgccccttcagggaaagaaaaggtgaaaactagagaattcttgtcccccctgccacccaaacacacacacacactcactcatacagtcaatgacaccctccaaaataatgtttctgaattctctacagaacaagatggcagacatatttcaaaatatatttcatccaatcgttacaaacagcttagcaatagatatttgagttggaaaaaatatcaacattgggtgaagggataaggtgaccctttgaaattgcctgcagcactaacagaaaaccagaacaccatctctttctccagctcccacgactgctccaaagtagagccaacaagtcctacaagacgcacaagcgggtggccactagggacatcccatttccaggcaccatttagcaagtagaagaggaaaacccacaccacggaaaccccttagtgggtgccttgctctgtaaatgtaatggaattaaaggcggtctcctgaaactgcctgggggcctcctccttgggccgtgggacgcgcagcgctggtccctacctcggatttccacacgacgtaggggtgcccgcgactgtcgggtggggactggaacttcctctgctggagccacctcctaggagaagcgaagatgccattggggcctcccccggatgaacagaggatgctggaagcgcttcggctactggctggcccggccaggacagaaggcaggtcccaggccatgctcttcttgaggccgccgcgacccaggggaacctcatagtcaaagtgaaagctgccggatggtgacttctcctgcggggtgctgggtgtggagaaggacgagcaaagaggtccaggaggcggtagcctggtggccctggggggcggaccccgggaagaggacgccaagcgagggccgagactctcggctgggagtgatggggagtagaggcggcccgccgtggctccccgcgcactgccctccgcgcccgcctcgtcgctcccgcagccgccgatcagggccgggtccaggctgcgggtctggcgcagcttcctcttggagaagcccttggccgaggccgcgctacttgaagcgggcgaggaacaggagaagacgctgtggagcaggctctgcgcggacatctcggcggggctgcacctgaggaccacctcctcctccctccctggacgctggtggctttgggtcgggaaccgaaagggactcaggcaaaggtgccaggcggggctggcccggggtttgcccagggcagtggagagcaaagcccagctcacgcgccgccggtgcgctccaagtgccccggcggcggcaggagcagcagatccatcaccagccttctaggaaaatgggtctggggacctcctgcagccgctagaaccttcctccggagcccaagacgcgaagagggtcaggaagaggaggaggaaggtcaggcgctcgctgggttcccagctccagcctgccagcgccactcccccttcctagctgaggcgggagacgcagcgctcctgctcgctggctctggatggcctctaagactccagcaagctcctccttgcggcccgaggacagtcccgagggccagggagaaggctgcctgggcgtgcgcccagggcgcgtccaccgcgctcccggcgccgcgagaacttcctcccgctcctgagccgggcgcctgagctgcgcctccctgcactctctccttgccccggcgcccgaggttgcgcgcctggcctccgctgggctgctgcgcccactcttccgactgcagaggctcaagggttgttccaagctcaaggttcccgcggggtctctgtcttgctgcagtgtggggacaccgagcgtgctgcgcccgggacctccaaagactgcgtgcccacggtgggatggaattcccggcggcgctcagcgctctccgtggaggagggagctcaggagacagccccaaggccgggtgtgtgtgttccgccggagaggaacacgctattcgcagcccagccttgggcccagggcagacgcggagatgaccccgtacgctcgctctagaggcagcgggaagggggcggccaggacgtgtagagctggaggaatgccggggctggagctggggcggagccaggagcaggagaaagcagaacgtgaagagttttccaggcgccaaacctgcaagcggcgaggagagaaggcagctcgccactgataccgggtctcctggggagaaagtcgtgaggacggaagtgcggaccttctcccccgtctccccacccccagatcaagggtcgcgccagctccactcacgtttctggaaaggaagggaagtgtcagattgcaccccacccactggtgtcagatgggcagccggggacgattgctctgaagttggagttaaatctcctgccttttctccccgcgcccccccaccccgccctgtcccggctgtttttgtttttaaaaaggaaggatagataggaaactgtctaaaagcagtggctgccgatgaatgagctggagatggagacctactaagaaagtggagggggaggagcctttgccgtggaaggggtcctgagcacgtgcggaaacgtgctctaggaggaggggtgagtgaggccgggtagggggcaggcgccgggcgcagcttcagcccagaggctgcagagattggcgctcacaaagcgatctgtctccgcgtcccgctctgggacgcctcgggtctcagcgcggtggccacagtcctgggaagctggagaacgctggggaaatcaatcttcccggcaaggagatgagtctgaaagcagcttctcccgctgtcggacccctggaatctataaagcgcaaagcctcgccctcttggagggctttttgatgtaacagttaagctttgcaatgcaacttacaaccatctcagcagggagcagacagaatgttggaaatgtctactttgtgtttgtgtcctcttttatcacttagggatgaagataattttatataaatgtaaaggtgactctaccatttcttttattttggagaaaaaatacaatgaaattataaatacagatgttggacacgaacattcctcttgcatatctaccagaattgtccaagtttgattctggaagacttcctttattccctatgacatattcaggggaaaagttaatttacttagactctttgaaaagcgtgtttggtgttcctaggtgttcagctattttggaggaggtacgtcatgaaatctaattaggagaattcgttgtctccacaaagggcgtcgggctcccaggtcttggctgtactcgttttttgtaaacgcagccgaacagactgcacccttagagattttttttccggtagctttaatgagctatctgctgtctgaagacagagttcgattctagtttcccatcccccatcgctgtccatctcttctcaccctgagcttcttaagtattttcagcggctgtcaatcaggtgtgctgctgacaggcacagtgtttaaaaagagctcttgctcccctgcctaactacacccaggccaagttacatttgggggcttgttggcattggctttcttccctcctcatacaagtcacattagaagtaaaagtgtgtgggtcttgtctgccctttctttagtaacaaaactgtaatttatcactggtaatggaaacacttaatgtctctaccactgggatacgaatgcatggttatgcctcattgcatggttatgcctcagtggagtttggcattcggggtagatggttaacagagtcacttcacagaatcacttataactcaaggggggtgagcaacttgatgattgtatttgatgatttatatatttctctaaccccatatgataaccatggggtagcaaatgaacccctgccatgactgtatagg

SEQ ID NO: 6956 - DNA, 1435 bp, artificial
  synthetic oligonucleotide
tttatatttatgttttattgaaaacaagatgtggcaacaacatattttctgaaaattataaatatcatttttaggtaaaattcacagaccatataattcacccttttaaagtatacaattcagtgattttttaaatatattcacaagattgtgcaaccatcacctgtatctaattccagaacattttcattaccctaagaagaaaccttatacccattagctgtcgctccacatccctccctaccagcctctgacaacaagtaatctttttgtctctatggatttgcctattctagacatttcatataaatagaattatacaatatgtggacctttgtgactagcttctttcacttagcataatgttttcaaaattcatccaaggcatagcattcatcagtacttcattcctttttattgttgagtaatttttcattaatcacattttgtttaaccattcatctatccgttgatgaatatttaattgtttctaccatttggctattatgaatactgctgctataacattcatatacatgttttggtgtggacatacatcttcatttctcttaggtatatacccagaagtagaattgctgagctctggagtaactgttttatttttgaggaattgccaaactgtttcccaaagctgctgcgtcatgttacattctcaccagcagtgtatgagagttccgatttttctacatcttgtcaacacttgttattatctatctttttttattatggccatcttagtgggtataaatgatatctcattgtagttttgattcacgtttccctaatagctaatgaaaacatcgttctttaccagataacacaactaatttcattttttcacacattacattccaagggtttttctgccatgtcgtaacatagttacaatcacagtctcactctctttatctaagtaatggctcagagaggatgcagtaaattttagaacaagatgtcacgccccaaaggcaagcctctgggaatctgggagaactgctatctgcatgcagactccctcagtcattgactagattttgatatgaaacacactttctctttttcaagcaccagattggaagaatgtgaatctcactatgaaaacatgagcttctgtttctgcaaatcctgaatgtgtcatgacatgtaccagagtcaagctcatttatttggaggcacctggctgagccataaagtacaaatggagccttctcaggtagatatgggaccaagttatcaaaagtaaagtgagaaggagaggaaacaaaatctatgtggggaatctttacattaaatggtaaaatccatatcattaagcccaaagtccagcgagacttattcttcaccatcttcccaatcccataatccattctagttggatttctctaaattcttgaagcatgctatgttccctctt

SEQ ID NO: 6957 - DNA, 280 bp, artificial
  synthetic oligonucleotide
gactaatttgtttaaccattcagtgctggccaaggtacattgaaatactcagaggcattttaatagcctaactttctggaaggtaatttagcaatattcctaaatccttaaaattatgcataccttttggatcatttatcttatggcaatgaattttgttgggataataagatatgtagtcattgtagtgaaagatggatgtatgaggatgttcactttagtggtagtcatagtagccagtaattagaaataatctaaatatccaattagataagaataa

SEQ ID NO: 6958 - DNA, 1924 bp, artificial
  synthetic oligonucleotide
tctcatgagctatgacattaaatttatatctatttaagtcactgacagaattagaaccaagtgtacaaactctaaattacaggaagggcagagaaaacatcagatcaaaaaattactaagtattacatttactaatctacagctgagatttcagaagcaaatgcatgttaaaaatgagatcatggcatgatacctcttctgctcatctgaagaatgaacataatttattttatatgttattgatatgaaagtataaatatttgataatatgtttaataggtatcaaccatctaggctgaaggttggagataacaataataataataatgtgatgatgatgataatgatagtagtgggggtggttagaaattattgagtgcttacagtgtcctaggaactatggtaagtgttataatttcaatctctcagcacaaccagaagataccactattattatcccccacttatggtacagaaactgaggcatggggaatcagggcaagtaagtggtggctcttagacttgatccagatctgtttacatagcccacaatcatactatctctttggtggtggcatttcagaaagattcagtattactttggtgcataatttttaaacactaaatctacaattttaaatgtaataattatttaaattatatggcttgctaaggtttgaatatttttgtcccctccaaaatttatgatgaaagttaatccctattgtggtggtattgggaggtaggggccttttggagaaatggttaaatcatgagggctcagccctaataagtgtatttgtgccttgtaaaagggccagaggtaaccagcttaggcccccttttgcccttctgtcccttctgccatgtgaggacacagcatccttcctctctggaggatgcagacagcatcatttttatgtagacagcagccctcaccagaaaatgacactgctagggtcttgatcttggacttcccagcctctagaacagtgagaaataaaattctgttctctataaattactcagtctgtggtattttgtaatggcagcacaaatgaactaagacattcctctaggttaagaattagggttgggctttccttctagaaaattcttttggggttaatgtccaccactgattttcatagaggggtcacctgataggtagaaaaggcacagactctgatgccagataggctggggtttaaatccttgcttcactcactactctctactcatgtgaattcaggcaattcacttaactatagtaggtagaattctaaggatagcctcccaagattcccatcccatggttactaaattaaatactaatctaggtactgctacgaagggattttgaaaatgtaactaaggtcccaaatcacttacccttacatggggagataatctgggtgggcctgctctaatcacattagtcctttaaaaggaagaagtcaaaggctgggcatggtggcttttcaggtgtaaacttgtaacctcagcattttgggaggccaacacaggacagtttgaccccagagttcaagatcagcctgggcaacttagggagaccttgtatattaaataataataataataataataataataattagctgagtatagtgctgcatgcctgtggtcccagctactctggaagcttaggtgagcggatcacttgagcctttgaggttgaggctgcagtgagccgtgattgcatcactgtactccagcctgggagacagagaccctgtctcaaaaataaaaaattataaaggaagaagtcaaagggattggaagcataacaaggatctgacataccattgctggctttcaagactgagggaccatgagacaagaaatgctcacagcctctcaaagctgagatagacctgctgtcaacagccagcaaggaaacagg

SEQ ID NO: 6959 - DNA, 1231 bp, artificial
  synthetic oligonucleotide
gaaaatcctagaaacacaatatggcctgaactaccagtaggctactcagaactatattcattcctttatgttcttctctggatcccagcagctagaagtttggtaattacattttccagacaccttgcgatacagttcagggtgagctcacacaaatgagatatattcacaaggcctaagagaagccaaagtccaatatggtgatggcaggcagatgaacagccttgggccagtggcccatgggaggtgttgctagatgcttccaggtacagtaggtatctgagaccatcaatggtgcctgcctgctgttattatcttcctaatttcttgaatgctagttgaagtccttttcaattctttagaaagcctctcactcctgtaataaatctttcttcttgaaatatctaaaggttttatgttttcccaactgaatccttgccagcgcagaatggcttagtcataactcaggtgcactgtcggtggaagggccaaagggggttaactggcctccatagaagcagttcaggtaccaacagcagataacaagcaaaggttcaagaaatcagactgagtccaacataagggatggcaattgtcaaggagggacctattcagagctggctatcaaacgcaatattctagctcctgggagaaacagcatccactaaaattcaaaattcagtgttgacatttgagatagtgatgcacttcctcttcaccccagatacgaatttagtgcaagtacgatagagattgtgtgtaaaccaacacatggtactcatggtgtcctggttggtgatgcagaaaatatggactatagtgttcatggtgctgataatccaccagaggctgacagcaacagtgaaggaggtttcctggaaggtgagaaagcactgggaaaatgctgctttcatgtctggttcactggtgttcattttgtaaaataatgctagcatatagagaatgtttactctttccattacatgagaatgtggtgaattaacaaacctgaaagaagaccagacttaggacaattgctgaggtctgtatccattcatccccaagttcccctgccctacagctatgctaatacacactctgcttcccttggagattacattctcactctttgttgtctttgtagaattgctgatcacatgaataaaatgtttatgttaattcatgacaaaataaaagtgctgaacagaaactcacttaaactcttctggaa

SEQ ID NO: 6960 - DNA, 9291 bp, artificial
  synthetic oligonucleotide
actgtcactactgccttatctattggccaaagcaagtcaaagatctaaacatcagggggcagcgtattacgtactctcccctttttgtgcatggaacttcaaattctacaagggtgtggatgcgagggtaggtgaggaatcagagccaataaaacaactggcattactaatttctgcttttaatcttatcttctcgtgcacactgttctctatcatgaatcctttccacttccataggttcaactgtcatgtctattaagagaatgttaaaatggttatctttagccctcatctctctcctgaactttaatcctatgtgtttggtttaaaatcatcaagcagtatgatattggctgtaggtttgtgataaatggatcatgtcctttgcaggcacatggatggaactggagctggaagtcactatccacagcaaactaacacagcaacagaaaaccaaacactgtatgttctcacttataagtaggagctgaacaatgagaacacgtggacacagggaggggaacaacacacactggggcctgtcaggtggtggggttgggggagggagagcatcaggataaataactaacgcatcctgggcttaatacctagatgatgggttgataggtacagcaaaccaccatggcacacgtttacctatgtaacaaacctgcacatccgcacatgtaccccggaatttaaaataaaaataaaaactttaaaaaattaaaaataaaataatcatgcaacatcccagccccaaataccttaacctaacattttaaaacctgaaattatcagtatcttccttacccacgcactcatccacaaccaaaatcagtttgtcctcctgtcttcaattttcttttctttcttttcttttccttgacagggtcttggtctatcacccaggctggagtgcagtggtatgattatagctcactgcagccttgaactcctgggatcacatgatcttcccgcctcagcctctcgagtagctgtgactacagatgcataccaccacacttggctattattttcaattgtttttcgtagagatggggtcttctatgttgcccaggctggtctcaaactcctggcttcaagcgattttcctgccttggcctcccaaagtactggaattacaggcatgagccactgtgcctggcccaattttcttttttttttcttttttttttttttttttgacctactgtctttcttggtcagaatttaagtattggaaaggcacatgtctactccatcagagtaacagtgccttccaactaagggatgtttctttgctttctcccctcaaaaaaatctcttcctcaaggcctcccttgcaacagtgcacttttttttttttttaaattatactttaagttttagggtacatgtgcacattgtgcaggttagttacatatgtatacatgtgccatgctggtgcgctgcacccactaacttttcatctagcattaggtatatctcctaatgctatccctcccccctcccccgaccccaccacagtccccagagtgtgatattccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcattttttatggctgcatagtataccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctccccagcacctgttgtttcctgactttttaatgactgccattctaactggtgtgagatgatatctcatagtggttttgatttgcatttctctgatggccagtgatggtgagcattttttcatgtgttttttggctgcataaatgtcttcttttgagaagtgtctgttcatgtccttcgcccactttttgatggggttgtttttttcttgtaaatttgattgagttcattgtagattctggccaagtcaatcctaagccaaaagaacaaagctggaggcatcacactacctaacttcaaactatactacaaggctacagtaaccaaaacagcatggtactggtaccaaaacagagatatagatcaatggaacagaacagagccctcagaaataacactgcttacctacaactatctgatctttgacaaacctgagaaaaacaagcaatggggaaaggattccctatttaataaatggtgctgggaaaactggctagccatatgtagaaagctgaaactggaccccttccttacaccttacacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcacaaccttctcatctgacaaagggccaatgttctttaacagttagagaattgattttatatatatatatatatatatatatatatatatatatatatatatattactttaagttctagggtacatgtgcacaatgtgcaggtttgttacatatgtatacatgtgccatgttggtgtgctgcacccagtaacttgtcatttaacattaggtatatctcctaatgctatccctcccccttcccccaccccacaacaggccccagtgtgtgatgttccccttcctgtgtccaagtgttctcattgttcaatttcgacctatgagtgagaacacgcagtgtttggttttttgtccttgcgatagtttgctgagaatgatggtttccagcttcatccatgtccctacaaaggacatgaactcatcagtttttatgactgcatagtattccatggtgtatatgtgccacattttcttaatccagtctatcattgttggacatttgggttggttccaagtctttcctattgagaatagcgccacaataaacatacgtatgcatgtgtctttatagcagcatgatttataatcctctgggtatatacccagtaatgcaatggctgggttaaatggtatttctacttctagatccctgaggaatcgccacactgacttccacagtggttgaactagtttacagtcccaacaacggtgtaaaagtgttcctatttctccacatcctctccagcacctgttgtttcctgacttttgaatgatcgccattctaactggtgtgagatggtatctcattgcagttttgatttgcatttctctgatggccagtgatgatgagcattttgtcatgtgtctgttgactgcataaatgtcttcttttgagaagtgtctgttcatatccttcacccacttgttgatggggttgtttttttcttgtaaatttgtttgagttctttgtagattctggatattagccctttgtcagatgagtagattgcaaaaattttctcccattctgtaggttgcctgttcactctgatagtattttcttttgctgggcagaagttctttagtttaattagatcccatttgtcaattttggcttctgttgccattgcttttggtgttttagacatgaagtccttgcccatgcctatgtcctgaatggtattacctaggttttcttctagggtttttatggttttaggtctaacatttaagtctttcatccatcttgaattgattttttataaggtgtaaggaagggacccagtttcagctttctacaaatggctagccagttttcccagcaccatttgttgaatagtgaatcctttccccatttcctgtttttgtcaggttagtcaaagatcagatagttgtagatgtgtggtattatttctgagggctctgttctgttccattggtctgtatctctgttttggtatcagtaccatgctgttttggttactgtagccttatagtgtagtttgaagtcaggtagcgtgatgcctccagctttgttcttttggcttaggattgacttagcgatgtgggctcttttttggttccatatgaactttaaagtagttttttccaattctgtgaagaaaggcattggtagcttgatggggatggcactgtatctataaattaccttgggcagtatggccattttcatgatattgattcttcctacccatgagcatggaatgttcttccatttctttgtatcctcttttatttcattgagcagtggtttgtggttctccttgaagaggtccttcacgtcccttgtaagttggattcctaggtattttattctctttgaagcaattctgaatgggagttcactcatgatttggctctctgtttctctgttattggtgtataagaatgcttgtgatttttgcacgtcgattttgtatcctgagactttgctgaagttgcttatcagctgaaggtgcaatcaaactagaactcaggattaagaaactcactcaaaaccgcccaactacatggaaactgaacaatctgctccttaatgactactgggtacataacgaaatgaaggcagaaataaagatgttctttgaaaccaacgagaacaaagacacaacatagcggaatctctgggacacatttaaagcagtgtgtagagggaaatttatagcactaaatgcccacaagagaaagcaggaaagatctaaaattgacaccctaacgtcacaattaaaagaactagagaagcaagagcaaacacattcaaaagctagcagaaggcaagaaataactaagatcagagcagaactgaaggagatagagacacaaaaaacccttcaaaaaatcaacgaatccaggagctggttttttgaaaagatcaacaaaatcgatagaccgctagcaagactaataaagaagaaaagagagaagaatcaaatagacgcaataaaaaatgataaaggggatatcaccaccgatcccacagaaatacaaactaccatcagagaatactataaacacctctatgcaaataaactagaaaatctggaagaaatggataaattcctgggcacatacaccctcctaagactaatccatgagaagttgaatctctgaatagaccaataacaggctctgaaattgaggcaataattaatagcttaccaaccaaaaaaagtccaggacaagatggattcacagccgaattctaccagaggtacaaggaggagctggtaccattccttctgaaactattccaatcaatagaaaaacagggaatcctccctaactcattttatgaggccagcatcatcctgaaaccaaagccgggcagagacacaacaaaaaacagaattttagaccaatatccctgatgaacatcgatgcaaaaatcctcaataaaatactggcaaacagaatccagcagcacatcaagaagcttctccaccatgatcaagtgggcttcatccctgggatgcaaggctggttcaacatacacaaatcaataaatataatccagcatataaacagaaccaaagacaaaaaccacatcattatttcaatagatgcagaaaaggcctttgacaaaattcaacagcccttcatgctaaaaactctcaataaattaggtattgatgggacatatctcaaaataataagagctatttatgacaaacccacagccaatatcatagtgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtccctgtttgcagatgacatgattgtatatctagaatatcccatcgtctcagcccaaaatctccttaagctgataagcaacttcagcaaagtctcaggatacaaaatcaatgtgagaatcaattttctttaacagttagagaattccagttaccttagaaaaaaattcgaggccattgaattctcctatggagtctgcatctcttacatctgcctgtttctttccagcccccatggccattaccttgatttccacctatgcctctagttgtctatattgaaaacgctaagtaagattgtcctgtttctccccaataacaaaagtagaaccagcaagtggagggggagggtgtggaaaggcagatttgggttcaatagtagaaacaaccacggtactcaaggagaaaacaggaatggcggtataatgggtagaactcaggttttagcatcatacagtctgggtttataagcaggctctgacacttattgtgtattttagagaaattatttaaccattcatgccttggtttcctaaaatgtaaaatggagctaataacagaatgtagcttattagggtactgggaaaattgagttaacatgcgcaaaatatatacaaattcataaaatacaagtactcaaaacctgaagctattatctctcttattattataataaaagaagtgatgtagttgcacattagggcagagattgctaactagtaggcagaatattctttcctcctctttctgagtaatggattagtccacactgtatttcctagcctgccttgcattgactgatttctagtcaatggaacatgagaggaagacgtgtgtgttattgccggattttacccagataaacctcctatacatgttcctccataccatttccctatttcagctggctgaaatggagggagcctggtatagctgtggaaacaatatactgaaagtgacaatcatgccatcagttgatatcctctcacagagcagagctgggtctacctgcccactcccacaaccccaccctggtctagcttgaactaccctagattgttatggatgcaaaaattaaatttctattgctttcagccattggatgctttggtctatttgttgtcttattctaaccttagcaccaatgacatttgggactggataattcttggtctttgggggaccgttctgtgcactatagcagcagtccccaaccttcttggcaccagggagcggtttcatagaagacaatttttccaaggaccggaggggaggaggatggtttctggatgattcaagcgcattacatttaatgtgcaccttatttctattattccattgtaatatataataaaataattatacaactcaccgtaatgtagaatcagtaggagccctgagcttgtagatggtcccatctggggatgatgggagacagtgacagatcatcaggtattagagtctcataaggcatgtgccacctagctcccctgcatgcacagttcacaatagggttcatgctcctaagagaatctaatgccgctgctgatttgatgggaggcagagctcaagcggtaatacaagtgatggggagctgctgtaaatgcagatgaagtttcactcatatgtccatcactcatttcctgctgtacagcctgattcctaacaggccatgtaccggtactggtccatgaccagaggattggggacccctgcattgtaagatgtttagaggcatccctatctactaatgccactagcatcttccctgactccggttgttggcaaccaaaaatgtctccagacattgtcaagtgtcccctgaagagcctatcttaccatatactcatcttactcatcttcagaggtattcacaatactgcatgcatgatctctttccaggggtggttgagcaggaaatcttgagatgttgaagtctgcccataatctacaatccttttcaactctgcaattgacactgggacttttattggtggaaaagatcatagacacttgttggtgaatggattattagagttcatttgattcataaggaaaataagactcagaggtgttacacaccatgcagaaattaggctcccaactcccatttaaattctgcttttactaccccatactgcctggcataagactgagtgaatacattgttctgctttatcattgcacaactttctcatccaataaattaatctaatttatattttatagttcagtccaaagaaaatgcccaaataaagatgctaggagtggagcactgaaggacagcagttattcaccatgtactgtgtacaaaaacctatcaattctttatttataatgaccaaaatttacagaggaaaaaatctacgtaagcataattaatttacgtcaggctctatttacccatgttgttagtaaccacatgggcccctccatgaagaactgatattaaccaggctcaccaacctgcttatcctcaaaaggctggactaattctcaaggcactgaggatcagaaaagtaacagagagctaatcttttctggtattgatacctatggcagggttcaaaaatataaaattccttagtccatttcttaacattgagttctcccagaagcagagagtgagataagaatttgcatgcaagcagtttaattgggagaagatcccaggaagcactgggaaaggatgaaagtgagacgaggaagggaaggtgaccaattcaaatgcattaatgagctggtgactactgtgggcacctgggacttagtccttctgggggcctctgggagattgggtaaagcttcactctgagtcatcccactcaaagggcaaggaagctggttgtgttaagtgttgctttctaggtgtaaccacttccagacttccctgctgtcctactgtcagctgtacatgagtagggagaggtggcagagaaagccatcaagtcaaaagttgccaatgtttgtagtataaagccttcaggctgaagcaggcaggacaccagaagcacctgctgtggctgagaattaaatcactgaccctcccctcccctcaccttgcatttctccccagcttcagtagttgttttcctttgggttcatttctacattcagggaa

SEQ ID NO: 6961 - DNA, 1749 bp, artificial
  synthetic oligonucleotide
tgagacatgaaaaaggatggttaacaatgtaactaaactttcttcctttgcagacatacttaaaccacgttaaagcagagataaaacaggctctaacattgaaatgggctcataattaggtgctaatgttgaatatcctgtaatgtttcaaaaagacacagatgcagaaaggccaggtctgcacaaggcaagagagaaaacgttgcatttatgaatgcaaatatgttacagatatccaagttcaccagtctatgccttactgatacttcttgctttttggcatctcctctttaatttccaccacttaactgattcacacctgggtcagaggcaaagccgtcttcctcatctctctgatgagcctctccactctttgcatctcccattgctaatctgtcttgtccccctaccattgcaaatcatctcaacttttggcttaagaacctatgagagtagcaggcagcccaggatcgaggtcatccttgcatcaaagccttaaaatccgattctacataatccagccaagcaagagattccaaaggcaagcacgagaatcattaataatgaagtagtcttccaatctattcaagtcaatcctcagtctttttaatgcaacatttacattaaaacataaaaataatccctttgttttgcatttgtttaattcatttacaaattattccatataattagaactcaaagaaagtatcactgtctgccaacaggaaccaaattttcttttcagttcataagttttttaccctccaaaacctcatcttaaaaagttttgtgtttgtgggtggttataaatgtttttctaatctagagctcaaagaaaatgtggccaaaggatactgctttgggtaacctcaggaaggaagaatatctccaaaaatattaaaaataaaaaagcagatcatagctcttaaggcccagtatgctaaatcctcagcgagcctggatcatgtaggaacgagtaattctagataagcacacatcctggatagctcagggttaacattctaactatcttattgtaagagcttctatttctctaatggagacattttcatgtcttttaaaaccattgaacagtttgtcttataagcataattataggtgaaaatacagattaaataaagagctgattgaatctgtcatgatattaccacatgaagcaaatgtctgcaggcatccacactgacaatccattatgactgttatatcttttcaatatggcacccagcgtcctggtaggcctaatataaggggctgctggctgcccctccagcaaacgttagagcagttcctgactctacttcttcattgctgctctcttttccactgtcaacaggaagggcaaactgctgtccctctgttgattctcacttctaccaccacatggccatgggtgcccaccttgaggtcccaggtgaccccagtactgttgccactgtgatctctaccactctgctcctctttgctttctccatccttagttctcaaaatgagcttttcatgcacctatcaccactggggtggaatgtctttttccttctataagacaaatccatgacggaagacactgctgggtaaaaacacatctggatcccaattctacttttaaggagaatttcttttttctttctttttaaaaaaattactagtcattcctgcaggttggtatcctacaaatcaagggtttactgtatgattattacatatccataagaaaaaaatgacaattta

SEQ ID NO: 6962 - DNA, 2276 bp, artificial
  synthetic oligonucleotide
ttaatgtatccaaagctaagggaatttggatcaagtcattttcacttaagcacttatgtataatttgaaggatacacatcaggaaacagaaaatatcaactttctcattgaccagatgcgtttaaaaatgtctcagtgaactggcatcccttcatttccgatcaggtagagagctgtgcattcataaaactactaggcttgttcttaagcaaagcttgctgttgctagctcttgctgctcttagaagtgggagcaaaaggtttgattctatagggctgtcctgattgtaactatagaattaggaagccctctatatttcttgatgaatcatattttaagttatttgtatactatgataaaatgatttttaacttttaggaatattaacttgaggccttaatagatggtccccagggttaatattcatttgaaatgctaatatagagaaattctttacattaatgattgtcaaagtatagtccctaggagagaaatgtcaatcttagctggaaacttattcaaaatgcaactgtttgaaccccaccccggacctactgactaggcactctggagatgaggccggcaatcagtattttaacaagccctctaggtgacttcaatgcactctcaagtttgaaatccactgctttatataatacacattgctcatctgggataatacatacagagcaatttatgttgagaaatagctcttttcttctttttgatggtgtgttgttttttgtgtgtttgcttgcttgttttgtattctgataaaagtaattgaaaatgtttaatataaggatttttgcctatcccagtatggttatgacacaagatcacttggttcctgataaactaaaaagtcattgtaaatgttgttttgaagaacaacctaattaaaatatattttattagcagcaataataagaggatgactaatttgaataatctagcaacttgagactggggaaacaatatggcttagagtcagagggactttagtccagcttaaatcagggttactcaatataagcattattgacctttggggccagataattctatgttgtaggggtgctataggatatttggcagcatccctggtctctacccactagatgccaggggatgccccttctcagttgtgataataaaaaatgtcccattgtcagatgtccccttgcgggggcaaatagtccctacttgagaaccactggtcggtccattgggggttctcaacctcagcagtacagtagaatcaattaatactgatgcccggccaggcgcagtggctcacgcctgtaatcacaacactttgggaggccgaggtgggtagatcacctcaggtcaggagttcaagaccagcctggctaacatggtgaaaccccatctctactaaaaaaatacaaaaattagctgggcatggtggtggcaggtgcctgtaatcccagctactcaggaggctgaggcaggagaatcacttgaacccaggaggcggaggttgcagtgagccgagactgtaccactgcactccagtctgggcaacaagagtgaaactccatcacaaaaaaaaaaaaaaaaaaaaaaaaaagaaaagaaagaaaagaaaagaaaagaatactgttgctcagactggttggattgaacctctgtggataggctcagaatcagtatcttttcaaagctcggtaggtgatacaaaggtccagccaagactgccaaacactgtacagacatcccagtgcatccatacccttacctgggagagagctgtaataccatctattgtaactatcacacaagatcagatgagagagcatttatgaaagcatttataccacaaggcaattagtatgttaaaggcagcagagaaaaataatgtacttttcaaagttgccattgaaattgaaaaatatatccagctctctattatgaattaggatggtttatatttactgtcttttagattcatatcccattcccaataggaaagagatgtgatgcattctctatgtctctcttgggagtagattcatgatattattcagtcttcgatgggcagaaaaccatacaaattggatcaaatcgttcatactatgcaccagtgatgctctgaatatatactataaaatcaatattctttctattcttttgcctctcaataaccaattttaataagtggaaaataattcagattcctctgacaatagcctctttagaaagaatggggaaaattcttgggttacaattgtgtcaatgaaagggattcttta

SEQ ID NO: 6963 - DNA, 4046 bp, artificial
  synthetic oligonucleotide
tcttttcaaatgggttattttgaaaccaaactgagatagacacagcttttcttctgaccctttaagatgaccttcctgaaaattatttttaattggttgttcagaatccatatagactgttgatatacacacagctttcctttgtaatgctccaagttgaccttccctttaaataaatgtattacctgacatgcaaattgtccctcttgaacatgtccttcaaatggacactaatgccagccaacaaccaagaagctgtagtttccttcctgtgtgaatattaggtgtgagaagagttcacagctcacggctttggcagagccaatatttgacttgcagtgttccccggcagaaaggcagaagaggccttacctttgggaatggtgatctgacagctcaggtcacagtcctgttgcaactgataaaaagccacttcctgcagccgggccctctccagctctgagagactctggatggggactgacctcagccgtacactgcggcctgacatgctgttccaggtgaaatcaccctgtaggccaaaaaaaaaaaaaaaaaaaaaatcaagagttacagagttcacttacctctcacaaatctcatcctctcttagtaataaagtcaagcaaaccacctttgtgttccaaaattgggtctcaattcccaaagtcaaatcctcttttagttcactgtggattttctcagttagttgcaaatgtcaaaatctcaagtatctgctgggtcacatgatcttatctcattatgcatataggcctgaggaaactatgtagaaagatactgtgagggtcctacttcctcctttttatgggaacacatgggaacttctaacttttgtgaaacactgtgctgctgctaattgccatcacacacatcagatatagggggatgagtgtgtatggagagcctaccatgtgccagcggctgcaccaagggcattttttaaaattggcaaataaaaatcgtacatattcatggggcacatggtgatatttctatacatatggttattagatatatatttctaataattagtaactaatctcaaacacttattatttctttggttgctaacattcaatatcctccttctagctatttgagatcatatattactgttaaccatagtcaagggctttttagttaatccctccaacaaccttatgaagtggttaacattttttacctatctcatgtaaaatttaataatataatctagtataatatatgagaatatattataatagtaaagtttatacttatgacatattatatgaatagtatagtaacatataccaatataatatagatgatgaaactgagtcttgaggaggttaagtaattctccccaaatcataaaacttataagatttggaataaggactcaagctaagaatgtagggctttaaactctatgctaatattgtaaccactgaggttctatttgtagcactctcatgagttattgtgaacacaataagcttagagttatgatcaacaggaagatgttcagtatttatagagacatttgatgctaaaatactccacatcaaagagtcaaagcaaagatttccacaatcctaaaagtgtactcatgtgtacacatgcacacccttgcaggccactgagggtaaatggctccaccctcaatgcagacagtaagaaagtgacgtccaaagaaaaagtactttacaatcctctgaaacccagtgtctccttactaaagacttcttgtgaatctcatgtatcaggcatgctgcaacagatttgaggaggcagctactgttgctcaatgatcaagaaagaaaagttctatcagggaaggagaggtactggcccacgcagggactcattgcaataaatggaacacttaacagaatcccataagacttcaccatcttaaagaagtcactcgcctggacgtggtggctcacacctgtaatcccagcactttgggaggctgaggtgggtggatcacctgaggtcaggagttcaagaccagcctggccaacatggcaaaagcccgtctctactaaaaatacaaaattagccaggcatggtggcgcatgcctgtagtcccagctacttgggaggccgaggcaggagaatcgcttgaacctgggagggggaggttgcagtgagccaagatcacaccactgcattccagcctgggcaacaagagcaaaactctgtcttaaaaacataaaaaagaagtcactcaccttaaagaagggagacagaaagactggtcccagcaacaaagtgccatagcactttgtttcacactggtgacaaattcctgtctagtgtattcattccaaaagtgaatggcatgatgttaattctttgatattttccctctttatctgggatttcattcactcatttaatacatgaatatattatactctggtaggggcagaaaatgaacggggtaagtaaaaggaatggtgtgtgaaataatgataactgctaggaaggagaaaaaggcaaagaaggggaagtagaagaaaggaatttgcagttttagagacagcagccaggaaagacctcactgagaaggcaaaatttgagcaagtgttaaagaagttatggcttttagtttctttgccttgacatgtatgaattatatccagtggataatgatgaagactagcaggaacccaggaggagctcagggagggtgatgcaggaggggatgtggggagaggagtgagtgagcaaatctagtcaaagtgaggaggctgcagtcacattcagtgaacagaagaaaattcttctggggccagtgtattttgaattttttctttcttttatgtttttggtataaccagactaagaaaaaataggacatatagacattatggttggggactcaggccttgggtgtacccctcactcacaccctctaagcttagagaactacaaggaacactattggggaattttttttattattattttctcccagatagaaagtccccagatgagtttataaattttagatatcaagcttaggtacctacgggagctgactgttatttgaagtgtcaaaacagaattacatacctattctttaaaagcaatcaaagatgtgacctccaatgggcttaattatctgtagtaggggtttgacaatctttttctgtaaagaccacatagaaaatatatcaggctttgtgagccatgtgatctctgttacaactactcaactctggcttggtgggatgaaagcagccacagataatttataaatcagcgagtgtggccatatgccaataaaactttatttacaaaaacagcaggctggttttggctggcgggctagagtttcccaacctgtgaactatagcttatgactgaaataaagtaattcctagaagggacattttgttcttatttactaagtcctcctggttaattaattcaaacaatatttaataagcacagatgagatgctaagctctgtggtaggcttgggactattaagatgacaacacagtcctcgtcctcagagttaaccttcaggtaggaagaacacaaacaatccataaaacacagagattgtggtactagaagtaagtactaaatgcaatgaatgcctaggagacaaggctttgttatctatctggaggatcaaggaaagctttatagagaaggtagtgtttcaatggaggcttgaaagttgagtaagagggggcagggttcgcccagtagcaatgcaactttagcagcaggtgcaaaggcaaatgagtttgagaaaacaggcttgttcagggaattacaaggctggaaggaggaaaagggcaagaggtgaagccaagcagaagtcagggccagattctgtagggctgtctctgttggcaatgcaaaccagattagattttcctccatagacgatggctagtcattcaggaactttgagctagagaggaacatgagcagatttgaaatatagggaagatgactggaaacaagtttcctaaggaattaaaggggagagcaagtcaaagatgtggagatgagaa

SEQ ID NO: 6964 - DNA, 2081 bp, artificial
  synthetic oligonucleotide
tcaactgccatgtccctcttcaccttcattgaattgaactagaaaagtcctaactcaaaagaggatatttggattaactaaggctggggaattaaaagtccgatatggtgtatttagcttaacagtgtttagataccaggatgtttatttttcatttaaaattcccagctactaacctcaaacggaccttttggcctgtcctgcaatcctgtgacattgctggcccgttagctgccctctcttccactcctctcctctttcctcaaacctccaggacctcttcgccatcctcacgcctagtggattaaattgcttcctattttgttggacgctgagacgcaatctggagtaaaatcccacgtgccctcccaccatcttctaactcacttgcatcagtgtccatataactaatgcccatctatcattatagtgtaaaagaaggtcaaaccctccacttgtgctctggatcccacccttgtggtctactctaggaaatcacccagtaatttcccaactcccccatcctcaattctttcctctctatggtaaattctggcagctgatgatcatgttataatagcattcatttgaaccctggaagcaccagactcacaggagagggttctacaaatagataaccacaaataaatccctatgatcatcctaatgtgacagagaacagaaatgtgagcttgactatgtgtccattttcattgtatcatgattttcattatatcctattaggtttggcatcatttctttaggctttaggtcctggctacagtatttattttcctgtgaaaattattcacacagtgaatctgaccctgttgagaacctccatttgaaggtttgcatggggatcaagtggccacatttagaccaaagctactgtcatagagcttgccaccagccacacattccaaggatctcagtaaatatttgatgtctatattcatatgcccaattcagtagcttcagaaaccctcatgcgatgcctgtttctttcaccagccacacaattccctctctcctctataaatgagaaaattatttgtaaatcattagttcctattttgacagaaaatatgaaaataactgctgtggcctgggaatatcttcaaacatttcgatagcacaaatctttctctggatgtgcggataaccacacagcctcagaaataattaatggagacagagcctctagtagacaagttttataaaattgtttttggtaaaggttatttgtttagtggactctttaacaagcaggaacaaagaaaaaaatcaactggatttaaaaacaaagccacagagagtatctgttccctgatatcttatctgatgtgcattcaaaccaagtttcaaaaacttttcaaagtcatcattctcttcactacaaattaagtttgctaacaatattgccatttttttttccttaggaatgaaaagaatgtctgtgcttattaaagggagacaaaactcttggcccgggccccacatgggccactttgtgagttatgttggagggagaacaggcctcatctccaccctacaaccaaaccaataccaggtaaggcaggagggcgtttctcaaggataagagcgacacggcctgacagtcactagtattcatttttcacaattgcctaagtgattttcttcttatttgagctgagggtctctatgtgtgagattagcatgaaaaaataaaacagggtggggatttcctcttggaaacaacatgctgtggttgtggtagtgaacaaaccgtgacaagaaagccaaaggtgcaaggcatatgccagtgaaatatgcatgtcttgtcagcccattggccttgtctatctctctcttctgaactctgtcataacctccaatggagtctcaggttctgcttcaagaaaaaacgtggccctaagactcactatccaaagaaaaactctggtcagtgtttttgtgctactctttctggtcaaagaactgagcctcctaccgcagaggcaagtcgcccaagctcacaggtgtgaggagtgacaggatgagttcacaagtcctagtctttagacctccaagccagc

SEQ ID NO: 6965 - DNA, 1664 bp, artificial
  synthetic oligonucleotide
tgatgattgcgctgacaattgagcaaacaataccaagaaatagagataaaagggatgtcttgatatcatctgagtcccgggacaagctatgtctgaagccatatttgcttgtggattgttcagctatgtgagccttcaaattacttaagctagtttgagttttgcattgcaaagaaaaatacgtacttgatgaacctttgatacaacagctttcaaatttgtctgctatttccttaacatgtgcagcacatttcttctctatgtggttgtcagaatgccatggtcaagacactcatttactggaaactctttttattcccatggctgaagccatccacttgcatactgtcctcaatctgtctttcccatcttctcccctagcagtcattccacacaagctctacttcagcaccactgtgcttctccctcaggtcttctcttccctcccttcctttcattcattgcataaatgttgagtgaatgcttcctgagtgccaggtattggatgctgggaattcagttacaaaccaaacagacaataatccttgtcttcatgaagctggtaacaaatatggaaagacgggcattaaacaaacatacaagaaaaacatagagaaacacaaggcaaagaagggcaatgagaaatgcttgggaagacgcagttttcaataggattgtcagtcccagagaagctgacattttagcagaaaactcaaactgatgaaggagttggagaaaatcattccaggtagaaggaaggaaaagaaagccaatgataaaggtcttgagtcaagagtgatgaggaggtctgtgaggctggaagagagtaggaaaggaggcgggtggtaggaaggggtcatagggccaggaccaggtgtcatggagtcttatgggtcataataaggacttctgcacttacttgcagtgggtggggatccactggagattttgaacagatgactaacatgaagcagcatcactctggctgctgagttgagagtagaatgcatggagccagagataaagcaaggagagcagagagggcctgctgatctacccagataagatgatgggtcctgaaccagggcagtgaggtgatgagaaatatttccacagtggacatagtgaggatagaggtaatagcattaatttattggatggagagagagagaagagagggagagggagaagaaaggatgacctcaatgcttggggcctaggcaactagaaagatggagttgctgttgactggtttggagaagctgcaggaggagaaggttgggggtcaagttttggagtgtggttttgatatgataatgtttagaggtttgcaagacatccaaatgaaggaggtatcttgtagatagttggcaataaggattcagagttcataggagaggtctgggttgaacatagacatttaagaggcacatatagatggtatttaaaaccctgtgaccagctgcagtggcctgggtatgaaaatggggagaagggaaagggcaggatatttaggtcaagggtgagattattctcttactgtataaattaaacagaaagacatcatttttactgtattttttccaaagatcatcacccaacagccatgtgctattataacagtttttaaaaacgtaacacctaaagggtgaaaatgagaggaa

SEQ ID NO: 6966 - DNA, 898 bp, artificial
  synthetic oligonucleotide
ttaaactacacaagcatgtgttattgacagataactgactacacaaacatgtgttactgatggataattgacttgccaatgcagccagcaccatctggcagtttagggtactgtaatttactataatttagccttacagtaatctattgtcactgcttcttgacttaagcaccacccctcagcctgccatttaagggcttctaccttcactgctggccagcctctttattgtgaccccagctagccaacatatttactgttatgtccaggtcctggtgcaagctccccaaatatccaggcttgtttatatcctccacagtcttcaaagttcactgcaaatccttcctcttctcagaagctatctctgagacttcaaatcacacctcttttccttctccaaactccaagtggattcatggtctggagcattgattcccttcctttgtcaacacaaggatgcctttttaatgtcaaaaatcacccagctcaaactcccacatgatagtaaatttgtgatatccaacgtggtagatctaagctagaggttcttaaccctggttgctcattaaaatcatgcaagagactttaaacaaaaatccgaatgtccagattgcagcctatgaaaatgaaccagaatctctgaggggtggcccaggcatagttgttcttcaggctcccaggtgattccaaggggctggtgagtctgacagccagtgggccagcacctattgtttggcattctacccttggaggcctcctccaacaagtctgaaagctcctaaaagcaagaatatactttgatattttaagctttttaaactcaaagtgtggatcatggaccagtagtatcaggatcacttgggagcttgttagaaattcagattcatagactacctcc

SEQ ID NO: 6967 - DNA, 1311 bp, artificial
  synthetic oligonucleotide
tcgatcacaaattacacctgtgatagatcaatgctcagtgcctgacaatgtcctggatagtcagtcaagggcaggtgaaggcttgcactcggggggaagtaagagagcacactgccttttataaatctacaattgtgccaattctgcaatggttactgcatatactgctcacgtttctcttttcattcttctgctggtttgcttaattgaatccccctctctctaaagatataagaatgtaatatcacttacattctttatgccaaaactgtaaaatgccttttattttcttggatatgtctcagatagcaaagaaaatgaaaattttacatttcctttttatactgtccccacaaacatctcataaacatgcttttgcataggtataacttgcgaggggaagtattaatatggagttgtctttgtcttcaaaaaacaaaacaaggtcggggtgcagtggctcttgcctgtaatcctagcactttgggaggcagaagttggaggccaggagtttgagaccagcctgggcaacataaggaaaccccatctctaccaaaaataaaaaattagctggatgttatggtgcctgcctgtagttccagttactcaggaggctgaggcaggaggattgcttgagcctaggagttccatgctgcagtgagctatgattacaccatgtcactgcactctagcctgaacgacacagcaaaaccctgcctctaaaaacaaaacaaaacaaagacaaaaacaaaacggaaaaaccccatcattgccatagtgtctgttaatcactgtgacaagtccgtaattatcttgcttgctcttccagctgggtagaatctatagaatatttaaaccaatccatacctcccgccttgaaatgaattgtctaagctttgctatcatgttattttctatgctattactttattttctattaatgactgtatgagtgccttagaacagcaggaagttattatcttatcacacagctgatatcaaccattatctctcactcagaacaacagacagcaaggagatgattccttttaccaaaatgtaaggctaataatacatttaagtaaattgttaagagagtctaactatgtagatcccatgttcagctccttcattttacacacacacacacacacacatacacacacatctgtgcactaacgaattttctataggtgaagaatatgctgctttcctcaaatgtttatgcctttttaaatttaatcaatgatgcagtattcaactgggtaccaataaagttttgttctctgaccaagtacactggagtgctgg

SEQ ID NO: 6968 - DNA, 925 bp, artificial
  synthetic oligonucleotide
tgtgatgtgaatctatcactaattttcttggtgacatgacaccaccttaagaaatgaaatgaacaagatatccaggacataatcacatttctctgtatatgcacacatacagcttcatatggacatgcaaaattaagagcatatagcatacggccacttatgacagggcatttctatagtccatataaattaagctcctttggaaggagaaaaaaatcccatgctacttatttatgcaagtgttttcaaataagtttctctatttgataagtgtaatgtaatcatacacaagcgagcaatgaaattagaaataaagacattgcatgttaggagcaaagtaggcaatttcataaggagcttttaattctgagagcatttcgaatggagtatttgaattgattttatctaattaatatgctaaattacagtgaacaaagaaagacaagtacaatcgtgtagggcatgtggacttgtagcatttccaagcagggaggacctttgggagtctccagtccaactccctcacttcacagacattcctaccatgtgaagtcacacacacaagctcgggtcaaggctacgtgtccagtcacttatgtatgcatcagaagggggagatagacacacactcaaacacacagagaaagaacatgaaaaacaatgcagcatacacttgtggcaatgtactctcctggaagaaaacatacaggttttgcagagaagagggattcatcagatataaagtcaggcctttatgttgtgggctgaaagctcaggtggcatatatagatttccagataagctaaaaatgacaagtgtgcagaattcacttgcaaaggctgccagcactttcccgggcattggacccaagttgcattgccatgttacctctctgttgtcctaagaaattgaaggtgctctcacc

SEQ ID NO: 6969 - DNA, 2381 bp, artificial
  synthetic oligonucleotide
tttccaacttcacgtaaatgccacaacaaactaggcatgggaaaaaccattccaagctgggggaagcaaaccttaggcataaggcacggagactgccatggttcctgaggaattgtgtgggaacagggattctggaaattgagctcagacaccaccgaggagaggacaggtggctctgcacaggatcaaataacttctttgttccagctaaggacctttgtcaaaaatgttttgcgttcctctttttccttttcaatcctttccaattacccttctccttccttttcctcatcccactttagtagacattaaaagtatgaggttggactgtgagtttgcagaacttaaagacgtcctccccacagtccctaccaaggcaagggcaattcattgcaagcagacggcacttgctcctccgcaagtgtttttctgcactcactgaaacttgccaagcctgcttgctgagcgaacaagcgagggggcaagaaggcggagggtttgcgctgaccattcgaagggggctctgcttcatctcccaaggctgtgggaaagggacagaaagttcgaaacccctcccctgcgctcttaaatggaaagctcacttcccccaaagtgtgcagggtggcgagcacccaacccacttagaagaaaaagtgaagagcttttccggttgcgatacagatgctaactttcccatccagatttattcagagctggtaaaagcaatagcattcctcttgaaatccctgcccttccaagcctattggcatgtttttccagccttgttttctccttatatgagtattgttcttgatatttaaatattgacataaaattcttccataactttgattgagttgtaaatcacaccctctccttggcttcctacatccactttttctttccttttcttgcttaacagcaaagctataaacctcttcctggactgataaggaattttatcatcatgccccagagccacagaagaagctgttggtttagaattcttttcaaagactcatttaagtaatcccccagccctttctccgctcactactttcagggctgccttctcacgtccagaagcaatacagtttccaaactgctagaacagaaaaacaaatttgcatttttctggaaggactgtctgtgctcatttcaagctggttccgccttctccgccagaaacacagtaagtgctcagaatgcgaaaccaaaatgagataagaggccccgtgaaattctttttcaggacattcagctgtctttattctagcccaaagcatagggtagaggcactaaaagctcgagatacatcctgcacgatacattccagcggccgcaaactggaattgatttacatatattctacaaactgcttgtaagccctttacaacgactgcctgacatcaaccacaattagaggcaaaagtgggggcgggtggcgaggaccagaccggggtggctcaggtaaaatgtgcttctttggttgtcttaggaaaatgcagccccgtctttccgccaaacgcatcgactacggccaggcgcctgctaacccagcaagctctccgcagtaacacgtcgcaggggtcccgggcggcgcccgccccctccgccgccagcgcaaccgcctgagcttacctgcctcatgtttagaatcccatgacccatccggcagggagcgagctgcatcggagcccgcgtcgcagtcttcagagcggaaacaccgaacccgacaggagcccgcaagacaaaagcaacccggcgaaatctacgggcagcaaagagcacgttttcgtcctctttttctttgatctgttgctacacgcactctgctcgagacaatgtcaagtttctcaaccttttctcccccagcctatgaaaagtcggtcgcagggaagcgaggaccgcctggctcttatttcaaatcagttctcagagacgttgtaggtggctggcttgggccgcggaggagcttcgccaatcagaagcaagggggtgggtcctgggagccagaaaggctgcctccgcgaggattaggggcgctttcgggattcaaatgactggaagcagctggaaacaatgtccaaagctccaaaagtaaaggatgagttctattcttatctaacagctctagttctgctaaaagcttaactagctaagggccttaaatccttgcattttaagagctccctaacagcattaaaacatttggaaggtgcaaaattatttcagccagaaaagttcaacactcaggacccaagggtatttttaaaaggatatcttgcactgaagccctacttttgcaaaagactggaaaggaaaccaaattgttatgagtaacaccttaactaaaacgaacaatccagaaaggagggtgt

SEQ ID NO: 6970 - DNA, 1672 bp, artificial
  synthetic oligonucleotide
tctgaataaaatattattcaatgtactccgaggcaggctttgtgcacaccatctcttttgatattacatataattgatatatcatatatcaattacatatatcaagactgaaaaacacaaggctgttgattgacaagcattttctttcctccagtactgaagtacgatagaggttttttaaatgaaaactctactaaagtagtttccagttctttgcactttgtagtagagaaaaagtatttcctaacacataaggctggaattgtagtttagcatccatttcaagcagctctctagaaatgtaaaaaggaaattgcaaaaatgagttcaaatcacaaaatataaaaatcccaagtgtgaattttctgaacaacaatgtgcaattaagaaacaaatagaggaagggtgggagggtgggggcttcaagggataagcaccttacgctgaagtctttggggacccccattgctaggcatctccactggattttccaggactctggttcatttatttctagacagctattttaccatacttaagagtcaaatgatgggagttttacccccattaacggaacttagtgtggacagcgttctaatggcatagaatggaatttggcaaaatcaacggccatttaaaatggttaacaaacctggataatatcaattaaatcattcatagaattttaacctaaattaaacattaccaatgtacatataagaagcatgttaaaacaaaacaaaacatccctcaactctatacatcacaagtattaatgtgtttcgcagactttttaaggctgggatgaatccaacttgaccatgtgtaggctgtctttggcaatcatatgattttccaaaacaattataaaaataaaagaaacatttgctcattgctactagtgtatatagtgtctccatagggtaatttgtgttgctggactaaatgctctgaacctttaaaaaaaacttatagttcacgacttagcaaggtctgccagttgtaagaaatgtggaagtcataatgaggactggaaggggaacttaagacccaattaatgtggtaattaacgtcagaaatagtgtctaaacaaaaaggtgaagaaaaaaggggtggacttgaacctttactgttctaaatactttctttttttattatcattttacatgtttagaatgaaaagcaaaatgtaaaaaatgaccatagatttaatatactagccagatttactgggtagtaacttactaatgacaaaggtatctttgtgctaatcttagtgtcttcccatccctgactaggatcaataaatgtttgctgaattgaattggagtacacactgacattaggttggcaggagtaacggaacattacaaagatatggcaatcaggtcacattagaaggcaacatcataattatatttgagtttacttttattttggatgaaaaaaagaatttctaatgcaattccattccagttcattatgtggaagtcttaattcaatgactacataccaaacacataataattcttcctcatgacacattccctggtatataagtgctcacaataatatccacgtaacaagggctacatacactgaaccaatttgaagtgtgttaggtataggtcagctttgaaagatcaaatattgaccatgagataaatctcaa

SEQ ID NO: 6971 - DNA, 8917 bp, artificial
  synthetic oligonucleotide
ataacacttattttacaccaaatagaatttagcctctggcatcattctatctggaggcaaagctaaggaaggcatccagtacgcgcaggatattagaacatgttcataagaaactgtcagaggaaggaaaattccagaaggaaaactaatttacagtccacaggacaaaccaagtgaatggaatatttaatcacacagcataaagaatcatttaaattacatggccgaattgcagatgtttaatacaattccagcaaaagaaaataaggtcaaaatattcctttagaataacttcatgacaactacttatcctttagatatgcctattaaagaccacacacatttcaaatgcgatgatgcttgaactccagtttcttcttttctttttctatcatgatattgaacattaaaagtgacataacaggaaaaagaataaaagagccctaaatcatgcaaaaattaaagcaagacaaaatgagagtcgcctgtgaaaatatcggaatgttctacagagaacaattttgggcataattttagttataggttagtgtacaatttcatctgatacatctgatttgagctttgcaaacctagtgtaaaagaatcagctgggcatcattttgaaagaaaaacagtagatgtttgggtctacgctccaatatttgagttaaggagttgtaattcgcagagcaggaggaatttccatttcaacaagcaacaaatgtttttaagcctgcaggtgatgaatcattaggacagtcaggactagcctttaaaaaaccaaatagaagaggagaaaagcaaatagcagagtgcattcctggtagaaaaggcaagttgggttttgtaaaaccttttgtgtgtgtgcatgcgtgcacgctgtattgtgatgtcatatatatttcttactgcgggttacagtaaaaaaaaaaagaaaaaagaaaaacactgctctaagttaggtgttcctaggctgtgatctgtgggccaaatcagcatacagcctgtttgtgtaaataaagctttattggcatactaccacactcattggttacacataatctatggctgctttcttgctacaatgttgtgcagaagtgagttgctgcaacagagaccgtatggcaaagcctaaaatatttgttatctggcccttgacagaaaagtcggctaacccctggcttaaatgattacagtcagatggccctgatttgcagcacactctgaaacactgtcctacttgtcacagcacttcaaactcagacacccagcatggagcgaagtacttagttttctattagacaacactttttaatgtattatttttaaaagttgacaaggtgaataaaatttgatgtttaaaaaaattagatactgacacataaaaagattctgtatgtgtctgccttaatgctgcaagggaaatattttccagtcaactcttcatttttcctttgggaagtgagattaccacattgcaacttttggaatttactctctactagtcatggaaatagtttgcctgctggaatctccttttagcagggacacagggctgtttatatcattttatttgctgtttattataccttacacattcttttaaaagccgctttattttgcttgaaatgcgttttaaacacttatttttatataaatctttttatatgtatgtaggatacacaacccaaaacaattaggtccaaacaatgcatcctcaattcacacaagtatctgaactgaaaatgaggcctgttctcaccatctctttaaggccatggagagctcaacatttagtccaagttaattttcttaaacttttaagatttagtgtacataaaaggcagtgaagaaaagggacccttattttgttgagctttggccttcagaagtctaccatagatctctgtgtctgaacattaaatgaatgaactcaatctgaatttagctctttgtgtgttgacatgaaacttatccccgactactgaaaaaaagaagaaaattcttttccagggagcctcatggcttaagactctccagtccgcccacctataaaggctgtcgagttaatttgtttcagagaatgtacaatggtccaagagcaggaatcatcagtaggtactaacgtgtaataatatcacctgcttggtgacctcgtcaattgcagaatttgaggtgagtttgacagctgagtgactagtgtcagagatagacaggggcaaaataaggcagttgatgaaactcacttttgtgatctccacaattctgcctggttcttgctccacctgcccacttccaattgcttgtcagaaggccccaccatccgttctttagactcaatgccctcagttgccactgccatcctggggtgcagggacccaagtcccccagtgaaccccaagtccacacttgccctccctgtctggcacctcagatttccacgggttggcattcacacccttcctcttaaaaacaggcctctgacacaatatgccctggctagggacttgagtcactgtgagtttcagggtttggaatgaactagtccttggtcatgtgccaaagtactagctcaagagaaaaggagtgcggccctcatctttcccaagtaacatctgctttctaagattgccttctgagataatgttgctgagcaaatgtatactttttaaaaagtgaagcattccatacatacaaaaaatttaagaatataatgaactgtcctgtacatagtaccaggtttactaaatctcagtattttcatcatatgagcttcagagttttcaaaaggaagtaaaaaagatttttttttgagacagggtcttgctctgtcacccaggctggagtgtagtagcatgattacggatcactgcagctttgaccttccaggctcaagcaatcctcctgcctcagccacctgactagctgagatcacaggcacatgccactacacccggctaatttttatttttatttttattttttgtagtgatggggaaccactatgttgcccaggctggtctcaaactcctgggctcaagtgatcctctcgccttggcctcccaaagtgctgggattataggcatgagccaccacacctggtggtaaaatattattgatagcattaaagcctctgtgtggcactttataatctcactcatgtctctctccagaagaaaagaccctctcaaatttagagctgatcactcccaaacatgtttatgtacacatacctaaacaatgtatgggattttttggtagtttattaaattttatataatgcttgtacaaataattatataactttcttctgtttttgtgatttgtccgtgctaatacatatcaccctagttcattaattttaatttctgaagactttttcattatataatacacaatttatatgtctaataaacagctgaattgagatagaatttacatatcataaacagtacatacttaaagtgcaaatttgacactttttcaaatatgtatgcacccatgaaacagtcaccacagtcaagataataaacatatatatcatgccccacaatttactcctgcccctttgtaattaactgtgcccatcctttcctgtcatcccatccctaaaagcaatcattgatttgctttttgtcactgtagattagtagaaagtgccgtttctcgaatttcatatgaatctactcatacagaatatactactttctgtctgactcctttcacgcaccttaattatactgagatccatccatgttgttgcattataactagtgtaactagtttattcctttttattgccaaagagtatttcattgtgtgattatgacacaaattgtttacccattcatctgttgatggactttgggccatttctagtttggggctattacaagtaaaattaacatgaaatttcacctacaagtcttttttttttttttttttggatagggtctcactctatcacccgggctggagtgtagtggcatcatttcagctcactgcaacctctgcttcttgggctcaagcgattctccagcctcagcctcctgtgtagctgggattacaggagtgagccaccaacacctggctaatttttgtgttttttgtagagacagggtttcaccatgttgcctaggctggtctcaaactcctgagctcaaagcaatccacctgcctcggcctcccaaagtgctgggattacaggtgtgagccaccgtgaccagtctcacctacaagttttgtatggacatagctttcctttctcttggtaaatacctaaatggctggatcatatggtaagtgtatgcttacttaagaaactgccagctttccagcatgtactactttaattcccacctccagcagtttgtgagaggctctggttccttcacatttttgccaacacttggtatgcgccatcttttgaattttaattattctagtaggtaggaagcagtatctcattgaaatttattttgcatttcattaatgactaatgatactgaaccatcttttcacgtgcttatttaccatctgtgatggttaatactgagtgccaacttgattggattgaaggatgcaagtattgatcctgggtgtgtctgtgagggtgttgccaaaggacattaacacttgagtcagtgggctggggaaggcagacccacccttaattgggtgggcaccatctaatcagctgccagcgaatataagcaggcagaaaaacatgaaaaggcaagactggcttagcctccccgtctacatctttctcccatgctggatgcttcctgccctcgaacatcggactccaagttcttcagttttgagagtcggactggctctccctgctagcttgcagacggcctattgtgggactttgtgattgtgtaagttaatacttaataaactcctctctctctatatatatatatcctattagttctgtcgctctagagaaccctaagtaatacatcatccacacctcttctttggtaaagttttcaaatcttttatgcattttggtgaaaggcttgttttcttattaatgagttttgagaatttgttatatattctggatacaatcctttattaaaataaataatttgtaaatattttcgcctagtttgtggttggtcttttcagtctcttaacagtgcattctgaagaggtttttaattttgatgaaacccaacatataaatattttcttttatggataatgcttttgtcatctgtatgtaaagaatctttgcctaacccaaggtcaagatctcctccacgttttcttctaggagttttacagcttttaccttttacatttagatatataatcaattttgagtaaagtcttgtatataatgtgaagtatggatcaaacttcatattcttacatacagatatccaattgctccagcaccagttactaaaaagacaatcctttctccactgaaattgcctttgcatctttgttgaaaatcacttgtccatatatgtatgaatctacttctcaagtctttttgctgatcctttgatctatttgtctatctttatacaaataccaccttatattgatttctgaagccttataataaatcttgaaatcagctgatgttagttctccaactttgttattattttcaaagtttttttttttttttttgagacagagtctctctctgtcgcccgggccggagtgcagtggcgcaatctcggctcactgcaaactccgcctcccggattcacgccattctcctgcctcagcctcctgagtagctgggactacaggctcctgccaccatgtctggcttattttttgtatttttagtagagacggggtttcaccgtgttagccaggatggtctcgatctcctgacctcgtgatccgcccgcctcggcttcccaaagtgctgggattataggtgtgagccaccgcacccggtctatttttcaaagttttaaatgattatgctatatcctttgcattctaatatgaactttagaatcggcttgtcaatttctgcaaaataacctgctggaattttcattgagattatgttgaatctacaggttgatgtggaaagaacagaaatcataacttttctgagtctttaccccataacatgatacatggcttcattttttagtcgtctttaatttctctcagcaatattttgtagttttcaaggtctttcaagtctcacccatcttttgttagatttatcactaagtatttcatatttgtgaggctgttttaaatggaatttctttttttaaatttcaattttcaattgttactaatatattgaaatgaaattggcttttgtattgtgatcttattctatgtcagatgtttcagtctttgctttatggttgtttttttaaaattgtttggtctaaaaagaaaaatccctcctactctgggatcatatgtatgttttctgttaatgtggttctgttaacagatattctgtagttgagccatccttgtattataagaataaaggctattttgatgtgtttaataaaacactgatggattacattttctcatattaaaaaaaatttttgtgtctatattcatgggtgatattctctcactctagattttttaatgttgtatgtatttggtatcaagatcatacactctacataaaatgtcttttttctattttctgaagtagtttatatgagaatgagattattagttcctggaacttctgttaaagtaagctatagaactgtgggaggctggtgccattttggggcagaaatgcaagttgatggacattttcaatgacttattaaatgtcttctgcttttaaatttttggtttattcaggttttccgctacttctttatgtaagttttcaaattattggcatgaagacatttacacaattttcttatgtttaaaaaagtctctactgtatttatggtatatttgtttatggggccccacactcttttttccttcatcaaccttaactacagattggtcttttaaattattttttacaagtaaaactcctcctgattaagggctggcaaacttttcctgtagaggaccagatagtcaatattttaggctttgaagaccacatactgtctctgtcacacatatattgtttttctttattttttttaacaaccttttaaaaatgggggaaaaggcactttttttattcacagatgtttcaaaattaggctgcgagttgttctttgctgacagctgttcttgtttgtttcctgtttttctttcatttacttttcttcctttatttctttcctctgctttcactgggtttatcctgttgtgctttttctagctttatttgaaagctaattttttacttttagtattaccttttttgggggtggggggacagggtcttgccgtgttgcccaggctggtcttgaactcctggactcaagcaatcctcctgcctcggcctcccaaagcgttgggactacaggtgtgagctaccatgcccagcctctttttcaaaagaattaaagcctgtaagtttgccttcagatacttttttgctgcttactacttatgatatattatagttcttttactgtggtttacttctacatttaaaaaatattactgtgaagatatatttatatatgaatagattttagtgtcaaaaaactatagaaactattattttattgttgataatatctaatgagatacagtgtgtggtcttagaggcagggttctatggtattcagtttttgaaatttgctgaaatacttgctttcaaccaagtgcatgattattattttaaaaatgccccatgtgtaggttttcctatatactttcctatcttttgagttcaaactcagtcggcatttgtcaaactttaatgtcactcagacgtaaaagaatgcgttttatggcattcccaaggtggtgaccaaaactcagtttccaaatttccactgcagctgagttttctttctaatttcaatatctatatttttccctccaaaactgctaatttgttgctttcctatctatttttttatttcatttccttcttttgtggcttcactttttttgctcttttgaaagagaagttattccttcatttctttctttgaacatcttaagactacttcttttaaagtctttttcttattttcctataaaattaattttatctggggtaagataatgttgtctgctgattttgctggctgtatgtttagaaatttaagatttctttatatactttgaaattaaacttagagtttcagttttaaagggaagtaatttataattctttcctctctcaccctccttgctcagcctaccctgctctgatagttttccagttgccttcacctggcccttgaggtcattattcaggaatcccatccttatctctgtgctcctgttctgtgtgggtatcagaaacagtgtgaacacaggcttcaagctaacaatgtgactttgctaaaagctatgatatgagggaaaggttggcaataatttttgactgaagcatgaagccttctatagcccatggcattaaataatgagcctgatttccattccccatcccatctggagcacttctaggtcctttccccaaagcttcaagaactatttatccacaggagctaaagccaaagctactttggcctcttccagaccaaatcccagtagcctgtatcctcagccacagtcatggcttttcagttttgtctcatttctggcctgtggagatgtttatcttgtttttggttcagctatatgtctttgcttttgcattttattaagttctttattactgacatgtatttggggtagaacgagtgcaccgaagcataaactccatgcatcactatggctggaacttggggacacctgcactactctgatctagctcatgagagaaaccctg

SEQ ID NO: 6972 - DNA, 506 bp, artificial
  synthetic oligonucleotide
ggtatttgttggactgaattgtgtgatgtatacaagaaaattaatccctgctacggtgaagtaggcttgccttgtgtaattcttgaggcagtcagcctcaggccatgttgggtggagagaataaactctatttaccaccttctttcaactcctggcagctccttgcatctcccactatgcatggagttacggtaacctgggcagcagggcgtcaccagcactctttctttggtgtcagaggtataatttagtgaagggtgaagttgcagaaactagtgggcgggttttcagatgggctataggagaaagactggggaaaggcaaggaggggagaaagagaaagacacagatctatctttgcatcagacaccatagttttgagggactttttgtgggttgctgctccctctccccaccagccttgacccttttttgtgacattatacagctgaatgagttagttataccaagtcaaaacccccagcccaactgccccatggcatctg

SEQ ID NO: 6973 - DNA, 1139 bp, artificial
  synthetic oligonucleotide
tttgaagagaaaaaaagaatctccttggcgctcttaactattctgatgagactaagttccagagaatattttacaaaaactacttaatttaacagtacgccttgaaaagtaacactacatattctaagtgtttctggaaaaaaaaaaagaaaaggaaaaaccacgacatatttataagctaacaattcttaagagagggttactatgaatgctgtacattaatttttactttgtcagatacataacttaagaaccaaataagatgatgcataattacttctaatgatagaaagtacgagttaagtctccaaagtaatcgtgacagtgtttcatgtggaacacatttcatctacaaaaatatccataaaatacaatctagtatacctcctaggtcaatattaatgtagaaacaagaaccttctgtaataattaggttattgaggaaaatcttaagatccattttagactgaataattaagtcaaattgtttggaatttaaaatatgtgcttcatgatgatgaaataatctgtacaacaaataaccatgacataagtttacctgcggaacaaatctgcacttgtacccctggaattaaaagttacaaaatattttttaaaatatgtggttcaaatatatatattcaacatgtatcactttgttaagagaaaaatagaaaaatactccgtatttgatcagaccatgtaattcagataataaaactgttgtaagttttaaaaagccacaatttctagtttactctttcctttgatagcattagtgcagaaaatattttgagaaacagatttgtactttgtttacctatacttaaatgtgttgttgtaatatttcttttcaaaacagtggcaccatatttctttagaaagtgcaacggcactcactgtttagcagcataaaaaatattatttgtgaaattacaatgtactccaaatagagaaaaatatttcagtgttttgaagggtaaaatacaaaaagcacacaagggggcagcaaaaaaaaaaaacagcagagacggtttcaaaaggaacttttctatggtattaaaagacaggagagcaaaataatgagtaggaggtttttggattacaggcaacgttaagttcttgatgtagatgctggt

SEQ ID NO: 6974 - DNA, 2067 bp, artificial
  synthetic oligonucleotide
tgccgcagtcctcacgaagtttttgggtgtgtggtgcccgaggggggcagccaggccgctgtggggccccagaaggccactggccacgccgacgagcacctggcccagaccaagagccccgggaacagccgtcgtaggaagcagccctgccgcaaccaggctgccccggctcagaagcctccagggcggcgtctgtttcctgagcctttgccgccatcttctccagggttccggcccagcagctatccctgttccggggcttctacgtcgagtcaggcaacccagccaggccctgcactcctaagccacgcatctgaggcaaggcctgctacccgaagccgcatcaccctggtagcttctgctctccgcagacgtgcatctggtccaggccctgtcatccgaggctgcaccgcccagccaggccctgcttttccacaccgcgccactcatctagaccctgctcgtctaagccctgaatctgcgccaggccctgcccgccgaggccgtgcatctgtgccaggccctgcccgccgaggctgcgattctgcgccaggccctgcccgccgaggccgcgattctgcgccagtctctgccccccgaggccgcgattctgcgccaggctctgcccgccgaggccgcgattctgcgccaggccctgcccttcgcgtccgcacagcaaggtcagacgccggtcatcgcagcaccagcacgacgccaggcactggcctccggagccgttccacccagcaaagatcagcccttctcagccgccgctctctgtctgggtcagctgatgagaatccttcctgtgggactggctcagaaaggcttgcctttcagagcagatcaggctctcctgatcctgaggtcccaagccgtgcttccccgcctgtttggcatgcagtccgtatgcgtgcctcctcaccctcaccccctgggaggttcttccttcccatccctcagcagtgggatgagagctcctcctcctcctatgcttccaactcctcctccccgagtaggtctcctggcctaagcccctcatccccttcccctgagtttttgggcctgagatctatctccactcctagccctgaaagccttaggtatgctttgatgcctgagttttatgctctgagccctgtccctccagaagagcaggcagaaatagagagcacagctcaccccgcaacaccgcctgagccgtgaccctctataagcatcctctaagacccacagaaggaatcaacatttacccactttgtgaatgggctgcctgccctgtagttagctgcgaggtctcccaaagttccagccgttaaccaacatcctgagtagtttagaagcctctcctccccatgactccaccacctagcacttaacctgctgttggcctttgattctgggccaccttcttcctcaagagtttgcctttgcccttgagctgagatttctgttttccaagttgcttttctgttatgaaatgttttaattagtaaaataaattgttttgtttaaacaaaatgtagaggtgtgtttttttattgcggttcgaaaaatcgttaatcctatatcatatttggagggttaaagaaagttgttaacatactagctgactctttggacgagagaagaaataaaatactgtcctagcaataatttattcccactggctgaaatggagttctgtgcaggaagttcccacttaggtctatataccctcttagcagaggtgatttgcaacttgggcaagaaaaggggccagggtctaacccaggtggctggagaaaaggaggggtgatggagacatccagggtcaggaaaggagcagggaatgatgaagtttgggatgagaggtagggagacgataacccagatgggagtagggaagctgggaggaagatccagagtcaggaaatggggaacagcaggagtcagaagcttgagaggggaatatcttagattctaaaggataaaaaaatgtttatgtgtggggaacgggctcctgaggtctttgggggtggggagaatgtgggagggtgatttggggctaataattgatgggaaaat

SEQ ID NO: 6975 - DNA, 768 bp, artificial
  synthetic oligonucleotide
agaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtatgtaccgcttgcgcccgcacagacttctgtttgtctgccttgcttaaaatgcatcccgcctggagcacctctcgtaccatgtgcggtctcatgggcaggagggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggcgaggggtgggcggggagtgtgtgtgtctgcctgtgcgccctgtgatgtttttggttcttttatatttcacacatattcgtgggtgcgtgcacatttttgataccagccttgtggtttgtttggtagtggaggcctttaaagtctgaccagcttggttgtgtggcatcttttagtatttttttcccttgagttgttttctccttcacagcgttcgc

SEQ ID NO: 6976 - DNA, 493 bp, artificial
  synthetic oligonucleotide
ttaatacagaaatgagtggggagtgtggatgtgggggtggaaagagacgtgaatctaattttccttatgaatctgcatcctttatgcaatagagctccgcttgcatctgaatagttgtctcgacaacgccacagtgagtgtaaatcgacttaagaaaaagactgctatgacagtggggtcaacttaggagcacagaaggaacacacacagtgttttagcagctggacagtgcagaaactaagggactgtggctccaggaaacacacactcaattgtaaccacgtgctttccacccagagcctcaatatcatatgtgttattccactgaccttccactcactttcaatctcatatttcacaatgaagatgcctttcccctccttgtctggttccactcatttttcatcattcccagatcctctggggaaaagaagccagggattttgaagaagacttctttgtgaattcaaaagcccagttgcctcacatgcct

SEQ ID NO: 6977 - DNA, 1187 bp, artificial
  synthetic oligonucleotide
atgcaataaacttaggaaggtacccagcatatagacactataataattattattattataggtttctctgttttatgatagagtgcgaatggctaagagaaggtcctaagccagtgtttgaagaagagacagaagttgcctggatggaggatgcagaagagggaggcaggggctagagcaggaagagctttgaaaagcatgtacaatgccaagctaagaagcagaatgggcttgggtcagttgaatagcacctacatttctgctactttcaaggaagagcaggctgatgaccaacctgtgtaagtggtctggtgaccctagcatgcaacaaacattttttccttaactcaggttcagattgaatcgctgtgagtggccatatgaactgctggtctgtctctgaaagaggctcaaccctcccttagctgtcagcagccttgtactccacctggcaacagctgggaagaatgagcctattggataatggcttttggagctgacttgtacgtggggatttggaagagaggtggatggagacaaagagggtgaggcattgcactgagccattggatagtgtgtggccaaaagagccaggcaccttcaggatctgctaggatgactttcaaacagcttgcgatgattcaatctgccccccagggatttttttttataaaagtatattttacaacttgggccagacaaaccagtgtcagttttatggccactatagtttttggttatttattccccatcttctctttgttttttccaggtgacctgctttaactgctagaccctggagagtctaaaaagaaaagtaataattattccttatattggtacaatgctttatgatttacaaagaaaccccacattcattggattttacagtacttctagaagggaggcaggacaagcaattacatggtcatcatttcctatgttacagatgagcaaatcaaggcaaagagaggggaaagcacatgtccagagttatacttccagggagcggtggagctaggactctgtattaattttctatgctgtatataataaattaccacaaatttagcagcttaaaccattacatatttattatttcagagtttctttgctcagaagtctgggcatggcttagctaagtcctctgcttagagccttacaaagtcacaaccaaggcattggcc

SEQ ID NO: 6978 - DNA, 1321 bp, artificial
  synthetic oligonucleotide
tcatttctggtcctaaattagttcttacatcagtccacttctctccatgcccactgccactccatcgccatctcacacctagaccattgcaataccttcctaacaaggttctctgatgcctgcagttctgcccagatgcatctaatccattctccacgttgcagtacagttgacctttaaacaacatgtgtttgaactacgtgggtctactcatacatggattgttctcaaccaaaggtggattgaaaatacagtattcactggatgcaaaatccacatatacaggggcccaatttttcttatctatgggttccacagggctgactgtaggacctgagtatgcacggattttggtatgggagggtgtcttggaaccaatcccctacgtatactgagggacaactgtactttgcagccagggtgctctttctgaagcacaagctatgtcactcccctgtccaattttcttcaatggttcctcattgcttactgaataaattctgagttccttgattaagactcttaatacatggatcctgcctacataatacccagcactctacccccatgccccctcaactctgttccctttcccccccaacacatggctctctgaaagtaccaaattatgcatggtttcaagtacaacctgttctcttgtaactctcagcctttttataagctattatttctttctggaataccctccacttcatccttgtccatctggtaaacctctactccttcttcaagtcagtacagaattcacacttatagaaagaaaccttcctttgcacccttaatcaaccttagactgttctcccttgatattcttactacctcctttgtatctctctattatggtgctgcttatattttattgtacttgtttctttccctgtgctggatattctgtgagggcaggaaccatgtctggatcctcaatatgttcctcagtacaggacctggacatagtcgatgttcaatcatcgctaaatacatgacgtgggcctggaataccaaaggcatttttggttatataagaataactttctggctattgtgttgatagatcttttaatcatggagtggaatatgaggcttgccccacgtagagtggccagcaaatgggacacctcagagaggctcctctagtgacttagaacccaaaaaagaaccctgggactaacccagctccaggcctaggaaacgttctactttgatgctgtttactgttacatgctactggagaactaatacaaaaatgtaacaatttggctggattatagacaaggactataaggaatgttaattgtcatct

SEQ ID NO: 6979 - DNA, 2694 bp, artificial
  synthetic oligonucleotide
aaaaaaaaaaaaaaaaaaaaaagcatataactttctccagagaacactggagggagactgcctcaggaggggttgtgacagtggatgacaaacgcatctcaggctggttaaagtacatgacaagtatgggggaaagggtgctggatgaagatctgggctagtttggggaggctaatgatcagaggggtccctgccagcccctcaaaatgttgcctcagcatacctcagactcctcaatctgattggtacacccatggcaacactccagggttgctaagagtgtgggccccaaggcctgaaggatcccatacactggaagtcaaccacaggctccaatgcaaggcgaatgccgcacaggttattgtgggtgtgtgttgcggtggacgtttgctgaaccctctgctgagatgtgaccaatgttgaaccccacccccccgcaaaaaaaaagtgatatttgctccctgctgaaaagacacatctttctatctccagcctgaacccacatctacaacttcaactgccatttaagcgggttggaagcgggagggcttttcggatttgaggatttaagagaaacaacaaaaaagtggaataaagttcgtaaagtccgttcacttggcaatctggcacctcaaggtgagtcgtcccacaagtcactcttcctggtaacagctccagctgcccctacccctcgccctcacccctacgggggaggctcgctttgggggttctggagcactcaggagagctcctctctcctgtcctcagctgcaacttggcttccagcagatcacagactcctaaaacaaacaaaccctggcggcggcggcggcggcggcagtggcggcggcggcggcggcggcggcggcagcggcagcagcaacagcagtagctccagcacagctgcgctccatggcgcaagtttcctccacacttctcaacgtgcaggaaatctcgccggcgctggggcaggactctggagggagggagaggccgagccgaaccggcggcaacaacgccccaagagctgaatggatgtgtgcgcgtccggccgtgggaagtgtggctggcaaaagccaccaatggcctcatctccgttcccacaccagcccctagccctgcaacctgcctgggagggacggcccgccggtcgatagaggggacaacgctgccaagagagctgccaagccgcgatgactgtcccttcagtccttcactgtcccgcagggacgcagaggcctccaaggagaaatccccaacagcctccacttccttcggcccaaactgagggaagtagccgccccgacgtggggcagcaagggctgccccagcgccctcgcgagtgtgtctgcgcgcaaggttctagccgggggccagttgtgctcccagctcgtgttccagccacccttaggggatgtctgcacctggactggtggcaagacccctccgtgccgctcagagggtctttcgctcccagccctaagtttcaaagttggcctgagggccccgtccagcggcagccttcgcacccgcttgtccattcaaagttaggcgccgttaggacatcagccgccagttcttaccttagacactgtgagcggctcacagtgttccagaccccccttaagggtgaagccccagggtgcccccccttgcagctgcacagggacgtactggaaggacccaggccggttctccatcctcggctgggctcaggcgccgccgggctccttttccgagggggctacgttgcctccgcccccagcagctccgccaccatcgccctccagctctacgccaccccgcaccgccctgctccgcctactctcccggctggagacgctcaggcagcgagcgagcgcaaggaggaaatgacacggagctggagaaagggggagagaggggggaaaaggagaagggaaaaaaagaaaagaaaagaaagaaggagaggcggagggatagcgcgtaatggacaagaaaacggagcaatggggaggggcagtcactgggacctcgcctataggatcgctggggagtgggagcgaggcgaggcctcacatcaattgttacattgtttcattcaagcagggcccctctttggtcctcctctttactgccgggttccccgcccctccagccagcccaggcgaggggaggtgaaagtcgttagtgtggacggcccgcgtggctgagtgggctgaaacgctggtttcctgattagcgcgttcatgtttctctgactgcctttttcttctgaaggtcccgagaacggagacctgggagggttaaaaggctgctaatttgtggaccttgcctagaggggtggaaagcaaagccagcaggccagcggacatagtgaggctgtgtgtgtagactgctctgtgtgtacgcgctaggtgtgtggggtcattatgaaacattgccccagagcatagtttaaataaagaagcactttgaggatgccccctgctcgggctcccccgcaccctggctcagtgttggtgtctatggctagcactgtgcttgtgtatgttccagtcatctggagttcctggcacggccttgcacttgccccaccgagatgagcaagccagcaatcagcaaactttatgactagcagtattgtctctaaacaaacctacaggaaagagcatccattgataagctggccaattaataatgttgtgcctttgg

SEQ ID NO: 6980 - DNA, 1535 bp, artificial
  synthetic oligonucleotide
acacctacatttctgatttagctgaccattatctagacagcaatataggaagaagagctgggttggcttttcagaattggccatgttctaaagttccttctgtttatattcatcccaaaaggactcaagcccagacctaaagctaagtgttggatctttgtcagctgattgtttactcaaaccaaagtctttctacctgtataaaacactaggctgaatattcacaaattttagggtaatcacacttcttttacgtgttaagagctctttcataaagttgacgaaaaatttggactgaacgagagggaattaatttcctataccgtgcccaaggtagtccacatgtgaaggttaagttttccacaagagggcagcatcacctaataaattatgtcattgtaagccttcaccaataggggctgagatggggaggctaaaagggtagaaaatacaggttccgggagccataggacctgccacaccatgaaaaccaaagggccctgctagtccaagcccataattatagccactcctaagtgactgatagtggcagatgttgctacagtatgaggaaagaggacatggaactcaccctggcgagatgagtgggtgaaacacctgaacactctcattcttgtgactggctcagaagacactctagatagtgttcacactccctctaagttgctggtgtctctgtacaaccagcatctcacaggggcctttatttcttattcagatcattgccacccctaatgattccttagcacatcattctctgcaggttaggctgcaaagcacaccaccattctgatgctctcccaatttaacaatgtttgtttattccaattatgcttcttttagaccctaaggaaacaaatgggaatgaaattcactgacaacccattatgtgacagtcattttacataaattatcttatttaatcatcacaataatgccattatataggaattattatttgtcatataagagacctaggaagttgcaaacatgggaatatctaactccaaaacaaaaacgcttccaaattcaccaaattacccctccaagaagccttatttaagacctaaatcttgaccaatccaagatttaatcagtgataatgtatctattatataaggcattacttaacatgtcacctcctatccatgtacatgggcaggtatggattaatcttaggtaccagcaggtaatagaagtcagtgggatcctacataacctcattcttcctaggtccaaagcctttctccttaaatattctctcttcaggataaatcatttggatatagaacatgaggataatggaataattaaagatggcttctgtgtttctgacttggttggctgagtacatacatagtggtcctggtcatagatagcgatcttgggagaagatgatgatgtgttaggtttggggcatgttgtgtttgcaatatctctgacacatttaagtataaatgtctaataggaagttggttatatggtctggagcataggagatatagaaaataaat

SEQ ID NO: 6981 - DNA, 1748 bp, artificial
  synthetic oligonucleotide
tagccagctactttgtcaaaaaaaacaaggcaacagaaatgaaaggtaagttgagtagtaaaggggtaggataagaggagatcttgattttgacaactaatactaggacaaatcaaaggtctgttgctggaaggatagataattctcatggggcctccagaatattctttcattccttaagttgggtccctgcggcccagaaatagaaagttccatgcctctcctcccctagactgtgctttacttcttaaccaagagaaagcagggatctaaacaagttcagacttctctacccagaagtccttgctgatggtggttagcctagtcagactcccggtttcccagtctgagactattcctctctgaggctcaacatccctattctaacccttttctgtccccaccacattgagagcatccttaaaccacacccacccaggaaagctggagatggctaccagtttgccaattctttccattctggcaatggagataggagaggcctccttttgtgtgattatccctgtgtgctgctgcagcttaactgtggttcctgaaaatcataattatatcctgagattattaataatagtgttaaagacagatacctaaccatgatccttaaaggggacacccttatcactagttaactctctctggcttccctctttggcatgatactcatcccaggtagtaaatagggcaaattgaagagaaatttaaggctctagcacagataattgtgcatttctctaggataggattgggagttagtaatgggatatctccaaaaagattgacagtgctcttgttatactcagagacagggatgaggaaatagtttgtggcttctatacccctacgctgccacacatctacctctctcaccttgaaataaatcagggaaagaaaagaggcagtaagaaatgctgatttcttctgctgaccccagatctcatttcctactctctatcccaccaaccccaggcagtcaccattgcaggaacagtttgtgttaatggccaggtagaagtaggaaggcagtctcctagctaactgggcctaacataccggatgcagcctagtgtaaatgatttaagagacagatgactcgtgtctgaattctggctccatcattttctttgtggtgtgatttagggcaaattactcaattttcttgtgtctcagtttcattatctgtaaaataatataattgtagactctacctcattggaggtgttaagaagattaaacaacttaataaatgtaatacccaaagaaacatgcttgacacataataatctctatgtaagggtttgctacttgtattcatggaaagagcactgaaactaaagtcgaaattatcttcaccatttgtaagtcacttcaccttcctgtctttaatattattaccataagatggaaggaaatactcacatgattcctttgggaattaaatgaaataacacacagaaaacatctagcacttagcaagcatgcaatgtctggggataaagaataaataaactcttttttaattcccccatctattactacttactaagtatctatactttcagctctggcaaatcccatgcccttaggcctaaagatcctttctctaacatgctttcactaagaattctaaaatcaagtgatccctgccaactgtattctatttccattatttatttaggtaatggtattattactgccatttgttatgcatccacttattgaaatggttc

SEQ ID NO: 6982 - DNA, 2025 bp, artificial
  synthetic oligonucleotide
cccttctatcattcaccttttggttttaagtccccatgctctagttatgacctttaggcatggccatttctggaagggcctattccctttaaccacacttcatatgacagaactaggctcagtttccccctttctctttctcagcttcactggtctctgcaataacaaggccctttcccaactgggtctcagaaccttaacgtggccctggggcaaaactgcagcagcctgacacccagggtttctagggattgcattattcagtcatcaattccacaaataattattgaacatctactacatgcttggcactcatttgaatgctgaggattcaccaaaaaacaagacagacatcatccgtgctcaaatagcatttattggctaagggctggggaaatacagacatacatacatgaagacgttgtttcagaaaataagtgcaataaagaaaacaaaaactgatgatgtgatagaaagtgcctggagggctactttggtcagtcaatttatttactcatttgcttaatcctatagcacatccaaaatagtttggaattacttcaccaatgctactaccaacaacaaacctactaaataaacttcaagattttttttccaccaacttctgatttgaaaacttttcaatcctacagaaaagttgcaagaataatacagtgatcacttacatattctttactgattgctaacactttatcacatttacttaatatctataactccatctatttatctgcatatctacctctttatttttggctgagccacttgaacgtttgttgcagacatcatgacatgtcacacataagtatttcagcatgtatctcataaacagcaaggacattctccttcatacacaatacaatgatcacacttatgaaatttaacaatgatacattaatattatctagaatacaatgcatatttgaatttctcaaattgtccaaataatgctctgtatagcttttttttttttgtaaatatagggtcaaatcatagattgcatttagttctgtgtctttagtcttctttaatctagattactcccagctttcatttgtctttcatgacattgacacttttgaagagtacagagcagttgtctttagactggatttcagtttcaatttgggtttgcctgattgtttcagattggattgtcatgaaaggcttctctgaagaggcaactttcagttgagtcttgtcaacaggaggaggcagctgtgaaaatatctggggaaagggattccaggcagagggaatggcaagtacaaattcctggagatggagacaggcttgtgtttgagggagaaaaagcaggccagagtgactggagcctagagatcaagggggagagtcccatgaaatgaaataagataggcgggattcagatcatgatgaagcatataagtcatgggaaagagaagattttgttctaattgcaatggtaagccactaagggttttatgtaatttggtgacatgatctgatttgaatttgcttttaaaaatagtttttacaccgcatgttctcactcataagtgggaggtgaacaatgagaacacatggacacagggagggtaacaacacacactgggacctggggttaggtggcgggagggagagcatcaggataaatagctaatgcatgcggggcttaatacctaggtgataggttgatctgtgcagcaaacctccatggtacacgtttatctatgtaacaaacctgcacgtcctgcacgtgtatcccagaacttaaaataaatacaataaagttgaaaagaaaaaagaaaaaatataataaaaaattaaaaaataaaaatagtttttattttctaaagaattttgctttgtatgcagtttaaagaaacaaataggtacttgtcatagctgtcaacctgcccccctctcccattatctgctccctagagggaactacttggagctcctttagctaaatagcatgcttgtaaagctaattcataatttttcagattaaagcattct

SEQ ID NO: 6983 - DNA, 1262 bp, artificial
  synthetic oligonucleotide
agataattagtggtggaacagacatttagaacttgtgtcactcaatttccagctgagggagaccagagcacaatactgagggctgtgagctgggggctgtgagacagggtctgtgtaaatcctcttcatagcagagtgggaaggctgccttaatgcctttttctttcttgagcttgtcaaaggagcagaggtttctcagctctcactctttctggacagcagttaatgatctgcaaccaagctcactataggaggtccctgtttagaggaacatttttgaatatgtatgtaatataataattcaaccagggtatactcattttattggttctgtttttatgttttcttgaagtgaagcactccacagttaagcggtatttactgccagtctgtggtgtatacagccctattaggtgtcctggggaaggagaaagggcagaaatattagacgtgatccttcccacaagaattattagagcttggtggtcaagataagccaaatacaggtgaaaagcaatccaaacacagatgccagtttatgatcatgacaccacactttgtacttttctggggggctgggggtgggtggggactaagtgtgacagagcggaaaggaaattgcaaggggagtcaggaaatctggcttcatattaaggttctaccactaaactctcaacatgaccttatacagatcatttaatgtctttgggccttaagttttctcgtatgaaaaatggaggtgggaataaagttgagcttgatcatctagctctaaagtctgttttagcacgaaatatcagcaatcctgtgagtgaatcacggacagctttttgtaaggggacagatcttgaaatggatcttgaatgatgcaattaacatagatcagcaaaggggaagtggaaaggcattgcagacaaggagagaagcaaagatagaaatctggaggtgagaatgagccaggctggttgagatagagggaacataccaacgactgatgagagatgagattagagtgaagcaagtggtagggagaaagcgggatgtaaaaggttttcaacatcagattgaagagttggaagatttggttttaaaggtaatgggagcaatgaaggctgtttgaatataggtgtacatggtaaaactaaccagtgaggaaaaattgtccttgactgtgtatttggttctggaagcatctacaaatctgctttgtttccctagagctgatatccagttgatttgaggtaatttgtaaaatcatgatt

SEQ ID NO: 6984 - DNA, 5309 bp, artificial
  synthetic oligonucleotide
tcgaggaggcagtgtttgaaaacaacatcaccccagctaagatgacaacctgtttgccttgaatgttaagatacaagccagctggttgcaggtgccatttgtctgaggaagatgcaggagagaatgatcctatcactgaagatcagatgttcccagctgcaccagagagcaattgcatagcaacattgagggtgttgtaaaagggtttggctccaagcaatttaatttgagcacgtacctagatcctttacatccttcaaaattctccagagccactgattagttaatctgcatggccttcttaacggatggtcgtggttcttaaccccattctacagataagtgattcaacaaatgtctggctctactaagggcaaagtcaaacccctgggatcctggtctcctgccagtgttgccagatgtctgtgggtcagctagccagcacgtctgagtgggcactacgtagaggaaactaatctgattccccttaccttaatcttcctcatctgtctggcaatgacattttcctgtcaaacaggtaggagatgctttcgcatgggagcaggggatgcttttcactgggggaagggtcctggtcgccagtcagcctttcagaggccaaaggggagatgcattctctgggtattacgtccccacgtgtcagtttcacagccatgttcccaaaatttcgcttaagatggccacaggtcaggtgattcctgcttgtctctttcccaccagcttaatgcaaactcttccaaaaagacaagatcaatcacccggtgagggtgagctcccaaatctagccaccccaactttgcccttcttaagatcactgcaggaaagggtattttcaggaaggggagggatacatcccctggtgagagctagggtgttgaatttttaaaaacttatcagagtctcccaccgtcatgttttatttatttttaaacctctgcactttcttttctctgtgaaacttttcattttagccttctttttcagttattcgtcattgcagatattttgcaaactcaagcctccctactaagaactcaggaagcaaccaatgcttccatttcgtgatgccaatctgccccctcccctcccgcattctacattctataagtgtgcggtccacagcagaagggttcctgagccgtgtccttatggtctgctaggcagcaggatggaccggtattgttcgtgtgttgtgttattcgtttgtgtgtgtgtgtgtgtgtgtgtgaatgcgcgcgcgtgtgtatgtcttcctgcaggggaagctaaattgaggtgtgtgtgtgcattatcctggttttcagttttgtggaacgaagtttagggtaaaggaagagtagggagagtgcagagaaagcaggaaagacaggcatactcccgcttaagagcagacggggtttcagggtccaaggtaaacacgaaaacctttttcctccctactccccttgggcgagtgccagaagattctccactcatcttttcccggctaagtgtaacgatttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccgcacaccgcttcaggtctgggcagcctgagtccctaagcctggaaggctaaagtaccctcgggcgccccgcccactccagtccggcagcccctcgcagggtgccaaactttcccccatcccactccatggctggcttggctctgaggtctaacccgtgggcgctcagcgtctccctatgctggaacacgcccctcagtgtgcgcacacctcttcgtaagcagccacgggtccgatgggcgggaagcagaggggcttgcgaacgcggactgggcagagcgcttgatgacctcctagcgacgcgcgggaggggaggggagagacaaaaaggggagggggagtggagcggcgtggaggttggggggcgggctggagccttgccgtgtttaaccctttagtgacacgaatgaaaaaaaaaagccagaggcgaagttgagggtctttgcaatcccccaaccacttagctgctggtcagaatagcttccatcctgtgtctgctctctcacctcagcagcaggtgagcttagcctcggaccaacctcttgccccccatctccaagcctcgatgggcaagtaatgctttttatctaagccgggaaaagaaattaagcggcatggtgtgtgtgtggtgggggggggggggtgcggggggggcgggtgttcagcctcctttggattgaagtacaatttgaccctcttcggttttttgcatttctgagctttgccgttgggtacagagtttgaggtgattcgggaaaggagtgtgatgagggaggctggcgccccggctttccgcagcctgcagcctccccgagagcaagtcgagagtgccccggcagcagctgggcttcgcgctcgggagctgaggctatctgggcgtctgtctggctcgcctatgctataggagcctgccttgtgcttttagctggatttcccagccatcagcaggagtttgtttttccgccccccccaaacttgttaacgcgcgcgcgcgcgcgcgtgtgtgtgtgtgtctgtgtgtgtgtgtgtgtgtgtcttgggctggggaaattcactgcaacacccacacccttttcacctcctgaagcagtctgacattagagatgggagattctcttgggaagagaacgactgatgcctagcgcagcacctttcccaccacatcggaagactttagaagctctttctgttatagtcacgtacacatacacacaaaccatcatcttagtcagacctagactttagacgccaatatattaccaattgtaattaaaatttgagaagactacctgttaagccacagctgggtggggggagcggacgggggagaaatacctgtaaacctgatttgaaatatgacaagtgaatttatctcccatacacataatgctgcagttgtgggtagcagccttctttctgcagccccttctctagccatctactcccagaccatatcccccactattccctcttcttttgccaacggacactgacctagccagaattttctagaatctgcaacatctttctgttgcctatactatgtctcagcaataaataataccataagagcacagtttcacctaaatccctccaaagaccagaatctctggtgaggtctgcatttcccagatcctcgctgcagcctcacagcctaagcccacctttccagagatgtgttaacactgcttggcagctactaagctagtgcagggaccgtccttaaactctggggatgggaagaccaggagaagtgagccctatcaattccctcacgtggcagtcctccttccagtaaattcaccttaggagcccactctcttcaccctccttgggcttgttctcctttcccctatcccacactcaagtagccaagccgcctttaaccctaagagttcaggactgaaatatacaggtgccagatctcattattggatctggtgcattaaagtgccagatctgaccaaccagcaagtccaggactggagatcacttttctggctctcacaccttaatggaatccctgtccttagaaggggcagatatcccacatttaaattttgctttttactaaacccaacatgtagttagaagggctgaaggctgagcagtcacagagtaagatggcctcttgggttacagatggcctcttggggtttggcatagacagtgtattgtcaagcgagataccaccaggggacaacttggagttactgctttatgtatgtttattgaaactcttgtctataattctacactca

SEQ ID NO: 6985 - DNA, 1580 bp, artificial
  synthetic oligonucleotide
aagagttccttaagttctaaacagaggctttgtgtcatcagctctgaacttccacaaatgcccaaacctggatcttggaaaaggtaaagtacctgtagtccttttccttctgaattctgtcctcctttggggaaacttccctactcacccaattactgtttctaaataaaccattgtttattttgtcaaaaccccaaaaccaataggcagccccaggaagccagtttgaacaggcagaagctaaaaatccattgcttgattgccccaagtcgataaactatgtgcatgtaaaacaatctttacccgcttggggctactaaactgaacaaggtcctgaggcaaaaattggaagaagcaaggtaacaagcaaatgcatcctgccaagggaggcactgaagggagaacccttgcctatcccctaagaagatttgcatactgcttcctggtccctggcctctggcagataatatcatctcattgcctcctcacaactatgcagtatcacgtctgacttccagacagtaaatctgaggcttggtttcccttactttgtccaagtacccacagttacaaaatgctagtggactctgtgcttcctctccccgtgatgagaaaactgggagggcctggttttttagtatgtacacaacaggttgaacacagaccccaccccatccccctgccaaactttattctgaatgacaagatcatagattgctaagaattaaaatgtattctcggcccggcgagcacgcctgtaatcccagcactttgggaggccgaggcgggcggatcacgaggtcaggagatcgagaccatcctggctaacacggtgaaaccccgtctctactaaaaatacaaaaaaaaaattagccgggcgtggtggcgggcgcctgtagtcccagctacttgggaggctgaggcaggagactggcgtgaacccgggaggcggagcttgcagtgagccgagatcgcgccactgcactccagcctggaagacagcgcaagactccgtcacacacacaaaaaagtattctatgaacagctctgactattccatactagaactcttaatgagcttccctcaaagtggcaaatgatattccttgtttttctaaagacctaacattcgttggcgggcgagaagggagttctccagtttttttaaagtgacagtccaagattgactggaagagtaattagaattcacatgttgacagcactttgtaattaataaagtgcttttgcttctcatcagccctctgaagcaggtagtgaaaggcgttttctaacgcaattctgtcctatgaaagacaccctgaaattagcatcttcaagtggcttgcccgaggaaatagttgaaatttttcctctcaaataagatagcccatgtttgttttgcagttttgagactttgcaacatcttggagttaaaacatttgtcagaagaacgcatctctgatgttagtacaaaaggcaatgaggaatgggactccatatgggaaattttgcttggtggccacatttataagcacacagctatttcataagaagggacacacatgtagtcctcctggtcc

SEQ ID NO: 6986 - DNA, 1642 bp, artificial
  synthetic oligonucleotide
ggtaaatgacccaaatgaccctgccctccctactccaatgcaagtgaacaatgacaagtggaggagggaggttcattcttccagataagttggattgtgagcctaggactttgcttatctggagttaggaagaagtcttcctccccctgtgtatcctggttgaaggggacatgggagaggccgactgtgggaagacatggctagtacttactacttcatctgcaggcagaaggaggtcatcagtgatagacaatgtattccacttgcagtctttgcttgctctcaaagcacacaatctgtgagatttcactttgcacactgtgagaagaggaagagaaaagatgggtgtgaatctggtgacagtgaggattctaattctcttcccaaagctgctctgaaagttagaacacagatgcattctaaatagttctaatgcacctccaaaaacctatttccaataggatccagttcctttttattcttactggctaatctttttattatccaacttgaatgaaaattgatggtaagaatgaggtgatttctgtctttttaacacttgtgataatatagtcccatccccccacactcatccttctattttcatcccctttatgttagtttcctccctttttctttcctcaatcagggttaacctcacaccagagtcagtgacctagtatgagttaatgatactaaagccacatgagttccttcatccctatatctacccactgagcttcacttcctaaaggaatcagaaaggtaccttcacagatgatggcatctctagataaggcaggaatgctctctcgacaaacattgcagtgctgggtccggtggctgtaactggagtaccaacaatgcattccaacaagaaaagggttgttttctgctgcaggtatctaaaataaataaacgagaagagagaatggaggatgaatcacagagacggattaaagagggcctgaaaatctgctgctaagtctaaaatggcctgctgtataggtgtcagagcgtgtgaaggggaagactgaaagttggagccaatacctgggacctgggatactttgtgtgcgtttttgtttgttttgccagtcgtttcaaaaagaaaaataatagaggggcagaccctggaatagaagctgaaggcaggagtaattatctttttttttttttttttttgagaggaagtcttgatctgtcaccaggctggagtgcagtgtcgcaatctcggctcactgcaacctccgcctcccggattcaagtgattctcctgcctcagcctcccaagtagctgggactacaggcatgcaccaccacgcccggctaatttttgtatttttagtagagacggggtcaagtgatctgcctgcctcggcctcctgaagtgctgggattacaagcgtgagccactgtgcccggccaggagtaatgatctttatactgcttggccaatcactctattgtcttagttcaagcaaaaatgtgttgtcttagccttggccttggttctctagccagggaataaagacaggaggtaaggctctgactctgggctagggaatattataataaggctttaactacctcctggaggtatacactttccttcctggctgccaggtgagcagagcattgc

SEQ ID NO: 6987 - DNA, 280 bp, artificial
  synthetic oligonucleotide
attgcagagacctttcttaatgtcaaagacggaaagcaaggtgtctatactatagggagctatgctatgctcctaaatggtctataatgttgtgtttccctactataattctcttcccaaatctctggcttgcaattttgactttttggagcagcagacgacttcacctcaatgtcatctttctttcctaaactttccattcagggggtttgagttgggagaaatctgatttgggaacataaacatgtattttccttggcctcaacaccctcagctatca

SEQ ID NO: 6988 - DNA, 447 bp, artificial
  synthetic oligonucleotide
gtggaatcctggcctagtatagcctcagttccctacctattaaacacgactaagaactggctcccctggggtcactattagtgtgacagaaattaaactgtattgaatgctcagccgaactgattttgcatttgaacagaatatggcttcccacctcaaacccctctggagaggagaggagtgtatgatgtatgcattggggggaatagattgtattgtcagatttcaaggtgccttatgcatttatttaacagtctggactacactctatcccactttgcctccccagtaactaatgcattccactgagatttgtatcctgcagagaattagctcctggagcaattacagtggcatgtatttccccacaggatcatccagagtcgcagctaggttttagagttcttcttggcaacccctttagtatcatgatcatccctgatggag

SEQ ID NO: 6989 - DNA, 331 bp, artificial
  synthetic oligonucleotide
cctgcttttgaattctggagctttacatcaaggggaaaaaattaaccaattgaattgtttccccctttttaccaaccctgttctttaaaggtgctaatgaaaccatcagtcatttttgttgttgattttgcaatgcctcaacatttattttgcacacactcatcactacttcaaaattaagatagctgttagaactggagcttgttagaagtgggtgcaaaagttatcgtggtttttgcctttccttttaatggcaaaaaccacgataacttttgcaccaacctaatatttagtgccttattaaagaagcacatctattctttatcaggaa

SEQ ID NO: 6990 - DNA, 992 bp, artificial
  synthetic oligonucleotide
tgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagc

SEQ ID NO: 6991 - DNA, 2181 bp, artificial
  synthetic oligonucleotide
tgaacaccccaactgcctgtaacccctcctttccttctacttcacacattctggcgtgcattggtcggataccatcagagactgtccttgtctcctgccagggtgcaagggtgctagcctgtcttgttgctctttagctctggttcccctcaacccccaacaaggagcagccctgagccctctgagcaaatgcaaattccatacttgttctgcgaggctacattttcaacattacatatgcttctccttggggatattgcctgctctgagtcccaggagctgtatcggcttgctttgggggatgcccagttcagccttcttctgggctatggtctatgccagcaatatcctttgaaaacctctgcctgtccaccaggggagatttcttccagctaaccatccactctactgcagaggttcctgtcacctcctagttgttcctactccattctgtcagtgttacctgcactatgctaggatttatcctgacttatgatgttatggacaaggtcctggtgtcctgtgaagtagtatagagtggaagctttggagcctatctgtgtttttcaatcccagctccagcacttcctagctctgtgaccttagcaagttactcagcctttccaagcctctgtcatctcatctgcaaaaagggataacagtaatacataccttatagggcttttgggaggattatataatactgaaaagcatttagaagaatgctgactcacagtaaaagctcaacaaatgttagacgttattattattgctattattattattttgtattgaagctctttttttttttgaggaaggtcttgtcacccaggctggagtgcagtggtgcaatcttggctcactgcagcctcaacctcccgggctcaggtaatcctcccacctcagactcctaagtagctgggactacaggcaagtgccaccatgcccgactaagttttgcgtttatatagatggggttttaccatgttgcctaggctggtgttgtactcctgagttcaagcgatccacctgtctcggcctcccaaagtgctgtgattagaggcctgagccaccgtgcccaaccatactgaagctttagtgggcttcatttaggtatattttcaaatataattgcctcttttgatgtacataaccgttctaatgaggtaggtataaaagactattggttagaatcccaatttttgaggtaaagaaattaagacttggctatatgaagtgagatggccatggttaatgacaagttttatgatttcccgtttaatgttattgttctccaccagaagacactgaaatagatggattgttatttattcaataaatatttattgaatggctactgtgtgccaggcattgtgctgggcgctgagggtacagtggtgagcaagacagacaggtccctgtgctcctgaagttaccattttagtggaaggggacaatcaataagcaagtaaataacaataaaaggtatatatcagttagtgcaataaaaattaaacagggcaatgggatacaaagtaattaagggagataaggtagtgaatgaaggagggtttttctggggaggtgactttcatgacaagtagatgagctggagaccttctcaccttggatatgtagctaggttctgggagagaagtcctcatgaagaggggatttccaaggtcctactctgggccaccatagacaagtggacaggaaggagggttgcaagataagggttgctcagagcccaaagtcagaaagacttgctaaatttgagattttctggaaagaggcaggagagcaaagaaacttttagcagtggaaagggaatttttttccttataggtacttattaagtttaaacattttaaaagtaactttattgagatataatttagatagaataaagttcactgattctaagcatacaggttaacgagtcttgagaaacatagacccctgtgttaaacatcgcctctctcaagatatacagaacattttcatcaccctaaagtgttcccttgagactttcgcagtcaattctggctaggtattatgtagaatgtccctcagtttgggtttgtctgatggtttctcattattagactagggttatgtgttttttgcaagaataccacagaagcgataagcccttcttatcatattatatcgggagat

SEQ ID NO: 6992 - DNA, 705 bp, artificial
  synthetic oligonucleotide
aactactcccactataatattaatatatagtcttaacccatttatgccttaggttacaattttttgaatttttgcaatcggaccttggcgatgacattgatataaataactccccatgcttagcgttccaataatggaatactaggcataaataggcttaatttagctttggtttagggtgtaatagtgaagggtgaaatgcacattgaaatttgtctggcttgtcatctcaggaggcatgtctattcctctctctagggaatgtcctaattgtgagggaaaaaccaaaagctgggaatcaatacatgtagccttgagttccgctattccccatttgagctatctctgaacttttgtgggccccattcctgtactagtcaaaggcagattcctacttccctctgacagtggtaagggctcagaaatgtttgggaatatagggatggggccactaccccttgctgtttatctctttctcctcaaataatatttcttctgctttgaggatcactagaattttttatacaagtctggagtgcggtgagagatttttactccttggaaatcaaagttctcatcgtataaagggccataagtttgtgtaggtttgcctgcaaggggcagtagggacaagggagctggagtaggtgattaacaaggttctagtttcttcctgcagaggactcaggttagctaacaagagag

SEQ ID NO: 6993 - DNA, 1272 bp, artificial
  synthetic oligonucleotide
tgcctagggcattagcaaagctggggtaaaacaaaaatgtaaatcaactttacattatatataaaacaagagaaaataagaagttggttaaattttgttccatctattttatggtgcaatatcattttattctgaattacatatggggtaggaagaggtgggcataactttttctaaagtatatgtattctggccaggtgtggtggctcatgtccgtaattccagccctttgggagactgaggcaggaggctcacttgagcccaggagttacttgagcctgggcaacatggtgagaccccatgtctacaaaagatttttaaaaaatgtttaaaaagtatccatattctgaaaaacaatacacatacacaaaattgcataaagtataaatgtacaactaaaagttgttataaagtaaacactatgtaaccatcacccaggcaagaaatagaacattgtctgcagcatcccaggagcaccactgcagacggccaggtgtcttggtttgccttggactgttccacttttagcacagaaaggctcaaatcccaaggaaactcctccctgggatgtgaaaagtctcaattttctgtgatgggtacagaagattgggggaaaagcacaaaacccatatggtgacccgccccccccgcccaaatagggagtgaaaacagcagtttgtaatgtgaaatggatatggcatagattctctgccttctgtagttgctgtggccattttttttgccccaactgctgatattgacaaccatgatttgcagctcacaataatgatcatccattgttgcatcacggtgactgatgccactttagcatgcaacttaagtgcattgaaattgtgagcattaacaagctcgcctttgtatttgcctgtggatcaactgttgtaatttgtatcaaggttgtttaacctttcacatcatgaatattgtgaccatgtgcattagtttgctagggctaccataacagaataccacagactaggtggcttaaacaacagaaatgtattttctcacagttctggaagctgacaatccaagaccaaggtgccagcaggtttggttttttctgaggcttctctccttggcttgcagatggcaaccttccttctgtgtcctcacaggtctttcctttgtgcttgtgaatccctggtgtctctgtgtgtggaaatttcctctttgtataaggacactggacagattaaattagggcccaccctaatagccacattttaacgtaatcacctctttaaaggc

SEQ ID NO: 6994 - DNA, 1941 bp, artificial
  synthetic oligonucleotide
tgctaacaactattttaggaccacgaggggataacctgcctgagaatggggccaacactaaggaaacactgacataccaagccttgtctgaagtcagccctgcctctggtcttgtcagtcacatgagccattcaagttcctattttctttaaaccagtttgagtttttctgttacttgcaattggaagtatgttgactgacacaataatccttcaccaatctcagttatcagggcctgtgacagatcctatgaactgactcactcaataccctttccaatccccttattgcatgccttcctgtatttcagagtctggaaagctgaaaactctatttctcacaattccttgcagctgggattctggatgtgacttaagttctactaatcagaactagctcaagacttgaatttggatatgagttaagcagagagaaacaatactcaaggccaaacatttactggtgcagatcatagcaaagattgtgcagtctgggaatcagctgctattgatggtggctttccagcttcctgatcatagcaggagtagcagctacctaaggtagttcagttctgtggtatggatttggaagcactcctggaagctctacctagatcctttttcttcatccctacccacgattctgtaagccagttaaatactataaattactttctgctgacattagctagaaaagattctgctctttgaaaataaacccagatcatacagtattctttgagcctttgacactactacactcagggctgtgggagccagtcaaaattttttctctttttaaagacagggtctcactctgttgcccaggttggagtgcagtggtgtgatcacagctcactgcagcctcgacctgccaggctcaattgatcctcctgcctcagcctctcaagtagctgggactacaggcatgcaccacgacacctggctatttttgtattttttgtagagatagggtttcactgtgtttcccaggctggtcttggagcaatcctcctgccttggcctcccaaagtgctgggattacaggcgtgactcactgcttggccaagagccagtctatgtagcaaaaataaaccagagctaaataaaagcatactcgtttctagacatttgcaattatctctatcctcaccacttaaaactaggatttttaaaaatgtcctgtctatacaagtcctaagctggtctggtgacccaagaatagcctctgtacagttctagtgtcaccctgcttttgcttgtacttttccctcaacctctaccttcaatggtataacaggcttttctgtggaaggtcatccattattattaccagcaaagagaattatggcggtaagaggacccagtaagatgcctctggaatgcgaatgttcccaggcattgtccagactctcaaatttcagctatgtttaactagaaaagatgatgccaaacaacaattatcaggaacaatcaaatgcagacagtttagtaaataactcgcctagaccaattttccctgccagaaattcagcatttgattatgctttcaatttagatttttgcctctttgtactccaggggtaggtcagggcatgcagtggacagtcaataaatacatcctaaagaaatgaattttgtaccagctctacattctaggataacaggtctgctcagaaaacaaatggtgtcagttggacccattctgttgggctaccctaacagaataccacagactaggtggcttaaacaacagaaatttattttctcaggatttagccaacataaccaggcttaaaatgcagttgtaagaaggaagtcgtgagggagtgctgactttgatagatagccccaataaaagcccatcattcattcaacaaatgtttaccaagtcccaaccacaaagtgctgatggtgcagaaaggaacaaggtacaattttt

SEQ ID NO: 6995 - DNA, 470 bp, artificial
  synthetic oligonucleotide
tctcatacattggtgatactttcctgatgatgtgagaattggctgggagctgtatttttctctctctttgagctcttaatgatgtaaggtcgtgggctttgacaggcctcttgcctacagctactttgtacaaggaggaggatgggtaatcaaaacggtcctcccatgaatactaggattcttagtaccctctttatggtgtattgggattaaaatgtcttctgtacgaaatcctctgaagttaccctgtagattaaagtggggtgaggtatggggaggttgctgtatctgtggacattttcatgccttgctggaacacggaaagctacactttgaagtacagctttcctactttctcactctatttttcctgtgtctcactcccccactcactcctgctctctgttagccaggcagtactaggaagacagtgtaccatgtgtccaagttttactttaagaatttcccta

SEQ ID NO: 6996 - DNA, 1375 bp, artificial
  synthetic oligonucleotide
agaagagctgcatgtctcactgaagctgtctaggctaaaacaagcttctttttccccctgttccagggagcctttgcctacatagtcaattatttcatgtacgtcctctgggctctcctatttgccttccttgccgtatctcttgtcaaggtgtttgcgccttatgcctgtggctctggaatccctgaggtgagtctcttaaaatggtttataaatggttacaatatgaatactttttggttaaaatctcttaatatgtattccagcacataccacaatttgatgaatgttaaacaggatcagatcctgaggccatctaagacctaggtctttccacaagtccctctcagcctgggctaccaggaaattaaagggagttgattcttagcctcctgagggttcctgttgagccaggctctggaaaacttcccctgttccctatccaaaaagcttccagagtatatcccaagattctgacctgaaaaagcagtgttattgtcagctttttcagggcaaaagaaagaaaatcatttggtacctttcccacaatatgatttaggctacatgggatggttaaaaccctgtttctaactacttttggcttagattgcttgacagtgactaaagacactgagacttaggttaccaggatgactttgcccttccctgtttcctgaccaggtaataagtcacaattttttttttttttaagccagggaatcaagactatacctaacctttaaggttgtttcagggacattagccttgtcctctcaaaacatgcctcttgggctaccacgttgtaacatgaggaaaacacctatccctccctctccagctcctccttcatatatgcacactctcatacttacaatacatccttgcccagctatcactcccctccccctaaaaagggggaacatgaaagcttaaagaacagttcttgctttcttgggctcctgggctctcttccaaacagggatcactgtaggtcaagcatttatatgtcacttattcaaaaggtgcagtttctataatgaggtccagatttttgcttcttagccttgttgacttccttagtctatattcaatctttctgtgtttaacctgcagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtaataatgaatggccttaatagtctctttttggttgtgagcataaatgatacaa

SEQ ID NO: 6997 - DNA, 646 bp, artificial
  synthetic oligonucleotide
cacaggatgatttttagcatcaaaatttccttatgtgtaaatggctcttttagtttcttttcatattttaaaaattcatagacttttttgagcagttttaggtttacaaaaagattgaatggaaagtatagagttgttatatattctcgagacaccccagtttccgctattaacatcttgcatgagtgttgtacacttgttaaaattgatgggctaatgttgagacattattattaaataatagtataattataatgtattataactattattaaataatagtttaaatataattattaatgtaaaccatagtttacattagagttccctctttgtgttatatactctatgggttttgacaagtgtataatgacatgcatgaccattatagtatcatacagaatagtttcactgccctaaaattcctctgagttctgcctatttatcccccctcccccaccctaaacccctggcaaccgctgatcatttttctgtctccatagtttagccttttccagaatgtcatatagttagaatcatacattatgcagccttttcagaatggcttattttacttagcactatgcatttaaggctcctcatatcttttcatgacttgatagctcatttcttttctttcattttt

SEQ ID NO: 6998 - DNA, 1502 bp, artificial
  synthetic oligonucleotide
atacttgtttcttgttttttccttctttccttccttccttcttttctttttctttctctttcttttctttctttccttcctttcctttcctttcttttcttctctcttttcttttctttcttttttgatggagtattgctctgttgctcaggctggagtgcactggcaccatcacagttcactgcagcctcaaccacctgggctcaagcgatcctcccacctcagcctctcaaatagctgggaccacaggcttgtgccaccatgcctggctaatttgtgtttattttttgtagagatggggtctcactatgttgcccaagctggtctcaaactcctaggctcaagcagtccaccagccttagcctcccaaagtgttgggattataggtgtgagccactgcacccagcctgatacttgtcgaagcaacttctctctactttagttcaatgcaaggttaatgcactaggcaagaacagcaagccttcttgttagatgcacatgtgaggtgtacaggtactggaatctcctgtcctggttccccctctctaatccttgctacctgggtgagagtgctttctgaatgcagtgcacccaggcaaggattctgcaagggggagtgacatcttcgcataggacagagcacttctacctcctccttccatcctttctatgactatttgttgagtacctacctactctattgcaggtgctgtcctgggcagttggcccacaagagaatgagccatatctggttccctaccttcatggagtgtacagttcagggaggagaatggactccttctcattcattatatctgcatgtcctgagggtgggtggggtacagggtgggtggggtacagatacatgttggagaatctactaaacctcagtacaatcacacataaatacgctgtgtgcaagagaaagggcctgacttggttacatccacagagacatgtcctcacagagtggtccctctgacctggtgcatcactcacattctttcagcctgtgtgccagtactgccttgactcactgtcccttttcaagaattccaagggaagaagccttgtctacacttaaaaggacagagcttttgcacatcaactctccctcctcttccttccacagatactcaagtgtctattagacagcaggtattatgttcatcaccaaggatatagcagggatcaaaatggacaggttgctaccctacattctggtagggactcataaacacactatacataaatgttgtggatgaataggccactgttcaaaagaatgaagtagatctatatgttccttgttacccagtctgcatgcacaagcatgtgcaggttctgctcaagtgaaattctcaaatgtccccaatccttgtacaccagacacactcagagacatggccctgcatgcagagaaccccacctactgaaagggtaggagatggagcctgttgtgctctcctctctcccattctcagcgtgcaagccagtgagct

SEQ ID NO: 6999 - DNA, 611 bp, artificial
  synthetic oligonucleotide
ccttcttgttatttctctccttcacccatgcatgacactgcaaagggtttgctggcttgagtcttctacacacacacacacagtctgagacatctgatgtgttcaccctcccatttgccttgaatggtagtgtgtgtgttttttaattccactcttatatacacaacttacaggagagtgaattttctagtgccacccccccgccataggctatgtgcccccttgctttttttcacccagcatccagagtcgagattgtttagtgcccttcttacaggccttgttggcaagagtgagcattattatgggacaccctccccacccccgacacagatgatgcacacaggagtacaagatgatgaggctcctgatcaccccacgcctccttagacctacgtctgtgtacatcctctgtctgtgagggagagaggaggtgactccttacctgtttgtctcacatgcctcacacattggggtgtgagctgtttcagttccctcccacacatgaggtttacagatgtgcaagctttttgagctgtgccctgccttttaaacccagcatgccttcttagtgcttttcccacaagcatgcattattggagagtggactt

SEQ ID NO: 7000 - DNA, 1574 bp, artificial
  synthetic oligonucleotide
aacaatgttctgtattgattacatgttaaaatgataatattttgctttttttaattcttagtttttgtgggtacatagtgtatatatttatatacacttgaaatattttgatacatgaaatattttggtacatgaaatattttgatacaggcatgtaatgcatagtaatcacatcatggagaatggggtatctgtcccttcaagcatttatcctttgtgttacaaacaatccaattatactcttttagttctttaaaaatgtatagttaaattattattgacttatagtcaccctgttgtgctatcaaatagtaggccttattcattctagttatttttggtacctattaaccatccctacctttcccatagtcccccactacccttcccattctctggtaaccacccttttactatctatgtccattgaagtaatattttggatatattgggtcaaataaattagagcgttaaagttaatttgacccatttctttgtgcttttcttaaggtggcatccagaaaatttcaaattacatatgtggctcacatttttatatttctgttagacagcactgctctagaggtgggtgatatctcatccttatatcatgtacatgagactaaaggctgaggaagccaaaaaattaaatacattggattaaagtttgctgttgtagccattaagtctctaaggtgacattaggcctattctctaatgtttgcattattaaggggtaaggaacaaggaagcttttaaacttaggtacattctagagttttagtcccatacacatctgttgaataactgtgtaaggcattgtgttgatactgtggctcatataaaaatcagtgacttagactttgccatcaaggagcttataatgtggtaaaagaacatgtacacacacaactgtacataaaatcatatataatggagtggtagaaacaaagggcttagaatcttaagagtacaagaggttatttgcagctagcatgagggtggaaggtttaggaaggaggtgacatttgagctggttggagaaagatggataggatttcagtagaggtcccctctatactcaaaggaacatgcagaactaggtgacaggtcactgagctgacatgcttttctcttcaccaaacggaaactctgtgtggcacaaaatggagagaggtcagataccttgacatgtgggttttttaagggcccatttatgttgatatgccttcctcatcagacccctgtcttgcatatacatagaaatttccaatcatagaatacactgcttatctaagtcttttggtttctgacatcctggatcagccaggcagcaagtgatgaaacacacatatgcctgtgcatatgtttctagttatgcatagatgaatgggcaggcagataaattgtttttaaactgtagttaaaatggccccatcttgaaatttagatttaacttgaatttctcttgtctaatctcttgggcaaataattgtagctcctaccatggggaagaataaagaaaggggcagaaagaggctgggaatgttactctaacagaagtatctctacct

SEQ ID NO: 7001 - DNA, 2783 bp, artificial
  synthetic oligonucleotide
gcacacaaatgtaacaagtagtttccatgtataaagattatcaatgagaagacatttatggaaacgggatttggcctgtatgcttcctttgactcacacaatgggcatttatcaagagcagtttggatattcttgcttaaatcctgagacattatttcattcaacaaacgaaatacagagatgaataagttgcaggatgctagaagattccttgtcatctaaagacagacatacaaacaaataattttgccatgttgaataagtgttagaatagagaggtacaaaaagcaagggaagccccgagaaaagcttgatgaagtctgagttttgagctggtctaaaaaaatgagtaggagcaaatgagagaattgcattctgggcagacagagcagcactgtttgggaagttccaagttgctctgtttgcctcatgtgagatgtgtaggggcgcgacctcagatgaagcagggaaggtagttggaggccagataataaagagccttgtatgttctaggaaggattttacactttatcctgaagacaaagattctaaacagggaagtaacataatcagattttgttttagaaagattactttggcagcagtgctgagctggaaatgatgaaaactgggagtcagtcaggaggtttctggaatagtttaggggagagatggtaagggtctgagcagaagcaggggcagtaaggttagaatgggattctagaatgttctgtgactggatgtggcaagaaatgggcctggattaactaccagcttgggtgcctgggggccactggtgccattctctgagatggggagcatgggaggcagctgatgggcatgggggtggtgcactggatttggatgacctgtttgggttgagacacctatgtactgtcaggtcaatgtttcaaagacagttttgaaagtacagaactgatattggcacagatggggatctaaagttttgttcctaatgatgcataaagagcttgtatttttttctctgtagttaatggaaatgtcattactagttaatgatttattttacaataaaaacattttaatgtttaacaactcttaatcaaaatgtcatattttcatagtaaataatgtattttgcaagcccaggccctgaaatcagatgtgcttaaaattacattgaagtgaaacctcatttttccagcattagtgaagaggggagtattctatataagtaagctctttggataactgcagcttatcctttgttttggctaacctctgaagtaaccagcaaagtacgatgatagtttggaagcagtgtggtatgatagttaaatgtgtgggtctgagttctactccattggttctgtcacttggtagctacgaggccttgggcaagtaacttaatctctctgtgtggaagttttctcctttacaaaatggagatagtaatataactcatcccattgctgagtatatagccaaaagaaaggaaatcagtattgaagagagagctgcactcccatgtatattgcagcactactcacaatagccaagataggaaatcaacttaagtgtccatcactggatgaatggataaaaaacatgtgttacatatattcaacaaaatattattcagccataaaaagaatgaaatcctgtcatttgcagcaacatggatggaactggaagtcattatgttaagtaaaataagccaggcacagaaagataaatactgcatattctcactcatatgtgggagttaaaaaatgtggatctcatgaaggtagaaagtcgaatggtggtttccagaggctgggaagggaaggagtttggggaatgaagagaagtgggttaatggttataaacatacagctagagagaaggaaaaagttttagtattcaatagtacagtagggagactacagttaacaataattatatatttcaaaatggcttgaagtaaaaaattggaatgtttctaacacaaagaaaagataaatgttagaggtgatgaatatcccagttaccctgatttgatcattacacattgtatacgtgtatcaaaatatcacatataccccccaaatatgtacagctattatatatcaatttttgaaaagggagaaaagtagaacacctgataggcttggtgtgaagagaaattaagctaatatatgcagagcacttggaacatagtaaatgccatataagtgtatgccattattataatagtaaaacatttagaatattgtgtagcatataataagtgctcagtaaaatttagcaatagccgttattactactatcactattattttcttataacctggggtgggactgggaccttgttctgtggaggtaattttaggttgtccttggaagccctgtcctgtggttgtctgtttgggtctttaagtagaagtttagacttgaaaagattcttagaaaacatctagcagccgggcgcggtggctcacgcctgtaatcccagcactttgtgaggccgaggcgggcggatcacgaggtcaggagatcgagaccatcctggctaacacggtgaaaccccgcctctactaaatatacaaaaagttagtcgggcatggtggcgggtgcctgtagtcccagctactcgggaggctgaggcaggagaatggcgtgaacccaggaggcggagcttgcagtgagccgagatcgtgccactgccctccagcctgggcgacagagccagactccatctcaaaaaacaacaacaaacatctagctcaattcctagaggttaagtgatatgcccaacg

SEQ ID NO: 7002 - DNA, 1554 bp, artificial
  synthetic oligonucleotide
gcagtatagtttttgcagcgttgctggaaacatcaagttggctgttaaaagtatcactacgtttgatcactattcctattcctactattatatgagtttagacaagttacttaacctttctgtgcctgtgtatttttatgagtaaaaatggagaaataaccctcggggttattgtgaacaccaaatgagacgaaaaaagtaaaggggttaggagagtgcctggcacataagaagcagctcaaattatgtgatctaatgttattagtattagatttctactactaattactctgtgggccgaaagctcaggatagacagtttcattctaaggacaaaccttctccccagcaaaaaaaggcactgcaagctggaaatagtgaaacacaatggggcattgcgttttcaaaggcaactgacacgcccagcactgggataggacccgcccgcccagtcctcattaaatatggcagcgagcggggccgacgtactgcggctgcgcaagttgaaactcctcctggcagctcctccccggcgggcctcccctcatctcggctgggtagaggtgccgggtgtgagctcggcgtggcgcgcacgcgcagacgctggctgggctgagccgatactcgcgaggcgccctgtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacaggtaaaggcaaacgggctgtcccttccccaacagtccttggcgggccgctggcccccggcccacccccggagcaccccctaagcgcagcgacacaggggaagcgcaatcccgctggcttggacccccggagatggggcttccccgcgcccggcgttggcagcccggcgcttagaggaggtagacaggctagttccagccagtgctgagcggcgttttcccgggagcccagccctgttctccgagttatggtccctgggttgcccgagcgaagtttccttgcggagcggcgccaagcccgccccgcttttgaatcggagtgtttagccgcctgcgtcccctttcccggactggggtagggtgacttaggctggcaaagctcagccgaggcccggctcttctccctccggctctggacttgccgctggttttgtatgggtcttagcaaagtggagaaactctcggaaaagtagttgctgcgctgttttccttttgccacttaacgcgcgtagctggttctctccagactttcgagccttgctcttgagcgccttgatccacacgggaaaagctttgcctttacattgacgcacgtttcctttgattaacatttcagagcaaatcagttgcctggagttcccagtgaagttgtacctgtgcccgtgcgataacgtcagtggaagctgccccgagtaagtgagggaaatctagaagtttggagcataaaaaaccagcacgaatc

SEQ ID NO: 7003 - DNA, 6118 bp, artificial
  synthetic oligonucleotide
cagcccatcaaattatgagtgggaattggaaaaggaccagttcaatacctatgcgtagaaactgggagaaaatgacgaaagagaaaggaacataatcaaagagcaaatggcaaagtttacccaaggaaacactggaagtattataaatatcatgatggtgtatagatatcatactatcataatgggtcagagggcataatgaagaaatataagagctcaaagaagacaattaagataatattttaaccaagtttgtaaatctcagaacaaaatagaaaagaaaaataaattacaaagccacatgagaagcaaacaaataaacaaacctcacagctaaaaaaatagatacactgtgaaaaagctcaagaaaatcacaccaaacaaaatggaagagagcaaatagcaccgtaattatagagagaactacagcctataaggtaggtaaagctggtgtgagaaatccttcatctcaccccaaataaagaaatccttcatctcaccccaaatagaaacccttcatctcaccccaaataaataaattctgtataaaatgtaacagaaataagataggtatagcaacattcagtcaagaaaggagatcatgagtaccagggacaaaaagggaaggcaaatttagatcaatgaccctgagctgaagctgaaccacctaaggagggtatggcacttcggtatatactagcagtaataatgaaagggagctctggggaccccgggggggaaccttttgggggttcacaaagtcaaaactattttcacaataataccgagattttatttgaatttattgatttctttattaagtacatagtgcagttttcctggggctatgatattacaacaggttgaatatagaaggagatatgagaatccagccagatttgtaaaaatgtaaaacaatgcaattaaatgttttgcatatttgaatatatacttatttttcactaaaagtatgttatttatgtaacatgtaacatgttttcagtattattttaaatgaattaacaaattaatatttaaaaattttatcacttttaagttctattatggcaaatattgatagatataacccacctaaacaaaagttctttaggatgttcaaaataatttatttttatgttaaaattaacatatagtaaaactgagtttgttggcatgcagtttgaagaattttagcacttgcatatgttcatgtaaccaccaccacaaacagaataaagaacagttctattacactcaaaatcctttgtgctgttccattgtcacaccttaccccaaccctaagccctgacaactgatttgctctccatcactatagttacaactttttgagaatgtcatataaatggaattatacaatatgtcaccttttgagactttcttctttcccttagcatgatgcctttgagatacaatcaagttgtagggtgaatccatagttcctttttatttctgagtgctactacagtttatttatccattcacccattgaagaatatttgggttatttccactttggggctattacaaataaaactactatgaacattcatgtacaggtttcatttgaacatttttccaaggtgaatacacaggagtgggattgccagatcatatggtaagtgtatgtttaatttcctaagaaactccaaatttctttccaaagtggctgtgccattttgcattctgaagagcattgtaagagttccagctgctctgcatccctgctaacaatggttttgtctctttctttctttctttctctctctttctttctttctttctttctttctttctttctttcttttctttctttctttcctgctttcctcccttccttccttccttccttttcttttcttttttcttttcttttctttttttttgagacagagtcttgctctgtcacccaggctggagtgcagtggcatgatcttggctcactgcaacctctgcctcccgggttcaagtgatcctcctgcctcagcctcccgagtagctgggactagaggcatctgccaccacacctggctaatttttgtatttttgtttgtttgtttgtttgttttacagagatggggtttcaccgcgttggccaggctgatctcaaactcctggcctcaagtgatccacccacctcagcctgccaaagtgctgggattacaggcacacctggcctggttttgtcagtatttctaatttaggcatttaaataggtgtgtagtagtatctcatcatggttttaatatgtattttcttaatggctattgatattgataatcattttttcttttctttctttcttttttttttttttgagacagggtctcagtctgtcattcaagctggagtgcagcagtgccatcttggctcactgaaatctctgcctcctgggatttggtgattctcctgcctcagccttctgagtagctgggactacaggcatgtgccaccatgcccagctaatttttgtatatttttattggagggagatgttcttcatgttgcccagactggtctcaaattcctgagttcaagcgatcctcctgcctcagcctcccaaagtgttgggattacaggcgtgagccattgtgtctggcctcatgtgcttattttcatccatatacactctttgttgatgtgattgttgaagtcttttggccattttaaaatggtgcttaaattttctaactgctgagttgtaagagttctttatacatgctggatagaagtcctctgtcagatatgtgatttgaaagtatattatcctgatctgtagcttctcatatccttctctgaacagtgtctttcacagaacaaaagattttggttttgatgaagtccaaattataatctttcttcttttatagatcatgctttttgcgtcatgtcaaaaaattttacctaatcccagattatagagatatttctcctgttttctgctaaaagtttcacactattatattttacatttatatatgttgttgattttgaattaatgtttgcataaggtgtaaagttaaggttgaggttcttttttttgtatatgaaagtacagttgttccaataccattcattcatttgttgaaaatataatcctctcttcattgaattgcctttgcacttttatcaaaaatcaaatgtccatactggtgtggggctatttctgaactctctgttctgcattgatctacatgtgtgtgccttcactaacaccacactctctggactctataacttcatagtaagtcttacagtcaggtagtctcattacttcagctttattcttttaaaaattgttttagctattctcattcttttgtcttttcatataaattttggtatcaccttgtgatatggtttgggtttgtgtccccacccaaatatcatctcaaatttaattctcacatgtcaagggagcaacctgtaatacccacgtgtcaagggagggaggtgactggatcatgggggcggtttcccccatgctgttctcatgatagtgagtgagttctcacaagatctgatggttttacaagtgtttgacagctcttccttcacactctcacactctatcctaccgtcttgtgaagaagggcttgcttccccttccaccgtgattgtaagcttcctgaggcttccccagctatatggaactgtgagtcaatgaaacctctttcctttataaattacccagtctaagggaagttctttatagcaaggtgaaaacagactaatacagtacattgataccacagagagtggggtactgcataaagatactttaaattgtggaagcaactttggaactgggtaacaggcagaggttgaaacagtgtggagggcttagaagaggacaggaagatgtgggaaaatttggagcttcctagagacttgttgaatggttttgaccaaaatgctgatagtgatgaagacaatgacatccaggctgaggtggtcttagatggaaatggggaacttattgggaagaggagtaaaggtcactcatgctatgctttagcaaagaggctggcggcattttgcccctgccctagagatctatggaactttgaacttgagagagattatttaaggtatctgacagcagaaatttctaagcagcaagcagcagagcattcaagatgtgacttggagtattctgaaagcattcagtcttatgtgttcacaaagaggtaatttgaaattggaacttatgtttaaaagggaagcagagtataaaagtttggaaaatttgcagcccgatgatgtagtagaaaagtgaaacccattttctgggaagaaattcaagccagctgcagaaatttgcataagtaatgaggagccaaatgttaatcaccaaggcaatggggaaaatgtttccagggcatgtcagagaccttcgtggcagctccttccatcacagacccagaggcctgggagggaaaaatggtttcctgggcagggcccagggcccctgctgctctgtgcagccttgggacttcgtagcctgcatcccagatgctcagatctagctaaaaggggccaaggtacagcttgagccattgcttcagagggtgcaagccccaagacttggcaccttctgcttggatgtccaggcagaagtctgctgcaggggtggagtgctcatggagaacctctgctagggcagtgtggaaaggaaatatggggttggagcccacacacagagtccccactggggcaatacctagtggagctgtgagaagagggtcaccatcctcctgaccccagaatggtagatccaccaacagcttgtaatgtgtgtctggaaaagacacaggcactcaacaccagctggtgaaggagctgcccaaggccatgggagccgcccccccttgcatcagcatgtcctggatgtgagacatggagtcaaaggggattattctggagtttcaagatttaatgactgcccaactggatttcagacttgcatggggcccctttgttttggccgatttctcccatttggaatgggagcatttatccaatgcctgtacccccattgtatcttggaagtaactattttgcttttgattttacaggatcctaggtggaaggggcttgtctcagatgagactttgaacttggacttttgggttagtgctgaaatgagttaagactttggaggactgttgggaaggcatgattggttttgaaatgtgaggacatgagatttgggaggagccagggctggaattatatggtttggctctgagttcctaccaaaatctcatctcaaattgtaatccccatgtgtggagggaaggacctgtaatacccatgcattgaggaagggaagtgattggatcatgagggcggtttccctcatgctgttctcatgatagtgagtgagttctcacaagatctgatggttttataagtgtttgacagttactccttcacatgttcacactctctcctgctgctttttgaagaagatgcctacttccccatctgccatgattgtaagtttcctgaggtgtctccagccatgcggacctgtacgtcacttaaacctcttttcttgataaattacccagtctcagggaagttctttatagcaatgtgaaaacagactaatataccttgttaatattgaccaaaatattgcttggattttgacaggaattgcattaagtatatacattaacttgggggagaattgacatctttactatgttaaatttaccagttcatgaacctgatatgtccctccatttatttaggtattcactgatttcttccatcagcattttgtagtttttattatacacttttggatttgggactgccatgagttcaaaagaactcatgaaaaaataaagtggtaaactcactgataatttagagtattatgaaatctagtcttctccaaatccagtcttctccaaataaattaagtcttctgtatttattttcaaagtactcaaatagctgctccatgtgttctgtctatgttttatagctgtatttagtgagggagacactgtgcagtttgctcacttcattttacccagaacaaaacccagtaatttttaagtttgagaacgattacattttaggg

SEQ ID NO: 7004 - DNA, 336 bp, artificial
  synthetic oligonucleotide
ctagatacttcttcataacaaaagtctattcttgggttccgggatccttcatcataaagtagtactgaaactttatcccacctggagaagggatttccactccgctccaggctttccgtatcacctaaagggaaaaaaacagtaaatagggaacaggcttaagggaaatagattggaaatgctgcaatcaggaaggggagtagggagatgagttaggctcctgaaggaaggatggaaccatttgtgtaggctacaacccccgagacccaggcacactcaaagactgataattaatcagaagattatagactgattcccttcccccacaccctaccc

SEQ ID NO: 7005 - DNA, 1999 bp, artificial
  synthetic oligonucleotide
gccagccaccaccaggattaggggactagactcttcctagaacactctttctcctcctactcctgtcctgatgcctgccctgggctgcactctctgggaccagcagctacagcccgacaccctcgagccatgacccaggtctgagccacttgctctgggcacactcctcgtgggctctggggtgctgctgcccagtgccagcagccccttggcacaggggttcccagaggcctctcagcctcatgtccgactccctctccctgctggcagctccacaggcttctttccacttccacctgctgcccccctcccccgggatgctgccagggcttaagggtcttgggagtgtgtcctgtagtttaggccccctctcagctgtaggggaagtgccagctgtagggatggccttgtcgtgcctcgtccctccagctggccttggagagaagaggtggattgtgccatcgggctgctcagcgtctgctgggccaggaggccggctgtcaagccattaacccacccgtggccttgggagcccaggaggacgcgagcagcaggcccagaccctgcagagcgctgataagatgggccagggacgcgcctctccaggcccagcggccttggtagcccggcccccccggagctggggtccaggcctccccagaactgcagctggagcttcatccttttcgggaagcgcaggacctggcgtgggaagggagacagggacgaggctagaggcaggctcggccgccgaaatgatggcctgtcacggcttctgcctgcgctccctaggacccccctcagaggggacatttcacagcctcagaaacatttctggacttggcacccgctcggcccccagccccgcagtggccgagggaagcctgcatagacgaggggaaggacgaggagaggggaggagacgatgaagggggtcagagcagcgattggagccgagagctggaagcgccttaaagagactgcgcggtccccgccccccttcccgccagcctcaatgaattagagctgtgtttcccaaacttgcctgatcataagcagcctctggggccctagttagagatacaggttccggagtacctcccttcgagattctgattcagtaggcctgcgggtggagccaaggaatctgtaattttaacacgctccccacgtgattctcgtgaacaagcaagtttggaaaatactgaattaaaggaaacggggcctggctgcagaagcagcctccactagggggcttcggcgggaggattcccgggggcgtcgcctgcttccgccgccgcctccttcagtgaaagtcccttttgggtccagctgccacagccaccgcgctccctcaggccgggcgggggacaccccaggtctgcgtggcccccgcgccgccacgcccagtggccgcccgagccctgcgagcagggggaggagccgccgccagtggaggcggaggaggtagaggaggcggagacggcggagaaggcggagaggaaggtggaggcggaggcgaaggtggaggggaaggcggaggcggcggggaaggcggaggcggcggggaaggtggacgccaccgagaaggtggagacggcggggaaggtggacgccgctgggaaggtggagacggcggagggtccgggccgccgggctgagctcaagctggagcccgaacccgagccggtccgggaggcggagcaggagccgaagcaggagctggaggatgagaacccagcgcggagcggcggtggcggcaacagcgacgaggttcctccccccacccttccctccgatccaccgcggccccccgatccctctccgcgtcgcagtcgtgcgccgcgccgccgaccccggccccggccccagacccggctccgtaccccgccgcagcctaggccccggcccccgccccggccccggccccggcgcggccctgggggcggatgcctggatgtggattttgccgtggggccaccaggctgttctcacgtga

SEQ ID NO: 7006 - DNA, 2638 bp, artificial
  synthetic oligonucleotide
actccagtatattatgtgccaccaagaaagaaaaaaaaatgctgccaaatataatcataaattgtcatttaaagatttcagggatgttgaaaatctttaaatgattttcatttaagatgtacctcttagagttgacaaaatatgatatatttttttctcatgtaaggataggtccagaggtgatcagctttttggtctttccatcatgattggttgcaaaatggctataagctatagcctttaaatcctcatttccagaaaggagaaagagaaatcaggaagggggaaaatgccttttagtttttatagtaatttaaggatcactttttaaagtctaccccaaaaaactcattggaagtttttactggcattgcactgggtgtgtagatcaatttggagagaacttctatatattacagtctaatttatatttcattaaaaaaatacagctggacctccatatccgtgggttccgagtcatgggattcaaccaaacacagatggaaaatattcaggaaaaaaaaaggatggttgcatctgtaccaaacaggtacagactttttttcttgtcactattccctaaaccaggggtctccaacccggggggccacctgttaggaaccgggccgcacagcaggaggtgagcagcgggcgggccagcattatggcctgagctccgcctcttgtcagatcagcagcggcattagattctcataggagcatgaacgctattgtgaactgtgcatgcgagggatctaagttgcacgcgccttatgagaatctaatgcctggtgatctgaggtggcacagtttcatccggaaaccatctccccgcccctgaagccccccatcccttcccaaccgccgttaaaaaaaaaaagtcttccacaaaacgggtccctggtggtgccaaacaggttagggatcgctgccctaaacaatagagtacggcaactatttacatagcatctgcattgtatcaggtatgatacaaaaagtaacctagagatgattcaaagtaacctagagatgattcaaagtaacctagagatgattcaaagtatatgaggggctgtgtataggttatatgcaaatactacacaacattttatatcagggacctgaatctctatggattttggtatccacaggggtcctggaaccaatctcccacggattaccaagggacaactgcatgtataaaacatgcttgtatttgcatagacaatttcttaaaggctaaatgtgaaagtgctaacaagtagttatctcaggggaataaaaatgggtgtgattggcgggggagggaagagctttaacttttcatgttatgccttgtataccttgttattaaaaaaacacgaatattgtatatattacttttataataataaatataaactagcaacttttaaagtggaatgtgcatcaccctggagtacaggagttttaaggggatcaatttctatatcctcaaatttcctgtgtagtcttttaaaattgacctgccagagaacatacttgcagtgtaggaatcaaactggttctctttttctatctcccctttcacaatggtcctttttgcactttacaaaagaaaaagcatatcttttacctatcctgaatcttaacctgggtgcgctgccctgtgatgtaaaatccttggggcacaggagagacaattccgaacaatgctgacgatggtaaacaaacaacttgctctaacaaatgaatggggataaaatccttttgcaactcagatggtttccaattctttgcttccagtagaattgaagaaaaaacctatgaagttatcagctgataaatcatgagaaataattttgaggataaatcattgtgtaatttccccccatatatctccaaaggaattcaaagacttgcgtgcattgctaaaacaaaatgtccattcctattcacttattcatataaatgaggtttctgtgtgctaacatttaaccaaacaaaaaataggaagagaattgatgctgaagcctatctcattctagcaaaaagcaatgtttatccatggatacacccattaattttttttaaaaaagccctatctacaatgaacttttgttttacgtttaataattacctatcaaaatttgtaatatattcacaatgttttgatccattttattctaatactaattgtcatgataattcaaacaagagcaaatttttaaacaacacttagagccttataatcagaggaacatttaaagagcatttaaattgaaaaatatatacacatttttgctgcagagaaatacgataggataatcaaaaacatttcaagtgaaaaaacagacaattattgagacaaaattctgttggaaaaacagaatggaattaagagctgagaaaagggaaaatgtacaacttccaagtatcaaagaagagctcagttatacatttttaaaacagatgatggtggctctcaagtcactaaggtatttaggtttcaccggattcatgtgaaatagtgacataacagttttatttttgaatattaacatttgtcacaaattacattatttgtagccaattgacatttgtgatgcaaaatatcagacatcaacccaaaaatgtgtgaaggagcacacgtttttct

SEQ ID NO: 7007 - DNA, 559 bp, artificial
  synthetic oligonucleotide
gtactagtactaccactactactattaataggaccttacaaatatcagtttttgtgttatcagagaaatatgagggtattgttaaatttgaatcggatgaattaccttttggtgtaattggttctaatattggtgatgcacattttcaagaattcaggtaacattaaacactcagtgaaatcacttagatttttacactgtattgatacatagtttatatttattccaaataagtatttgatcatgtccatttcaatgaattctgggatgaaatgcctatgagcacatctcccttaaaagcaaaggtgaaaattatgctcactgttattttatataagtagtagaagcagaaaattgtgacttataattcttcattgccctctaaaaagattaagtccttatgctggaggaccttttcttctgagtgcaaataaaataaaagcctcagaatggtggcctttcccacacttgaagtagtattaagtatggggtaagtgtccaatctgaagacagaagataaaacagagctcaatttatctgcatcaaaaaattgggagac

SEQ ID NO: 7008 - DNA, 4644 bp, artificial
  synthetic oligonucleotide
cacaatggtattccctggagggcaagaaagacttttagtctgggccttgggattgaggaaatagaagagaatctgtggtgtttacagacactagcaccatccattagggtaggaacagtaagaaagcaaaggtttgtgtcaaagacttgaagttttcctagtgtgggtcttcagaaaaccactttagggcctctgagaaaaaagacactgccatactggcttggtagtgagagtcaggtaaagacctcattcctcccattactggaacagccatgaggtctcctgacagcaaggtgacaatgtccagataacaacaggtgaacaaaatagccctacatacccagagacagagccacttgccttgggcccagctgttcactaagtcatcgggttcttccatttcagtgcaagggtgcctagccaatgtagtgagcaaaggttgatttcaagattgaattttgagggatcaaagttggagcaggtcaaaattattaacaactcggcgatgcccgatcccttctgcctgcagctactaacactgcatggttcctagcttaacaaccctctgaattttggggaagcttcctgtaaacactaaataaaacaaacaatatgtcttgagagcagtgtgtattatggttaaaagcaactgaatattgttcctccagctgggttgcatgaatgcatatcaggggaaccatgagtcccattgaattacaggcaaacgtactatgccaggtgcttttcatgcatttttcaagggagaagagatatagcgtaatcagattctcagaggggtctgagtcttaagccactgttgcaatggggagtcttggatttgtgctttattaactgtgtgtcctgtgaaaattcatagggaacccccatgtcatattttcctgccagtagagtggaaaaaaccaatatcaaccccataacattattgtggggaattaattaaaagatgctttataaataaattcgttttaaatgagacgttcatgtgttcccttccccatcccccaataaatagctctattaaataaaaggcaaccggttgagattttggataacagagatatgtatttttcaaaaatgtatgtgtacacagtttatatatgtggaataatgatgtgtctaatcctgtattttttcaagaatcattttcatagattatttggcatcgtgtgctttaaaataatgatgatgatgataatgataattctttgcacttgcatagccagtagtcctctcatttatctcatcggttgttgacaaagccctcctcttactcttgtaaatgaaatgaggctagtgctgggtctgcagtgtttggttgccatggtttaaattcgtttcataagctgttgcttggcaatcccacgcgtcagctggctctttttcctcagcactctcgccacacgctgtctgaagtataatgagactgaggctgggcaaaggaggatggcagtccccaagcacgttccatcttcccacacaacactgtttgttaccatgatgcttgataaatgtgttaaaagcagagcagtgaagtggttgcaaacatgggatttagtgtcacatagacctgggttcaagttctgggttgggatttggctcagtgtctcctttggccattcacctagaaacccgtctcagtttctccatgtatcaagtgagagattataatatgcagcacctggagtggatgtgagaattggaggaaaaaattcatttaaagtacctgcacacagtaggtgctcagtagctgtaacctgtactaataagggtcatgggagctggtagaactataactttccttgttctgtagtaaaatgctctgatgtagcagtcagtttggacttaatttgtgtagttgtggcccactttcttttatacatagtatgagtgggctcactacaaatccatagagtaaaacagaaatttataaataaactatcaggatcaaggaaaagactgggagtgttgtgactaaaggaagacaagtagagatgctgcagacagaacatatcaatagatgtccactccaggtagtgagtgggtaggcactgtgcattcaaaggggctgtcatgggggaggcttctctcctccctagataaacacatacccatgggcagtggtgtgcaggtaaaacagctctcagggagagaaaagccttgatttgtaacatttgcctatttctgtggtgtaaatactcctaccatgaccaattttaaactaccaatgtgatgccattgaagggagtgtagagttggaaagcaatgcccacaattggctctcgggagcccatcagagcctgcttcagcgcagaagtaatcccttccctaggggaagcttttttgtttttgcttttgttttttttctcttttgtggacatttccaacaagctcttgtatttatagcagtttagggaggtcagttctcaggactgctcttctggcatttgattttccctgattggaagcatatggctgaggaaatagcctctgttctgttgtgcaggcccatcccacatctccataggctgacttcagcaccctttctggcttaagatcaggagcccatgatctttgcaggatccagaggagacttgggagctaggaattacctagatgaaaatcttaattgaggtagtatcttctcccaaagttattttatcttttttatataacccaactcagccatactgccctcgtcatagtctctcatactctcatggtctctcatattcattgtagcattctcagtgctacaatgcatgtgaccttactatgtttatattagccaccaagcagtttcaaaatgaatcactttttaaattcatccatgccactgtaaagctgcttcatctaatatgacttcagtgtagttgtctgattttgatagctggagtaaacaaactgtgcgtgcttgaattccattctggactgaacagtttcaagtgtcagtcagtgatgctcatttgtaagaacaggcacattgaccagctttcagtgaaaatatgttgcatgtgttttacattttacatggtccataatttgtatttcctttccacttcgtatctgacaatgtccagttaaatggctcctacagacagagtgccccaaaacatagtgtctttcttacgaatcagctgaaaaatatcaggatgtttatgaggcagcagaacaggaaattagatataaaacccacaactttctaaggagggtaggccctgttaacaggagatttttttgtgggggcagtggggttagatacaaagtcatgaacctcaatataattaatggcctgtcacagttctgagagttttcagtagtgggtggagtgtacaaatttgaaggtagaagctggaagacacttaaacttcccagcaaaagcaagatccttgagggagagaccaaagtcagggaaaatggaagcctgttagggagatggtgcagggagtgaggggagggggatctgattactggagactgaaaagaaagatttgtgagaaggaataatgtctaatggagactttctagttaaattctgtggggggaaatgctcctaatacatttcccccaggacattttcatttaattctacaatgctcactgtttaatgggcacagattctctatggtgaatgtgagtaaaatcgtgttccaagatttagatatggtagaaaaacaaagcccatgagtcagggtagcagacatgtggcttatatatactctcgtgtgaatgaagggacatctttgcatagaaagatctcatgttcaccattaacttaccaggtaggggtgggggatggagggtattttctgtgcctagctggaggactgtaggttagacaggcttggtgggaggatggaaatggagtttctttaacgagagcctgcaggttcctggaactcctcctcatgctgactgctcagaagtgccccaccaaattctgcccagtggcggcagagtcctgctggggatggtctcgtcagatccagaagagtggcttataagcaagaataagcatacattttctcttaagaaaccagagttaacaattattttattttccattgtcttggtcagcttgggctactgtaacaaattactgtagactgggtggcttaaccaacaaacatttatttctcacagttctggaggctgagaagtccaagatcaaggtgccagcagatcctgtgtctggtgaggggccgcttcctggtttgcagatggctgtcttctcattgtatctcacagggtggagagtagtaaaagctctttggagtcccttttataagggcactaattctattcatgacggctccactcatgtcctaatcacctcccaaagactccaccacctaataccatcatattgggagctaggatttcaacatatgaatttggaaggggggcataaacattcagtccataataccaatgtttttgaaatatttgaaaatgttgtataccaaaaggaagctcagggactttactcttaatattgttttgcctttaagcctttgtgtccatttaaaacttctcaagtcttcttttatatattgaacaaattttcagatcctaaaagagctcatttctaatttatcttcaggaaattttgcctcactgcctttt

SEQ ID NO: 7009 - DNA, 692 bp, artificial
  synthetic oligonucleotide
aatatgtgaccttttgtgtccagcttttttcacacagaacagagaaaaacagctaccatttattggttgccatgactactatgtcctacgcactgttattgagagctttgtgtgccttatctttaatcctcacaataaccctgtggcagagtagcactatcatcttcatgttaatgaggagaccgaggcacagagctgttcagtaacttgcataaagcgcagcagcgcatacatggaagagttaaaacgcaaatccaggtctgtctgtatccaaatcccataccctttacattccatctttctgccttagcgtcacatggatgtgggccagtaatgtggtggcattgcagccagggcaaaggagttgagccaaccacgtggtgctgagaagcatagccctaagatctcctggacctggtgtcttttagtggggtgggggctggggatgccctatctcaagcctgtgctcctgaccccagtaaatttgcctgctgaggtcctgcttgcttacttcttcctgcagcttcttggcggccccagctgcagtctttggttttactcaatttggatgtgtaggttacagagtttgtatggtagagtgtctgtatttcttcatctggctttggttacacgtggaaacatgacaaagcaagtcaagctttctatgaagagaaggacaaaaattcactgaa

SEQ ID NO: 7010 - DNA, 2502 bp, artificial
  synthetic oligonucleotide
gaaatatttggatgagattggggaagtggaactcaggtttctcttggtatttataattgggtagaatcaaggaaacctaaatggccataatgttttacctttaccctttgctatggtttgaatgtgtccccctcaaaattcatgtgttggaaacttaattcccaatgcaggagtgttgggagttgggacctgataagaggtgattggctctgctctcatgactagattaatgtcattatcatggaagcaggtcagttattatgacagtgggttgttataaagtgagttcagcccctggtgcctccctctgccttgagcactggtttcacctctgccttctgctgtgggataacaaagcatgaaggccttcaccagatgctagcaccagcctcttggacttcccagcctctggaaccataagcaaaataaacttctattctttataaattacctagtctgtggtattctgttatagcagcagaaaacagactaagacactcatgaaatatatataacaaaccagcgttatgtgcacatatgcacaaatgcactcatactggaggatacagtgagtgtttgagtttttatatcttgtagttgttcatgcaagatggtttatggagttgaaatttgtcatccatataagtaatgtactacttgaaattggacaaagtatggagaagagccttaaaaatcattgaaaaaatgaggtgagcttaaaagaatttaatatgtgtagctcagggaagctgctgtttaggagaagtgggaatgtgcctctgcttcaggactgtaagtccccaaagagtaatttgcaggcagtaagaaggcactacagagaaggaaatgggcagaaaggaattgaagtgtgtcttagtttgctcaggcttccataacaaaatatcacagactaggtggcttaaacaacagacatttatcctctcatgttctggaggctggaagtccaagatcaaggtgctggctgatttggttctggtgagggttccaatcttggctcacagatggctgctttcttgctgtgtcctcatatagtctcttctttgtgagcaaagaagaaaaagaatgaaaaaaacaaaaaaagaaagaaaaaagaaaaataagaaaaggaaaaagaaagaagaagagcaagaagaagagctctgttatctcttcttttaaggacctgccctgatttaattgaggttaaataactgtatgacttcatttaaccttaattacctccttgtaaaccctatctccaaatacagtcgtattggggattagggtttcaacttatgaatttggtggagaaacaattaattccatagtagagtggaagctataggcagtagaatgacctcccagggaaacaacggggacagtgatgctattcctgaggaattaaaagtgcattgggctgggccagttccacaatatgctgtaggaagggcttccttccctcctggccctttggagatgtgaggaagggactgacagactaaaagctttaggttgcttgggagatatcgtctgataaaaactttaatctggtaaccttcctctctctttctctctctacctctcactctctctctgtctggctctcttaatggaatgctagtgtattcttattaggaagatagaacttggttaggaaggaaggaagaaaaacggcaggcaggcaggcattggagccagcaggactgggagatcacaaccacaatctcctgggcaaaagaaaggggaaatgagaagcagtgctttctcagtcatgcgagtagttactggcagtttgttctggccagcagaacttctgatatcatggctattgaataacttatcatcaaagtttaatgtgaaaccaggtgactgataactaaatctaggaacagaaatagaatcttcattttttctgcctgaagaaacttttttctgtcatttgatttaaaggccaaaggctattcaccataccactgagaattataaaacctttatgaaaactcatcacagtgttgaattgaatgtgtgatagagaggaaagctgggataatttcaatccttacccgacccatcttaataaggtaaagactcctgtgaaagctaccatactcaacgcagtgagatcacagcatagccgattttttttttttttttttttttttttttacctctttctaggttgaatggaaatgaggcagtagccaaaggggatagaaataaacgttcttctcttactgtgattgtgtggatctgatgggcttttcaaaatggcacatgggtcagtgtttcttggagcctggactagcataccctcccggcatcttaagagaaacaatctccaggcttggtagaagtccttggctttcttgcttagaaatgtcagaagccaatgaatatttacatccccatctcacctttgctctgatttgctaatctgatccttatcaaattaggccaaaaggaaagcagttagaaacttgaacttccattgttagataagta

SEQ ID NO: 7011 - DNA, 871 bp, artificial
  synthetic oligonucleotide
tagattagtacatttgatcatatacagaagagaatctgagctcaattgaagaagtgatagaaatggtatttccccatgttttacagctgggatgtggtttgtttgtccccagaaaatctcatattgaaatgtgatccctagtgtggcagtgttgggaggtggggcctagtgggaggtatttgggtcatgggggtggatcccttatgagtggcttggtgccattttcgaggtagtgagtgaattctcattcttgtgagactggattgacttttgcggggaatgggttattataaagccagaatacctcttgggtttggtcacccctcttcacatgtgcccacttcttctttgaccttctctgccgtgttttgatgcagcagaaaagccctcaccagaagtcaagcaaatgctggcaccgcacttcctgtacagcttgcagaaccatgagctaagtaaaacctttttctttataaattacccagcctcaggtattttgctatagtaacacaaaatggattaagacaccatgactcttctggttaaactggagagactctaattaagctcctctctttctcacaaatgctcattattttgtctctgtctacgcattgtcactacttagtgttctttacctttaaaaaagttcacaataacacagatgatcctctacagtcatgttagtgcccttgcaatttccaaatctcattctgtggggtggatgctgcctctgaatgatggtgactaagcaatttgacagggtgctgtcaaaggcaaaccacaattggacagtaattaaagtggcaagaacaaattttattcaggactattgcaataggagacctcatatagaactgagctcaactttgaa

SEQ ID NO: 7012 - DNA, 4151 bp, artificial
  synthetic oligonucleotide
ctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataaaacaccacatatttatttacttccctttacagcaaaacctattggaagaaatatctatacgagctttcttcagttcttctatgatgcctttctgaaatagccccaatcagatcttttttgcccaaccatttcagcaaaactgctgaagatattcacattgttatagccatggttaagtctcagatgtcatcttacttgggatattggcagcatttgacatagttgatcatctctaccttgcaaccctttcttcacttggtttccaagataccacactctcctcatttcccttcttcctcactggccactgtgcaaagctgtcagttctcttgaaactgctttgtaggttcaatgcaaatccaaccacaattccaatagagttttgcctgtgtgtagatcatgacacattaattcttaaatttatgtagaagtgccaagactagccaggacactgatacttattgtaatggtatattcagatggcacgatatttttgcaagagtagacaaatcgaccaataaaaaaacagtgatctcggaaacagtgtagacacactcgtgtagacacagaactggtgaccaaggaagtgtgttagaccagtggggaaatgattggattttgaataaatagaacaattggttacccgcattgaaaaatatgaacttggatccctactttacaacacaaataaaaataattctaagtgggtttaaagcctaaatgcgaagggcaaaaccaaagcgctttaagaatacaatgaggcagggccgggtgctgtggctcactcttgtaatcccagcactttgggaggtctagatgggcggatcaggagtttgagaccaccagcctggccaacatggtgaaaccccgtctctactaaaaatacaaaaattagctgggcatccacctgtagtcccagctgtttgggaggctgaggcgggacaatcgtttgaactcagggggcagaggttgcagtgagccgagatggcaccactgcactccagcctgggccacagatcgagactccatctcaaaaacaaaacaaaacaaaaaacaaggcaaaacaccttcgtatactcatggtagcaaagtttttcttcatcacgacacagaaacaaccataaatgaaaattacgaaacattcagtgaccttaaaattaggaatgtccattgatcaaaagacaccataaagagagtgaaaaccttatgtagtaggttgctatgaataaaagcaaaacaaaaaggagtgaaaacacaagtgaaaaattgggaggagataatggaatcacatataactgatgaagggctcaaaccttagatgccaataagcatctaaataaattgtggtatattcgcagaatggaatattgtataatgagaatggaagatccataactgcacgaaagcatacagatgaatcacaaaaagccaaaaaaaagcttccacactgatccatttatgcaaagttcacaagcaggcaaaactcatgaattaccacctaaatggtgacattgtaaagaaaagcgaggggctgattaccagagtcaggatagtgttcacctctggcagagggagggatgtggctgagaaggggcccagaggacttctgggatgtcaataatggttcactgcttgacctgggagactgttcatggatgtgcaatttattcatcatcattaaaacagacttatgggctgggcgcggtggctcacacctataatcccagcactttgggaggctgaggcaggcatatcacttgaggtcaggagttcgagaccagcctggccaatgtggggaaaccccgtctgtactaaaagtataaaaattagccgggcgtggtggtgggcgcctgtaatcccagctacttgggaggctgaggcgggagaatcactagaacccaggaggtggaggttgcagtgggccgagatcgcaccactgcactctagtctgggcaacagagcgagactcttgtctcaaaaaaacaaaacaaccccccccatacatttaggttttatacactcttatgcaaagacctcacaagtgaagcagagtgcagtgggaagtgggagtagcatgagtgtccgagactcctgcacacaggcttgcagagactccagcctcctggtgtgaaccacagtgtaggcggcctccttcctgcagaacaatccctgggctccgggtcttgccttctgtttgtggagatcgactagtggggaatcctctatcgtgtgcccctgacaccagccatagagtggggcctcttgggatggacaggacctgcccatattgtcctcagatgttggggtccatctcccctcaggcctcattcacacccacaatagcccaggacacatgggctttggggcctggtgggcctcataaaagcctggaaccccgagccctggtggtgtgaccttgggcaagtcacccgtcctagaccagcctcagttccccattcataaagggggctaatgcccatcaagcagggtaggtgcaggctttggggaaaacgttgtactgccctcctcctgagcccatgttagacaggtcttatagtcaaggcagggtaggagggtggacaggaacaggggctggagcgacacagtttgggactaaattgcccagggtcacacagtgggc

SEQ ID NO: 7013 - DNA, 4767 bp, artificial
  synthetic oligonucleotide
aaggttgaggacgaagaaggacccaaagatgacaaggctcacaaagtacacccagggcagttcataccccatggcatcttgcatctggggagagaaaaggcatgcatccctcagggtaggcagacactcctgcgtgagtgtcagggaggaaaggcaggtgcagcctttgagctctgtgcccacagtccacctcacccagtagagcacatcggtccagccttccatggtgacacactggaagactgtcagcatggcgaagaagaagttgtcaaagttggtgatgcctccattgggccctggccagcgcccgcggcactcagtctggttcagcgtgcacgcacgccctgatcccgaagacgcacagggcgatgggtcctcctccgcttccatgtctgcaggaagactggagcttggggcttcgaagcaggcccactctcagtcgctgccaccctgaagccccgcccacttaggaagctcgacttgggtcctagatttttctctttctctctttctttctttctttttttgagacggggtctccctctgtcgcccaggctggagtgcagtggcacgatctcggctcaccacaacttccgcctcccgggttcaagcaattctcctgcctcagcctcctgagtagctgggattaccggcgtgtgccacaacgcccggctaattttttttgtatttttagtagagacgggggtttcaccatattggtcaggttggtctcgaactcctgaccttgtgatccgcccgcctcggcctcccaaagtgctgggattacaggcgtgagccaccgtgcccggccagtcctagatttttctaaggcaacacttagctccacttctagggcagaaccctgcgagctccgtattctgaaccactgggaagctagggatcccaccaaccgggatttaaatcctggcgtggagtcttgtaaataacaatgaggcaagagcctgggggcggagtcttgtgaatttggacgcgtctcttgaaaataggggaggggcaaggcatgggcgggagtctgggtaaatggtctgagtgtatgagaacagtcgtggagaataaagcttttttttggtttgtttttgttttgtttttgagaccgagtctcactctgtcgcccaggctggagcgcagtgagtggtgcgatccgatctcagctcactgcaacctccatctcccaggctcaagtgattctcatgccgcagcctcccgagtagctgggattacagacatgcaccaccacgcccggctcaactttgtatttttagtagagatggggtttcactatgttggccaggctggtctcgaactcctgacctcaagtgatccatctgcctcggcctcccaaagtgctgggattacaggcgtgaaccacggcgcccagccgaggataaagttttttaaaattgtttttgttattattttttggagactggatctcactattttgcacaggctggtagcaaactcctgggcgtaagtgatcctcccgcctcggcctcccaaatgccgggaatacaggtgtaagccaaggcgcagagtttttgttttgttttgttttgtttttgagacggagtctcgctctgtcgcccaggctggagtgcagtggcgcatctcggctcactgcaagctccgcctcctgggttcacgccattctcctgcctcagcctcaggttcacgccattctcctgcctcagcctcccgagtagctgggactacaggcgcccgccaccatgcccagctaattttttgtatttttttagtagaggcagggtttcaccgtgttagccaggatggtctcgatctcctgacctcgtgatccgcccgcctcggcctcccaaagtgctgggattacaggcgcagagtcttgtcttaagtgcggggcacttgcacttaagtcttaagtgcggggcaggaccttagcctgtgggtacagtctcgtgatggggcggagctattagcgaggtggggttgtagtctgatttagggcagagtcttgaatatatgggtgggacttggttatctggggatggaacctgagcctgggggccgaatcttgtgcatttcagtgggtttccctgagtgcagcattggatctaggaaccgaaggagggggcatgttctgcctaggaggggcgggcagactaaccggatcccaggaagtagcacgtcttgtgcattcgtccaaggaacagctcgagcccaatgatggcataaatgatgatgacgaagagcacgagcagtgcaatgtgcagcagcggcaccagagccttcatgatggaattgagcactatgtgcaggcctgcggggagggagggggaggcagaaataagggcggggtcagctcagccccacccccaccctccacctccgacctcgggggatgtgccactcactcgggaccccagacaccagcctcagtggccgcagcacccgaaacgccctcaatgccttcacatcgaagcctcctggctttcccccggtgtgcggggcgtcgcctggccgtccggggccctgctccagcagaacgctgaacagcctgatgggggagcaccgggcagggaggcggaggtcaggccttgggattcccccctccaccctaaccttctcagaaaagcacaagtccctgtaactagaaatagaaatgggttttaataatattcctgattctggctgccgaatgggggcggtctgaaagagtcgctttcctgagcccagaattcagcgggcctgacggtaggaaggcgactagggtggggtgcctcccgcagacgcgcacccgaccacgacgatgatgaagtcgagtaggttccagccattgcggatgtaggcgctggggtggagcaccagcccgtaggccacgatcttgagcaccgtctccacagtgaaaatcaccaggaatacgtactccacctgctcctgggggtgggaccggggggcgggtcgggaagtcggggagttatttgaaggcgaggtttgacgggggcgtggggagcatagtcaggaccgagggtggggctgagccaggcagggccatccgggtcagagagggggcggggtctggctggaaggagtgagctctactggggctctatttggctgggaactggctggggcggggcgggccttaccaggttgtggttggcagtgttggagtcgtcctcagggaaggggatgtaaactcccagggccacgcagttggcaaagatggtcagcaggatgaggatgtcgaagggcctcaggtggacacagtcaaggaccctggcagagtggcattggaacccccctactcccttgggaacctcccacccagtgctgacccttgacgcccaaggtgacaggtcctggcattctcgacccctgccctgacaaggccttgactttgtccctcctggaaaccttaaccatccccaactcttgctgtgattcagtccttgactcttgaaccctggtgacctttgcctttctgaacctgccccccaacccagttcttgactcttgaccttgatgatctcagccctcctctgttccagccctgacccaattctttactcctggtaccctgatgacccttacccctgggccctgcccctgccttccaggatgcttccactccacgatgctgatgcaggaccgtcgcagaggattggccagggtgaggcagaagagtgcccgaggtgaccgctgggcactggccactgccactgtcttgtgcttgctgtgctggtttcttcgcttaggggtccctaggcctgatgccccactgctttcaccttccacagctgggggcccggggcacagcccccattcgggaccagggcctgccccattggctggactgggctctggggtggtgtctatatggagaaactgtgtcagggagggacagggtattggggcaattgtggctgcttcctacctgatcctgtccctctgtttgaaggaaggagagaagagcatggaaaattagggagaactgggagtagctgggttaaggactgggaagtaagagtgttcgaattaagattagagtgagagtttataggggagtgaaggtgagattacatttccaagtgaagtagggtttggtgtttaagttgggggtagagtttaaattgccatggggtgggcgaatttaaggttaaatttgagtggtgggttttgggttagggtggggatgggtttagacataggtaggagtggagttttgtctaagggttaggactgggtattttgaattggaattagaattaggatacaggttagggtcgaagttgagttttgagtgggacttgaattttgcattggggttttcagctaaggccactcccagttcccatggtctcgtttcagcctcagagggcggtagattggcctggttaagattcccagctttggatgaaacaagctgcctgagtttaaatcctgactttaccacttggtagctatgtgttgccttgggcaaattatgtaatctctttgagcctcagtttccttatctgtataataaggatgataataacagtacctaaaatatagcggtgttatgaggattaaatgagttcagaatcaaaagaatgcctggcacatagagttattcccattttgcagatgagaaaattgagaagaaaaagttaagtgacttgctgaagtggctgaatggggagtcacactcagtctaactctagagccctcatggcttactaccaccatcaagtatgtcttctctctctttctctcttttgtttttgt

SEQ ID NO: 7014 - DNA, 1399 bp, artificial
  synthetic oligonucleotide
gcttcatgaagtggatactactatctatcatctccattttgtagatgtggagaacttttccagacagtgtgatgataagagcctggattctggagccaggctgcctgggttctaattctggctctgccactcgctagctgggtcccgagattagtcgcttaacccctcagtgccttgatgctcagtgttctgtgccttagtatttaattcgcataaggttgtggtgaagaaattgtcagtacacataaagaaaggtgctgagaaaggagcttgaggcacacagcaagtgctacctgtgtaagctacaaggtgggatgggacaggctaagggctctggatttatttgggtaggggggaaggcagtgtcttgggggctgaggcgccctagaggttttggatttaagcttctggggtagaaggaataggaggctgggggagacgactagcaggctgggggtgtaccctggatctgggtgagccacacaggctgcccgtggtgctcagaggcgatggtcaacgtgttgaggaagacgagcaacagcacagcccagtagcaggcattggacttcactgcccgacggcagcgtgcccgaaggacccggttggctcggcggaggcggcggctgggggaaggggagcccacaggctgagatcacctacctaagcctgccctggggggctcaggtgggggatccaaaggtcatgagggcttggaggtggggggtttcaaagttatggagtcaaggatttgcacaactttcccaactcaccagactctggttttcatgatcttgtttctgaaaaagaagggggatgggaggtgtgtgtcgtaaagggcagaaggggtgtcagtgactggggccagaggtcaaggactgagatcgaggcttgaggctaaagaaaggacttgagtcagggtttggactggcttctgggctgggtcaggggctgggggccctcacaggcagcgtgtacagctggccagagccccctcctcctcatcctcatcgccttgggtctctgtcatggaaccggtgtcactggctgggaggctggctgtaggcaaggtggggatagtggtcaggacctgaagaccccgaggtccaatctttggctttcacctctgcctacccacccccaccccagcctggctggacccccaccatggctgctggtggagtgtgtggagcgagtagaatgactgaaccagcgcagacgtccacgcctcctattggtcagctcggccagctgtggccctgcagggagagaaaggacaattagggaggacatactgggggcagggttagggccatgtctagggtaggggtgtcatttggagtctttatagctgaggctggtcttgattctgcattttgagccataacttgggggctggggc

SEQ ID NO: 7015 - DNA, 1200 bp, artificial
  synthetic oligonucleotide
ctttccgatgaaaggatcaaataaggagaggccccaggtgcagctctccctgccttgagtgtggttttgatgcctggagctgtgatcatgaaacaacaatcatgaaaatgaatgccaacttgctaagaatggtgaagcagaaagatagagcatgggtcccggatgaacaatgaacaaacagcctacctctgcacttctcaatacatgaggtaattaccacagttcattgactccaggaggcacatctttttacattttagaatctctgaaattggggcgcattttataacaaatggcaacttacaatggccactggctacttttttttttttttccacattcttacatctccgaaatcagaatgcaacttacaagtactggccatagacttaaagaaatgtggcaaatgtctttatagcttaagttgctgttagttggcagggggtttgttatttgcagccttaaatgttcccaatggttcccaagggattatgtggagataatagggtcaggagtctggcgggggtcaggcagggatctcagacctgcatggctagggcaactgtgttgagcaggatgagcaggaacatcaggtactcaaaggcagcagagttcacagtggcccacacacgatactgatgcgggttcttggggatgtaacggcggagtggctgggccttgagggcatattccacacattgacgctgcataccagggcagggcatgagtgagcagtggggtcctgaggcaaggagggaagggttggtgaccatccatagggggtcaggggtcagaggtcacctggttcttgtccagctcacagttttggtactcctgctcgccctgggcacggaaagtgatgatgacgaagcccacgaagatgttcatcatgaagaacgcaatgatgatgatgtagacaatgaagaacactgagatctccacacggtaattatagatggggccatggtcctctgcatatgcatcgatggccttgtatagcagtctgtgggagccagagggggggtagaggtgggggcaggtgaggggatatcccagccccctcagacctgcccccagtctacttatcacagacaccccagagtttcctgcctggcaccccaaagacccctaaatctcctgacctaaccacctgggacctccatacatactctaagagacctctaccaggccctcaaagag

SEQ ID NO: 7016 - DNA, 414 bp, artificial
  synthetic oligonucleotide
attggagaaggaggtgggtgcaccctgcgggccgtagccttgctgcccatagtcgccctgaggcccgtagccactgccaccgctgccggctggttgaccatagtcaggctggtagccgccctgaggcccgtaggaatcctggggcccgtacccgccggggccctgcccgtagcctgcatcgccgtaggcgtccccgggtgccggttgtttctcgggggcgccgggaggcgcgcgcaggaacggggcggcccagcctgtctccttaaacacgaaccacaggttgccgacccagagcaccaggttcaggaagccgaacacctgcagggagacaaggctcggctgtggtaccccgcccattgccttggcggccctgcgtgcaggaatgagcatgcggggaatgaatccgtaggctcc

SEQ ID NO: 7017 - DNA, 1385 bp, artificial
  synthetic oligonucleotide
ttagccgacacatgatgcgttccaggtccacaggcaccgcgtgcactgcatgctcctcccgcgggcatttgcaatgctggcagatctttctgagggggccgggatgggggtcaattactaaggagttgcccacccgaacccctcggcagcccaggtccaatggaggagcggggacatacagattatcaccaccaaaggtctgtgagcagggacagggatctgggcctgggggcggggctgcaggaggtgggcctatgagccagggtgtggctgggctgtgagccagaggacaggtcgtggggagtgggatgctttgtgggggaactttcactagacacaggcatctaacctgtggtgaggctctgaacttgtgggctctgagcctgtgggtagggcctgagtctgggggctgtaggctctgtttattgggtgcagggctccagcaggaggataggacgctgggcctgggagagtaggtctgagtctaagaggggtgctggaggccagagggcggcgctcaaagttagagacgaagaatctccctagggatgcgactccgcggctacgggagaacacttctgggggcggggctgcgtagtgggtggagctctcctgggaaaggactttggggaatgagtcagggggcggggctctgaatctgagcctgaggctcttttcccaactgagatccctctgtaggcggagctcaagcgtaggggcgtggcgtaaggctcctggatttccccccgaaggcggagctctgacaaaggcgaggccctttaggggcgccacttacctccagccgtggagcaggaagccagggcactgctccctacaggagttgcagggctggccccggtctgggtcctctgcctctggaggctgcagtgggcgggggcagatgcagggccgggtgaggcgcggaagcagggaaggagaagtcaacgcccgcccctccacttcattgcccgcgaccgcacgctggggcctgtcttacctgggcagcgctgggcaggctgggacagcgcccagagtgcgggggagcgggacacaaccgaggcagaggcggggcagttggagccacctccttatatgtccccttttcagggaattccccttcctaggctggcctcggacccccctccccgtccgcccctagcctcagacacctcccaccagccttagatccttccagggctcaagcacctcccctataattcattgtactctccccactagagcacagaacccctactctgggcatcctctccccggcctcatcccggttccctctccatctacgccgccagcagcactccagttccacagggtaggagacgagaccgcattcttccttgagatccccacgtgaaccctgcccctct

SEQ ID NO: 7018 - DNA, 1972 bp, artificial
  synthetic oligonucleotide
ccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgagaggcccggtgcggtggctcatgcctgtaatcccagtcctttgggaggctgcgggaggattgcttgagcccaggagttctagaccagcctgggcaacatggcaaaaccccatctctaccaaaaaattaaaaaattagctgggaacgctgacacgagcctggagtcccagctacttgggaggctgaggtgggaggatagcttgagcccaaaacttttgaggctgcagtgagccctgatcacaccactgcactccagcctgggcaatagggtagaccaagtctctaaaacagaaacaaaaatagaaacaaactgataaaggagggaggaagaggatttatgacttaggttgtaggggcggggcgtgggggtgaggggcatgggcctcatcatctactctgactggagaatggagccccctccaggacggcctgccttcaagccacgatgcagttcttgtctcgggcctgacgaggcatccctgcgcgagagtccctggggagcgataaagatggggagttgaaggtctccattgcagtgtcctgagcaggcatgggcctgcacaaatgcgggggcagagggatgcgctctcctaggaagaagccatcatcctctgatgattcggaactggaactggagggcgagctggagcaagattccgagtctgaccctgatcccgcgtcacattgatagtggcgacgtctgcttgggtggcggttgtgatggtgatggtgattatgatgatggtggcggcgacggctgggggccctgggtgggggactgcgtggcctgcggcgctgggccgggggtgcactcagggtccggcgcgggcctccttcagacaccagagggtcgcggaagctgacgcgtggggtgctctgacgaccgaaggcactatcatctgggcgcaggttaggctggccgggggactctgggggcggctcggggacactgcggagccccagttccggcatggagtggcggtggggagcccctctcagaaagcgggagggctcctcagggcctgtagctgttaagggggagacagagtgactccttgtatctgccctcccactggccccctcctaagaggaggcctgcggaagggccttctttcctccactaagactgggaaagtgggggcaggggtcggagaatggcagggaggtgggaagtctgggaagtgtgaggcctggagcaggctctgggtgttgagagggttggaaggaagaacacggagcaagatgggactggtgtggggggcgtggccagggcacccggggtggcttcggatggaagaggtgtggcataggctggagtagatttggtttgcaataaaaggggtggggcctgactgcagaggatgaagggtgaccggctggagaagaggaagaggaacttggggtcaagcagagacaagttgaggtaggggaccagccctgtattgacagggtggaaccagggttcatgaggcgggtgtagtttgggatgga

SEQ ID NO: 7019 - DNA, 7213 bp, artificial
  synthetic oligonucleotide
gggagtcaacggaggtgggatgagagaggagagagcaggggctcctagatgagcggggtttgatttcctttggagattgtgggaaatgatttctgaggggcatgttctggatccaggaggggaggggtctcgggaaaggaggtgtcggggttgtgaggggtggtgcccatcccagaacgcctgtcaagggagatttctctcaaggtcagggtctcatctcccgcagcctttgggttctcctgtccatcctcagccaaaggcctggatttcccttccctacttcaccacccaatctaatccgtagtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcgcccctgtggggaggggacggggaaggaagaaagaatttaaaggaccggaatgcgagagtccaggtggccttggagaggaaagaggaacggtgaagacaagctgcgagagctgggagctggagggtgaagaggtgaacacttgagtggttagagctgtagatagacattgtggggaagtgtgccagggtggcttccagctacccctgacttagagcctggtggaggtgtggttcttcagaagtcagcaaagggctcaagagccccagtctataaatacagtcacacccaggagactaataatagtaaccccagccaccatgtacttagttttatccctgctactggctttattgcaatatttattttcatctacaatagttgcacatctactcaactatccgaatatgtccatttcgcagaggaggaaagtgaggcccagggagtgcagatagctacagagaggagggtcaaagcacgatttaatcaaggcctgattcccaagtctgtcctctcaatttcacctgcattgacaagtattaattgaaccccaactgtatatgttgcactgtgctaggtactgtggagatgctggaggaacaagacataaaatttctttgtgtagctgatgtatgtaatgagagtagacagatgtcagacaaaaaagacgagaaaatgaataaataaaaaaccaggccaggcgtggtggctcacgcctgtaatcccagcactttgggaggccgaggctggtggatcacgaggtcaagagttcaagagcagcctggccaagatggtgaaaccccgtctctactgaaaatacaaaaattagccaggtgtggtagcaggtgcctgtaatcacagctactcgggaggctgaggcagagaattgcttgaacccaggaggtggaggttgcagcgagccaagatcgcaccactgcactccagcctgggtgacagagcgagaatcagtctcaaaaaaaaaaaaaaaaaaaaaaaacttcaggccagacatggtggtttgtgcctgtaatcccagtactttgggaggcggaggcgggtggattgtttgagcctacaagtttgataccagcctgggcaacatagaccttgtctctacaaaaagtttaaaaattagctgggagtggtggctcatgcctgtagtcccaactacttgggacactgaggtgggaggatcacttgagcctgggaggtcaaggctgcagtgagccatgattgcaccattccactctagctggagtgacagtgagaccttatctcaaaaaaaaaaaaaaaaaaaaaaaaaggccaggctcgtggcttacatctgtaatcccaacactttgggaggccaaggcaggcggatcacctgaggtcaggagttcgagaccagtctgaccaatatggagaaaccccatctctactaaaaatacaaaattagcctggtgtggtggcacatgcctgtaatctcagctactcaggaggctgagacagaagaatcgcttgaacccgggaggtggaggttgcggtgagccaagattgtgccattgtactccagcctgggcaacaagagcaaaactccttctcaaaaaaaaaaaaaaaaaaaaaaaaaaaaaaaaaaaaagacaatttcagagagaagtgagagtcatgaagctatgaagctagcaaaaggaggttacattgtgggagatgatggtgagcttctggcctctttgaagacataactcttgagctgcaacctgaatgaccagaagccaggtatatgaagcactgagtgaagggcattgacagcagggggaatagcaagtgcaaaggtgttgaagtggaaccaggttcatcttgtttcagaaattcagacgtgtcctcacagagttggaaagcacatactcatcactaggaaaagtatgtttcatcccttccactattcactcactcttccggcaaccggggctgaaagaggggagctctttccttagttttgaggggccctgtgttggcagagagagcaggcaggcccttgggttgaatcctcctggccatccagttatgattctcccccacttcaaatgagatgagaataaaaacaacttctagtctggagagtgtgtccctcagggtacctctgggatcctgattccaggagacgagatgcatgtcttagatgcagaaattaaggctgagctgggggaaattacttgctcaaaataacacacttagccaggcgcagtggctcacgcctgtaatctcagcactttgggaggccaaggcgggagaattgcttgaggtcaggagttcaagaccagcctgagcaacataacgagaccttgtctctactaaaaaataaataaatacaaacaaagtgtctacaaatgtcacccagccttgcaccccaggagccatccattcatcttgccaatcccccagaaataaactttcctattcctcatgtacgattgtgccgactggcccctctcttcagaaccaggaaactgaggcccaacatttagggccaggacttccttgggattgcagaacacagaatcagaccttgggctctctgggctctaacactactacaaaatatgtttttttaaaatagagacaagctctcactacgttgcccaggctggtctcgaactcttgagctgaagtgattctcctacctcggcctcccaaagtgctaggattacaggcatgagccactgctcctggccttgggctctaacacttgaaacaatgcttgccctatttctgagcaactcaatgctcaccaacccctattctcacacagcctttacactggcagggtcttattctcatcactgctcagaggtttattccactgtccacaatccattatccaaaaacaaaaagctctggaaactgatggttttcccacaagataggcactatttggttacaaaacctgacctgatctaacgaggaacaattttctttcttcctttctttttgtttttccttttttggagacagggtcttgctctgttgcccaggcaggagtgcagtggtctgatcatggttcactgcagccttgaactcccaggctcaagcaatcctcccacctcagcctcccgagtagttgggattacaggcacgtgccaccatgcctgggctaatttttttcttttttcttttttttttttttttttgagacggagtcttgctctgtcgcccaggctggagtgcagtggcgcaatcttggctcactacaacctccacctcccaggttcaagcgattctcctgcctcagcctcctgactagctgggattataggcgagcgccaccacacccggttcattttttgtgtatttttagtagagacggggtttcaccatgttggacaggctggtctcgaactcctgacctcgtgatctgcccacctcggcctcccaaactgctgggattataggcttgagccaccgcgtccggccgcctgggctaatttttaaaattatttgtagagatgaggtctcactgtgttgccgaggttgatctccaactcttgggctcaagcgatcctcccacctgaggctcccagagtgttgggattactggcatgagccactgcgcccagccgaggaacacttttcaatccttacccagttattgtgaacgttcataccttttcttgaagaaataccgtttttgttgttgttgttgtttttgagacgtagtttcgctcttgttgcccagactggagtgcaatggcatgatcttggctcaccgcaacctctgcctcccgggttcaagcgattctcctgcctcagccttccgagtagctgggattacaggcatgcgtcaccgtgcccagctaatttttgtatttttagtagagacggtgtttctccatgttggtcaggctggtctcgaactcccgacctcaggtgatccacccgcctcggcctcccagtgttgggattacaggcgtgagccaccgcgcctggcccttttttttttttgtaacgcggcagctccaaaccccgctgagagtatatgcatgggaaaactttctgaaatcaaaaatattccgaattctggcaacatactgggccccaagtctttcggatttaactctgcctcggccgttttattcagttaaggaaactgagtcactccatcccaaagccagattcccgcggttctaagctgaagctgtctcgggtgcatttgcattccaaaaaggcgaagggtcccgctattactgctcctggtacctggagctgccaagcacccctgcgatggggcgccccgggggctgtgcgccaggctgggagtatccttggggggcggggcgagggggcttccggggcggcagcacctggcccggctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaat

SEQ ID NO: 7020 - DNA, 1283 bp, artificial
  synthetic oligonucleotide
cctaactgtcaggacaggcctccaaccctaaggaagatgaacagacccagcccttcaccaagagaggccctgacacgccccctccccggggtgaataggtctgaataggctgcaggaagtgcaggccagcctctactgggtttggccccgccaggtccctgttcctggccatttccaacatttgggtgggcccaacaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaaggtgagcatcccctggtgagggtgggagagtggacactggcaaatggacgtggtagggctgggatgggtgactggccggtgaaaaccgggaggtaggcacaactcaagtggcccaacccgtgagaagagttgcgacaaactggcttaccggaaaggacaaactgtgggggactgatgaatatctgccaggacagtcaggaaccaaactggggtggtcttgggctctggtaaaagcagattcttgggacaggaacaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatcccctttattcatccgaccacatcctgcatgatcagcccatcctttgatgcccagcccctcctgtgctgcttcagcttctccttagccatgctccatcttcctatgggtcccccatcttcttagcctcaccccaccccagccccacagccccagaacctacttgtcagccttagttcctcctcagcctgcttaacctgtcccagcactttgcccctccccatggccttgccccccagcctgtcctgccccctctgggcccccctcattgaattctatcccacttgctctcttccactcaga

SEQ ID NO: 7021 - DNA, 1945 bp, artificial
  synthetic oligonucleotide
gagcgagtagcagcatgaacaagagcctcctctgggttcccaaacaaggtctgaggcctctgagctaagaggtaacatcatcgccctctgcctggctgtctatcttccattcaggcccttaacaggtgtgggaagagggcttttccactatccttgggatctgccccagctgggtaggcgggcagaggggaaaggattattctggtcaagtcttgctgaatgttgcttctcttgttcattcacacgcactcacaaggctggtcccaggcagcatatctgagatacctccaaatccctccagattcatgttatccccaaacacagcaaccagtcactgagaggcaccaagctcccaagacagcacttctgtccctcaggaccccttctcccacactgagggaaaaaagattctaggattcccttaaaaccagtgcctcacctgacagtgtcccctcaaattcattcccctcatgtccgactgaaaatccccgaattcagcctctaatcagagaccctgtctaccaagttcagctatctcagaccagtttctggatactccagaataggccccgctagacgcagtcaagggctccccaaacctgacccagaccccgcttaatgcactcccacgactcctttaataaagccacaatccaagcaggccactgccggattccttaggtgcccccccaagacgggcgccccgacgtcctccaaggctaggccgagggcctccaatcccagtccggggcccccgctgcccccgagatcaggcccctgggagccccagtcggcactcccagccccaggcggccccgcacctgagcagctgagccgagtcggccggcctgcgctcctccaacagcacgaacacggctcgagggccctccgcgctggcctctacgccatcccgagctggttcggccgcatgagacatgacgcccggccccgggcgagccctgccaggccggtcgggcctcggcccggtccccctaacaaaataagagtcccccctccccccagctcgccactgccgcctcctccgctaagccatggagctagcactgcgcgggcgggcggcgtctgggagatgggatgggctgtgagtcatcccccgcccagaacggaccgacgccccccctcaacctaaccccggacgaccgccctcctccccctcgtcttcttccccctcctccctcctcccagggatggggaaactccacaggaagtgaccgcactggggatggatggcccgtctggccacgacccattagcgaggcggccaatcgctgaacggcgattcgagggcccaccctaagcgacgcctccgacgcggaggaaaaacgcgattcggcccgccctcattccgagaagcagcacccagaccacgccctcaggggcagcgacaaataggcgagggttgatttggttgaaccacgcctctatgtttgcgtcgctttcggagccacgccctctcttctcaaattatccctctgcaaggtaatattaagccgctccttgggtcctctgcgcctgcgcatcgatggccagtcggcgcacggagggtctcctggccaagcttttagctgcggaaccgcgccctctttcggccaatatttgtaatatctgagccctagaccgcgctccaacctcgatctggctgtgctctctcagccaaagccataactatgaggcacaggcagctacattccctgaaggtgcgggccagaaacccccccctttcgctgtccgcagtccagccgcccagctggtcttccgggagtattccgcctgttccatgccatcgagagcggttgtactatgttcattgcgctgcgcaatatgtgcttaataaattcttgacgggtgaatgaatctggtcccttcggtgaatgacgacttctggaatcacaaagatccaggtttgaatagggaaggggacctc

SEQ ID NO: 7022 - DNA, 2117 bp, artificial
  synthetic oligonucleotide
ctccaggtctgagtaaggtaccgcctacttaatggcgctctcccagcccacaatgctaacagagtccaaccttcaaagccgcagagtatctcggaatccaatagtctcaccactccgagcctcagtttcccttctccagacccaccccataaactcagggtccatcccaaccaaccccttctcagagctgatagcacgacctctcgctaccccgcccccggtcgcctagccgggtggtctttcccaccgcgagcggcacctgcatccgctgaaactcctcctcagacagagcttgcgccatgttcctccccccacccccccgccagctttctgcgcagacgcagctcgcgcctcctggcagtattaaggtcggaccaaaccactggccaggaatggagggggtagaacctaattccgaagggcagcattttggagacgcagagaagagaacgaaaccgacgagtcaggtgaactgtaatacaacgttctacccgaatgtaagtcatctgattggcttttggactcttctaggccacccattgtgatacgacattattacatccccgtttcatgggtggactcgtcgctagggaagtctttgccgacagaaaatcacccttccgcggtattcctttaatgagaatgggtaacttaataaccatagaaatgaaagcggaagcttcgctctggtcttgttcccgcccctcctccgggagaccccaaaggggaatcccacctcttgtaaagcctttggccttttttttttttttttttttaaggtttgacacttattttgttatcatgatactgcatgtcacgttaggtaaaggacttagccaccaataaaaatagcagagtggaaagagtgacagtgaatcaaacgaaaaagctacattaaaacaaaacaaaaacaaaaaacaaaccagggtggtgaaacaccaggctcattcaagtattagaattcactataaccctcaccgatctgagagtaagaaatggtatctcagtgtagtttttttcttattttcttttttctttctgtttttgttgttgttgttgttgttgtttttcttttttgagacggagtttcacttttgttgcccaggctggagtgcagtggcacgatatccgatcacagcaacctccgcttggcgagttcaagcgattctcctgcctcagcctcccgagtagctgggattacaggcacccgccacctcgtccgggtaatttttttttttttttttagtagagacggggtttctccatattggtcaggccggtctcgaactcccgacctcaggtagtccgcccgcctcggcctcccagagtgctgggattaaggcgtgagccaccgcgcccagccttcttattttcgtagaatttaatgatttccctgctgtggaaaaatatttccagcagggccgggcgcggtggctcacgcctgtaatcccagcactttgggaggccaaggagggctgttcacttgcggtcaggagttcgagactaacctggccaacatggtgaaaccccatctctactaaaaacacaaaaattggccgggtgtggtggtgggcgcctgtaatcccagctactcggaaggctgaggcacgagaatcgcttgaacccgccaggcagaggttgcggtgagccgagatcgcaccactacactccagcctgggggatagagcgagactctgtctccaagaaaagaaagaaaaagaaaagtattgccagccaggactctttgatttctttcttgatttaattgactttattgaaagataacgctattgatctgtctatatacataaatgcacccattttaagggtacaatttagtgagctttgtctaatgtatacaaccttgtaaccaccatcacaagcaagatagggaacattgatttctttgtatcctatcccaaaccccaccccctatcccaggtaaccaatgattggcttcctgttactggattacatttctcttgcagagtttcatgcaaatagaatgagacaggatgtatccttttctgtctggcttctttcactcatcataatccttttgagattcatccaagttgtttcgtgtataagtatctttttttctttttattgactag

SEQ ID NO: 7023 - DNA, 1905 bp, artificial
  synthetic oligonucleotide
cagagacagaaacagagaagagacagggcaaaaacgagagaaagatagaaataaagagagaatgcagagaaagaatcagaggagagacagagaaaaggtaaaagatggagttccagagcgacagaagcaggaaagcacagctgaggaagaggcaggactaacctgcagcctgcaggcccaggccctacctcccccatgcctcagcctcctctccctgtcctagtccctcacctgagcggctcttgctgttagtgaggatgtcctgcagtcgctcctgcagcttatctgcccgtttccgctccaaatgcagctgccgcttgaggtccttgagctgtgggggacaggggtaacatgaggactgaggcccagtgggcccataggagggaggctacaggtaggagggagccgtgcttgggcaccgctctgtcttaccgcagcactgcccttcttctccaggatcctctgcccatccactgtgtccttcacctcctgtgggagaaagcaggcatggctggtagatgccggaagggctgcctgaagcatgctccctccctgcccctcctgtacgctgaggatcaggggtgtgtctggggctgtgcagtgaccactgacctgcttcaggctgctaatggtcttcaggtggcagtcccgctcctcctgggcctgctcgagctgatcccgtacatcctgtagctcctcctccttgccctgcaaagcagaaagcagcttaggcattggcttgggaagcctctgtcctcccaggagggcccgtcactgtctggagagaggaacaccatcatgcgagaggcaccttcagctcggcagcgtgctgctcccgacactgcttgagggcttcctcttgttcctgctgctgctgctgcagggattcctacaagacaagtcccaggtctggccacagccccccagaaggtatcatgcccagttaggggtatgagggactgcaatgggggcccagaggtatgcagaaatgaccctcctgcagggaaccccacacgcccttaggcaatatgctgaagtgtcacatctaaagttgcaccattcgcatggttgacttagatttgcatttacattttattttatttaacaaaacatagcgcttactacatgccaagaatgttctaagagttttacatatattaactcattttctataatcctcccgtaatacctagatggtagatattattgttaccccctttttaccattgatgaaaacaggccacagagaggtcagataacttgcccaaggtcacacagctaggaaatggcccagccaggattcaaacctagacaaacaactggctccagcctgtgctcttcactgctacatgacaatgcctttcagtgtattatgagatttccagaaaatggcaacaaaggttctttttccgagacagagtctcactccgtcacccaggctggagtacagtacacgatatcagctcactgcgacctctgcctcctgggttcaagtgattcttctgcctcagcctcctgagtagctggaattacaggcgccagccaccatgcccggctaatttttgtatttttagtagagacagggtttcaccatgttggccaggctggtcttgaactcctgacctcaagtgatccgcccacctcggccttccaaagtgctgagattacaggcgtgagccaccgcacccagcaggttcttgttcaataacatcagtgtattgcattaatttcctgacagaagtacagtttcaggagaaagaggtgcctttccaaatttgcacaaaggcagggcagccttaacacgtgacagtctgtcctatctgatggccatcccctgatccactccagagggctgctattgagccaggggactgtggggatatccctaagtccagaaaatctcgg

SEQ ID NO: 7024 - DNA, 1086 bp, artificial
  synthetic oligonucleotide
cctactatgagccacataatttatggcaccagagaagggggaattagcccacagatgattaaacagaaagtcagagagagagaatgactggcctgtcctgcatgtcgcaatctgaatccaagttggtgggcttggggaaaagttgacaagaaaatatgtgtgctgcgcccaaagtaggagatgggtttaggtgaggagaaaaggggaggggttctcagatttttgggttgagagaagctggagctgtaggttcttcctttccccttaccctggctggaacagccgagctctccttttcccgcaagatctcccggtagctgaaggaggagatgctactgctgtcccctgtctgggtccggcttggtgagttcatctctgagagaaccagctcctcaaggcctgggtggtggagggaagagaaacttgagccccagtacccctgagtcccagggcagcaaccagcaggaagaggcagaaatagatttaacagagatggaaagagagacacctgggcatggggaaaggcagaagcagacaggaggacagggagagacagagacagaaaaaagagctgaggctgggcgcactggctcacacctgtaatcccagcactttgggaggctgaggtgggctgatcacttgacgtcaggagttcgagaacagcctggccaacatgaagaaaccccgtctctactaaaaatacaaaaattagccaggtgtggttgtgtgtgcctgtaattccagcgattcaggaggctgaggcaggagaatcgcttgaacccaagcaggcggaggttacagtgagccgaaatcgcaccattgcactccagcctgggtgacagagtgagactcttgtctcaaaaaaaaaaaaacaaaaaacagaaagaaaagaaagagctgcctttctggagaaacacatacaaaatgagagggagaaaatggaagaggttggagaaagagaacgacatgggtacacatgggtctcaagtggcagacacacttggacacagggttcagagaaaggaagacagctagagagggcacagggcacatccacttgcagaaagaaaatgccagagatggaaa

SEQ ID NO: 7025 - DNA, 1644 bp, artificial
  synthetic oligonucleotide
ccctgtgagtgcctggagaacttgaagatgcgaaacacccggaacacacgcagggtgacaaaggcgccagagacatcgtcgttcttgggcaccaaaagcccaatgtagtagggcaggatggccaccacgtcgatgaggctcatgacactccgcaggaagcggcaacggctgggggcggcaaacagccgcaggaggtattcacctgtgaatatgagtacacaggctgtgtccatgcagaaaaaggcctgtgggaagcgttcgccacagggctgctcccttgaggacctgcgtgcagagccgcggcatgggatggtctccaccacattggcgatgaccgacacggcgatgaagaagccggtcacatagtagaaaacgagggctgcggtgctcgtgtgtggattctcgaaggcccgccagagccgctgccgcagggagctgcctgctggcagggctgggccgtccccggcctgctctgcctcctcatcctctgccaggcgctcggcattctccttctttcggtcccgatactcttcaaggcagcagtcaccgactagctcgggaaccaggccgtagaaagccagctcttcgtcgaaggcctggatgcactcctgccgtgggcaatgcagccgccccgttcggtagaagttcagcacatggcggaacatgtcagggtcgcgatcgaagaagtactcgcctgagtcagcatcgtagaagaattccttctccgagctgcccagcaaggtgtctgggtagcggtccagcgtattcttccaagtctcaaagcgccgtccgctcacgttcaccaccagaacctcatctcctcgagatgccttcacccccggtgccgggggcaggggttgctgggccaggggcagccagcccactgctgctgcccgagcaaaaggcagccacgtggccaggcctgccgccatcgtgccactccccaagcccagggagacttagtgagggtggcgtttaggagaatgtggctgtctccaggatggtgggggcttggagacaccttgagccacccaaacaaggaaactgggggtgtctagagaggccaagaggaaccaggaggaagaactaaagagatgggaaggagtctgggggacatttacagaacctaggaggggcctgggcaatgttctgagggactgagaagggccttggggacatggagaagagcagaaaaggggtgtggggatggggccaagaaggagctgagggagggtttagagagactgagatgattctaaaggagtcagcctgtgcctgagaggtgtctgggggcgtctagaggggccaagaaacacgtggggaattctctgcactctcaagagtctcagggaaggcagaagagcctggaattcctttgcagtggtggagaggagactggggcatccagaggggtagaaatgggaccagaggtgcttgaaagagactgagagtgcctggaagtgggggttctagaggggctgagacaggtgaggagggttgtccacaccctcaagacttctaggggaagcataagagggttagacccccctcatggatctggaaagggagctggtgcatcttgaggggtggctgtggatccaggaggttgtaaagaggctgaaaggtgtcttgggactgcctaga

SEQ ID NO: 7026 - DNA, 1709 bp, artificial
  synthetic oligonucleotide
cattccaagcttcagaatctgggaattgttgggccagatggagatgaggacctctcgtagaggccagatcagaggtgagggttctcttctctgaacctccaaagctccatatcccagccagagggaggaggaaatctcaactctccttcttaggctagagctcagatgtcggatcaaagctttgccttcatctgagagcccaaggggaggagcatgcaggagtccagctgggagagtggggccagtcccagtgtgctagggcaaggaggccaggggcctgtggaagcccagtgcttcagctcccaccaggaaaaatgtctggggtgggaggaagtttctcatttcctggctacttccccactatgtggaccatttcatgaaactccattgcatagttctcagtggggggggcagaaggggtgcccaagcctgcccctctctgcctcccaaaaatatggctttggaaaggagttcccaaaaatgaagaggaccctctgaatcagcaggcctacccctcacagggatgagatcttgacagtctcggggaagaggcaaggggtacccaggctggagttcctgagggtgctgccggccctgccaccgccgccaggggaggaaggttggctctcatctggggtgttggcaggaggggtagggatgctgataatggcagccacgaagtcccggctgtcgcagttcaggtcaaggctgtcatggggcttggcattgaggctggagcggctgtggacaagggtggagaagatggaaggctcttaaaaagttatcttaggccgggtgcggtggctcatgcctgtaatcccagcactttgggaggccgaggtgagtggatcatctgaggtcaggagttcgagaccagcctgaccaacatgatgaaaccccgtctctactaaatacaaaaaattagctgggcatggtggcgcatgcctgtaatcccagctactcgggaggttgaggcgggagaattgcttgaacccggcaggcagaggttgcagtgagctgagattgcaccactgcactccagcctgggtgacggaatgagactctgtctcaacaaaaaaaaaaaaagaaaaaaagttatcagccgggtgctgtggctcatgcctgtaatcccagcactttgggaggccgaggcgggcggatcacgagatcaggagattgagaccatcctggctaacgcggtaaagccccatctctactaaaaatacaaaaaattagccaggcgtggtggcaggcacctgtagtcccagctactcaggaagctgaggcaggagaatggcgtgaacccaggaggcggagcttgcagtgagctgagattgcaccactgcactccagcctgggtgacagagtgagactctgtctcaaaaaaaaaaaaaaaattaatacttgccacagcaatcatggcatttattgagcacctactgggtccctggcactgtgctaagtacttaagtacttctcctgcatccccaattatggtggtaaagagtgaggactctagagtcagatagtcctgggttcaaatcctggtcccactttaaccactccaaacctctctcttctctcatctgtagcatgggacgaacactatctcccacctcatagggttgctgtggagattaaatgagattaaaaatgatacgaagtgctcagagcagtgtctggaacacaatgtgcatacatatgaaaat

SEQ ID NO: 7027 - DNA, 2316 bp, artificial
  synthetic oligonucleotide
gtgaaaacgcctagatcccttggggcgatctcaaacagccttccttgagtcccttcacagtctgggggtcccatctgccgtggccgctcacccctcaccccacagctcttacctgctcgacagtggcagggtccatagcctcgatgcgtgctgcagccgcctcatactcgtcctcactgttgtagcctgcgccgacctcctcacgctcgggactgcccccgccaaccgcgccaaccccgggagcttgacgtcgccgcttgctgtgcccaggcccggagcagcagccgcccacgcctacggcaccacccacacccaccaccacgcccgcggcacccacacccgccgccgctgcgcccagcgcgtcgccgggaccgccgccgggaccacctgggcccccgcaaggaggtggagaagcctgttgtggccggggacccgccactgcaccaggcggcacggccagcgcccagcgatgaagagcgcccggcggtcctggtagcgggccttgaggcggtggcgaagctcgcggacgggcccccacgacgccggagtcacggtcgcgatcgccgccgcccacgcccgtgccgccgccgcccacgcccacacctccgccgcgccgcggcgccgggggcatcggcccgggcggcggcggctcgttggcggggtcggcgtcgggaggcggcggcttctttttggggagtatagtcatggctgcactgccgagtaccccccaacaaacccggcgcggggcacgccgggagagaacccggatgagggggctagtgtagtgcgcgaggcacgacgggaacggcgagacccggataaagggatcgcggcaccggttcgagaaccctcggcggcggaggcggcggcggcggcggcggcggcggtggcggcgcgcgggtcacgccgagaggagaacccggatgtaaagtccaagatgaaggcagtgcggcgagtttgtcttagccttctctccaagtccagcaagtttattgctacgcttgttccggccttctgcttcaaaggaaacagaaccaaaacaagcacctcttcgctccgccccctcgcaggttcttgcactaccgggtggggccccggggcgctgcgcacgcgcgccagggcacagccccgccccttactcggaagtacgtgggcaaaatcgccgccgccgccgccacaacaattgcaacaccaaccaattgagcagctgcgtgggacctcgacgacgcccacgggccaatcacaggcgagtgctcgccctccggtgccctccgtctcaaatttcagtcaaagtcgacaccctggttcccagcctttctccccgtcagttccgtcttgctcttcacttttctccccgaagctctgacctgcaggcgtcggtactgcggacggacagcgtggcctgtcccacgtacgacaggaaaaacacctcccctccaggattccaacttgaacgctgtcagccggaatgactggaaaacatcaacactcccgggagcatagctggcccctgtagcgtcacttccggtcccacccacctacaaatacccttccgggggaggcggacaccgcttcgccccggcaacagcctgagttctgcggtgattggttaagagacgccgtcactcgcggcataccgaccaaccttgggacagacaggcgccgtggggacagtggttgtttgggaaacagacacgccttctctggcaccacagcactctcggcctcgcgttgacctccccgcccctatggctagtgcgcaggcgcggcccagccttttttttttttttttttttttttttcctaattgagacaggggtctcactctgtcgcccaggttggaatgcagtggcgcgatcatagctcactgcaaactccaactcccaggttcaagcgatcctcccgcctcagcctcccgaatagctgggaccacaggcgcgcaccactacgaccggctaatttttttttcacttttttgtagggacaaagtctcactatgttgcccaggctgatctccagctcccgggctcaagcgatcctcccgcctcggcttcccagagtgctgggattacaggcgttagtcaccgcgcctggccaagcccagcctttttctaaaactgagtttgcttgggtcgatcgaggtttatgaaagctctgtcaccagtcagcgtctcaaaatggggttggcagaatccctgctattgagtagctggagagctacacgctaatcctagctctgcccttcctgtctgagtgatctttgtcagtcatttaaaacccaccccgtcctcaatttttgttgttgttgtttacttt

SEQ ID NO: 7028 - DNA, 1398 bp, artificial
  synthetic oligonucleotide
tgtcctctcctggctctctacctttagcgaaaccaaaggtccacaagtctacctctaggccgttagttctaacaaaacttcagcagttaaattaatatcgaattaacaatacaggcttcataaaacagggtcctaaagtatggacgagttatgacacttctttacttatctgtaaaatgtaaaataccaccttctctcctcaatcctatgatggcactgataggtgatatggtataacatgtacctaatcacagcttttgaggggggaaacacaccacactgattataaggtataccctaagtttggaatcattaacgtggaagaaaatatacatctccaaaccaaggaaaacagcaatagtactatcccaacaagggagaatagaaggatttctccaataatataaggcaggaaaagcatctaagcacagagctaaacacataggaagtactcaacaagaattcatttttggccaggtgtggtggctcacgcctgtaatcccagcaatttgggaggccgacgcaggtggatcacctgaggtcaggagttcaagaccagccgagccaacatggtgaaaccctatctctactaaaaatacaaaaaattagccaggcggggtggtggatgcctgtaatcccagctatttgggaggctgaggcagaaaaatcgcttgaacccgggaggtggaggttgcaatgagccaagatcacaccactgcactacagcctaggcaacaagagcgaaactctgtctcaaaaaaaaaaaaaagaattcgtttttctgactttcctagctccacctctgtcctccagaaagccctcctcttcccagaaggctggcacacagggctgggggccaggcttgacttccctgtggaggggtctgaggttggggggatgacctgcagaggtaggggaattcagagaacttgttttgatagaaactgaaactcctcctcttgctgacgctgcacttgtgggcaatctgcacctgttctcccctcccagaggccagctggaagggggtcccccaccattctacctctgttcccatctcaaacagggctcagaaatcctcagtacaatactacaattggtcccacaccaaagacttttcacactccaactcattctatccttaccaaaacactcttactttacccaggagacacagaaatgtggcaaagcttgcctgggatcacagatttagggggagtgaaggggaggccaggctctcaaagggtaactgctggccccagctgatattaccaccttcaccccaatccagccaccatcttagtcaccttactccctggggcaggacctgatcttgtgtgcctcagtttccacaccagcacaagcaggaatcagctagaacccaggaaaggcatgggagag

SEQ ID NO: 7029 - DNA, 1582 bp, artificial
  synthetic oligonucleotide
cttttccagtggcaataggtccagaaggaggtttaataagcagcaaatcaaatacaaactccaggcccccagacagaccctgctggagagcattcacacctctgaggtcaagccaaggtccgtgccattgcatcctctgcccagaggcccgcccaacccctgccccacacagaacagagtcgctcagggaaactgacatttggttttattgtgccaaggacattacagatggcggatcttgtcaacacctgcagggcacgggtgccccatctgccaaggctgctcccacactccctacactcaaatcccgggtggcagccataatccccaaagatgacccccaccccaagattccaaagaagctagtggtggtggaagcaaaaggaatgcagcaaggtcagggtttcattgtccaagccggcctgacacctgccgccctgcccttgcccagtgcacaccctagaccctgggccggcctccatgcagctggaggccagaagacagcaacccatatctttgcaccctcctccatgccccatggcctgcctgcccagaaagatgccaccttcacagagccagtgctgtcgtctatatcatttttgattagttgattttataagataaaagtaattttaataaagaaaaaattcaacattgaaggctcagacgttcttgggggtactgggaagggaaatttcccacttcttcctcccacctccctggcatcagtgtcggggggtggcggcaagtttttctcatcttggaaggaatgaggggcagggagactttcctctgtctgaatgtctctctcctctggggctgcctggctgccagttggtctgtctctgtgtgcctcttgtctatcttcggcacccttgcccgagtcccctgtggaatgcagggatggttctgtgcgggatggggtggggggcaacagggcacatcagctggcagagagacaggtgatagtggcagcggcaatgagagagagtgcaggggtgggctagccagagggaagtgaggaggagggaaaagaggggagagcagaaagaacagaaggaggcaagagggaagaagccaaagaaggtgaggtggcaccggagagcaggagtactggggttgggagatggtgtccaatccctgggtctccatcaactcttgtctgggggcgggtctctgtgcactttgtttttcttcatactgtctaggtattcctgttgggacactgccagcaccgaagctaggatctcatcatcatcccagtcattcagacctgctgggcgagaggaagaggaaaaggatgatggagcgctctcagcctgccttctcctcaccctgtgccgacatctggggctctggagaaatcccatagggcccttctcactcctttctcaaaacagaaggatctgctaggcctgtgaaaccccacttagaccccagacccttctggggcaaattccttggatctgaaaaatcccctccagtgcctctcccttcttttcttggggagatggccagaggctccagaaagcccctctcaggacttgccacttcttccagtctctcccagctcctagcagcc

SEQ ID NO: 7030 - DNA, 1915 bp, artificial
  synthetic oligonucleotide
ggggaccagcccagcacacgattccggggaatcactttgatggccacctggagaagaaggccgtgataaggaggccagcaggtgatccccagacccctcccagtctagaccttctgcctacctccagtattcctccatctaccagcactctagtctttctggtccccaaccacagcaccccacagaacgcgtaccagggcgtctcccctgccctccaggtcctcggaaccaagtttatctctcccaccttccttagccctgggctctccgttctcaggcatcaggactcatcactccaagtcctgagttctagatttcctgataccccaggcccacaatcttcctatttagctctacgacaccccaactctgtaccagggtcctggtccgcatgactccacactggacacctacctccaaaagtcccacaaatctcacatctaggtccctgctttcccacacatacacagcctggaccccggggtcaaggaactccggaatctgaagccccctgccccccccccccgcccataacctcctagaccgacacacacacgcgcacgcacacacacctggccctctacacacactgcaggctcactcctcggacacggacacggacacacacacacacacacctggtcctctacacactctgcaggctcactcctcggtcaaccagcattccagggccaggacccccgcccccgccacacgcacctgaccctcccaagaccctcatgacggatacctggagtcgatctgtgaggcggtgtcctgcgaagacggtgccaaagccccccttacccaggagggggccgagtcgatactcggcctcgaacgcttcccgatccttgcctcctacgcaggcggaggcgaggaagtcagggtggcggcgtgctgagcccagccacgactccctccccccgcgctgcaacccatcattccagcccaccccgtctggttgcagtaggggaggatgtactcacctggcggcggcgtgggggtcccggggggcgcgggaggcccctgtagaggcttggtcaacatggaggtggcgctgcgcagattgagcccactgaacccgctaagcccgcagggcgtggacgcccggggcagcgcagctggggagccagggctggggggcgccagggtggaaagcagagaaactggtggcccggaagcgcccgcagacggcgcagcgttgagattcgccgcgcgcgccagccccaatgctactgagcctgggcacgcgcctcccgggagagtcaccctgggcgacagccccgcccacctggctttgatcaatccggacgcggcacctgctgtaccacagccaatcggagccagttcttatttgcataccaccctcatcgtttcaagggcccccttatgcaaatacacgctcggttcttccgaggaggcggggcctgcatgtaaatgagggggcttgaggtggggctcacaccaagaggaaaccggttctgggaatccctttgcagcaccgcgcttgttttggttgttgcgcggggttgttgttggtagtggtggcggtgtgtgtgtgtatttacacttaaaaaataactgcgcagtatcctttcctgggaagttggtttgccgccgctgcctggatattagcacagagatagcgccaggccgggcttctaagaattcgcgcttgtggctatccaagactccgtctcgaaaggtgcttgtcggactccttcaccggagtcctccaggcgactggcggccttcactggaaagctgaggccagggccctggaaatatctggtagccagggagggggaacccctaccatcaacgccacgggtgtgcattggtcaaaggcagcattgcctggtgagtgtttattggagcttttaaccctgagccctgggcccagtcagcaagt

SEQ ID NO: 7031 - DNA, 418 bp, artificial
  synthetic oligonucleotide
aggtagacatatagattggcagtgagtgaacaatcactgatgttgtttaaagcggccatgagttgctaattgctgactctgggggatgggtacatggatattttactatttgattattctctctgattttgcatgtattcggaattctccataatatgaagctaaatcacatgtgagagatccctgctactttataagcattggcaatctcactcctacagcccacacaggccggctacccggctgttagggctagaaaagtgtaagatgccgctacgcatagctggagtggcgctccaggcaggttgagatttggagacactcctgaagcaaaccatctgtgtgaacacacacacatacatgtggagtctcacccaccgaccccagtgcagccccatccctggttcgtacccctctt

SEQ ID NO: 7032 - DNA, 1406 bp, artificial
  synthetic oligonucleotide
gcagagttgacgtttcaataagcgacataggcgtgttaactagccaagacagactgtcagcaaagcaggaccgcgtcgcaccccttctccgacggtgagcccgtccaaccatgccccgccccttttcaatccggcacaactgggaaaaaccaagagcgaccgcgggaagcatccaccgtccccgccggccctcaacaggttcatccgtgccccgccccccactgacaaaggcgacctgggaaaaaccactggcggcaactctggggatttccggtcaacaccgtaccacccctagccgggatggatcgtccagcgtgtcttttttcgttaacagggctaggagattacgaagtcaggagaaacatggcgtggttcggccttcgccgcaccttctctggttgtggcccctcataacggagcccgaatgacaggaaccgagtgggggtagcgggagatacgttaagagtcccccgagtctggtacatggctctgtgcggccgatgcctcccccgcccgacccccacggctggccttggcgtcgcagcaatattccggatgcctgtgcccattgccgtaccagggctcccgagcgtactcctccatggcgctggcgtctggccgcgcagtcaggccacgcccccagcgtagacgcacaccggcgtcggagctttccgcctattaccgggcagcgattgggtcgctataccgcatgtcacgccaaggacgcactctcattggccaatcgagtttctgccatttgttcattgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagag

SEQ ID NO: 7033 - DNA, 10184 bp, artificial
  synthetic oligonucleotide
aaggcaagaaaactagcaggaagtatccttaccaggcctgtttccccactgtctcattggcctgactggggatggtgggaggtccaggtttaacttgaatgtggtggtcatggtagcttcttggcagaaggggtgcctgccattgaccacaggtgggaaattggaggacagtctgagagctgaatttctcccacgtggtgagaattgctttggcagctcaagggagttggatctgaggtttccaggacttttcttcatggccaccttatgatcccaagctgaccaccacagccttactgagtcaagaagaggagggatggggaagggccggggctgccccgttcttgttttgttttgttttttgagatggagtcttgctcttgtcacccaggctggagtgcagtggcacgatctcggctcattgcagcctctgcctcccaggttcaagtgattctccttcctcaacctcctgagtagctgggattacaggtgcctaccaccacacctggctaatttttgtatttttagtagagacggggttttgccatattgggcaggctggtctcaaactcctgacctggtgatccgctggccttggtctcccaaagtgctgggattatgggtgtgagccaccactcccgggccaggggctgccctgttttaagagccctctggatgccccacctctgctgccctctcattgatcaggactgtgcatgtggttgccatagctgcaagggagcctgggaaatgtgtagtttgacaggcagccgcctccaatcagggtctttcttccctgacagaatgacccctcctctgtcactgtcttttctccagagctaccaaaaaaccgagttgaggcagcacaggctctgtggcctgaaagagcttcccacaaaaccgttcccaaagtcaggccatcctggtcaaaatctaacacccaactctcccacacacacacaccaccaacaggaaagcaagggagaggcgccacaggggacacacggggaggtttggccgccgtccgtgcacccctagaggccgctgtggcacccacgtgcctgtgcgcaagccgcctgggggggcacgaccccttgctcccccggggcaatggcacgggcaggggcggggcagtggcaggggcaggggcgcggcgcaggggggtgggcggcctgaggagccgagggagggcggctgcgcatgtccactcccccaaccgccgccggggtgccccggggagcagcgtcgccccccgccaggcctgtcagagcgtcccagcgcgcccgcctccccacggacacaggtgagcgaggcgccggtgcccctggccctgccaggcctgggggtatccccgcgccggctttgggggatcgtcccccaagcgccaagccttctcccgggcgagcggcccctcactcgggccggccgggaggggtgtcggcgcttggctggaagcggggccgcctcacccggagtcgggatgggtcttgacaggatgcccgggcgacgctgctcacaccgagcccgaagtggagtcctggtttcggggacccttccgcactccgagctttgcacctcacccggcctcgtccgggaaagcacgacctggcgaggccgccctaaccccaggtcccggccccttagcgcgccagccttggtgagctgggcgaagccccccaacctggtcccagcggctctgagcgcgcggccacggggacccgccgggggctccgcgccacttgagaggaccgagcccccaatctccggcgcctcccgcgggctgaggccccgggccagtgccctcggcacgtgcctctgcgcctcgggctcctcccgggagcggagccttggggaccagggccgcggcctccctgcgcgtcgcggggactgggcgagtgtggccccgtcccgccaggcacctggggtggaagctgcgctccgccactcggccaggccccgggctttccttcctcaccgtcggcgcccccagactccagccgctcagaccccgacttaagaggcagcctcgaccccgcctctgccttctgacccatccctaaagatggccgggcacccctacaggacccccagaagccgacctctccctccacgtgcgccgccgcctcgcccctccccgcagtcctccaggtcttcttcctgtccccaaccgtcggggacccccaagctccgtcctccgcttcctgctctctttatcccgcccccgctccttctgggccaacgccgccagtgactattcccagggatccctcagagctgaggacgccgcggccgcatccccatttgggaccttgccccgactccgacctccggatctccagctccaccaaacctcgaagccaccatccgcccccaaactgccgctgcgccaggctttcggaggggagtcgtggcaacagccattaggatgcactaagcagggcacttcctgagcccaaggacaccgaggggcattcactgagtgaatggggatgtgctgctaataactaacactaattgaccacctgccgtgtgcccatcctcttcgaacatgcaacttccttgttccttatcttgttactgtctctttctctctgccagaatccaatcctcacaagggcagggactggggtctgttttgttaactgccatatcacaatgcctggcacgaaggaagattcttgaattaatgaatggagattaaattataatttaaaagcctggcatgaactgagcaccttctgcatgcttatcacccgctactgacatatagttcactttttttttttttttttttttgagacggagttttgctcttatctcccaggctggagtgcaagtggtgtgatctcagctcactgcaacctccgcctcccgggttcaagcgattcttctgcctcagcctcccgagtagctgggattacaggcgtccaccaccactcctggctaatttttttgtgtttttattagagacagggtttcgcaatgttgggcaggctggtctcgaactcctgacctcaggtgatccacccgactcggcctccaaagtgctgggattacaggcgtgagccattgtgccccgccccctttttaacctagtttgttgtctctcaccccgaccagaatataaccttcatgagggctacagtttgttgtctatttattgcccaactccatgtccttgccacacagtaggttcccaataaatgtatgttgaataattaataaagactacattctaatgataatggctaacagaccacgtgatttacatatttatttggtttattatattatctgcctctgccttttagaacataaaccttctgggggtgggaatgttgggtccctactgtctggcaggcactgtgctgggctagggttcaatggtgaccaaaaccggcaaaatcctgccctccctctgtcatggggaggaactgctaatgggcatggggattcttttctgggtgaggaaaatgttctaaaatttacttatggtgatagttgcacaacttcgtgaatatgctaaaacccgttaaattggacactagctggctgaacttgatgggatgtaaattacatctcaataaagctgtttgggaaatccagccttcacagttgttgattcgcgtgaggagggaaggagagatggggggacgtgggacagggagaaaacaacataaatcatatatatatagcatgcaaattggaaggtgatcagcacacaataggcattcaataaatgttgaaataatgacaccccactgtctccttgccctcaaatggtctcccctaacgtatcccctgttgtcttgcttcttctcttcccacttgcagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattctttcattcaagaaattcagggggagcccactgtgtgctaggctccgctttatatataagggaggtagaggcaaacaagacacttaaaaatccttgcccttatagatatggcatcaggctagatagtgataaaggctacgtgttaaaggcaggtgaaggaatagggtgacaggtccaggaaagccttcttgagagtaggtgacatctggacaaaaacctgaagatatccagaggcagagggactagccagtgcaaagaccatggccacaaatcagctgccaccacagcaaccctcagtatatccagggcctggagcaagagtacaggtaggcctctacactacataactaaatatgtaaacgttcagacattacgaatcaagctttacaaagtaaatgaaatacaccctatcctactttggcaaatacactttattagtgacctggatacccaggctccaatttctcagccttctcagagttccctgccagaatgtgcctgtctgccaaagagtgtgcctgtactggggcctcccgaccctcagtgccctctccctttctctccgctctctccttttctcttccccacatcaggaggtgttcatgtgtgcctgcgacatcccagccagcacctcaagctctactcacgtgccccacaaagccaccccttggccctcaggaggatggtcccttggaagatgatggtgcaggccctgaaagtggcctcaaagcctgggatccccatacccaagtgaggcctaaaagggggacacaagatccgcgattgtccatgtggatgtcttcccctccacccctaggagagacatagactgagcaggtgattgctctaaagtgcaggacccagggtagagtctcctctctcctggtctaagggcaaccaccaccgcggggaaccaccagcccctagaaactgccactcacacagacaagcacagagctgcttcagatcatgtttattgtggggccagggggtagggatcctcgggtgagagggctggctggccggggtaagttgctctggacgtgctggcggggagcagtcctggtggcgggatggcgggggcacttctgggtcccagggtgcacgggatccgggcagtgctcagggtggcaagaggcggcgtgcaggcacctggggcgccggggtctctaggcgtttcacacgcagcagcgcccccagcacgccctcagggggcagctcagagcccacatcgtggtcggcggcacggcggaggcggcgcggggctgccaccccctcggagtccgcgcttcccgcaagaatccgtcccagcaagtacctgcagggccgagcgcaaagcagtgaggcggtgtccgcggtggggcgttcccccgccccacgctcggggcccagaacgcaggatccacaaccacatactgcctggggacacggttccctccccaagaaggcgtcctcagcccactgctttcagtagacagccgtcatcgcctttcatcccagaaaactgtggcttccccgcctccctctccccttcccaggacctggggtccacttcccccactgagtcagccaggcatccttgcctggactccctggatccaggacctcactccctcttaggccccaggacttaggggttcgcactccacggggtaagcaggcttcccagttcctcgccctcgtcctctccggacgcaggcgcccgacccctccccaccccctgccgggcacctcaacagctcggggtccacgtcgggtgtctcgtcgcctgcctcctcagcatccgggcccgcggggccgtcgtcgtagaccgggggccggggtcggagcgccgcggcggggacgggcgcggggacaagctgggctgcgagggcggcagggtcaaggcgggcgcggagcagagcgcgagcgagctgcgctgcaggcgcgtcggggtcgtcgtccaggcccagagccggatcagagttgcggggggcgccccagacgcgcagcagctgcgccaggacgcgcgcctgctgatcctcagcctcctgcgcctcggcccgcgcccgctcctgacgttcggcctccagcagatgcgccagcgcccgcgccagctcctgcaccgcccccgccgcctcacctcggggcactgaccgccggaagcggcgaggagcgccagtctcagccaagggcggagacgctgcgcttaggccgcggggctcctgcgggaaaatgaggtgggggaaaagagtttgtcagcgtccgtcgagacagggacccccagcccgggaagcttcgtaggcctcaaacatcccagatgccaccaaaagcaccgtgaccatccaaatatacccggacacccctaaggccactggaaaccaccaaatatctccagacgcacttaagaccaccaaagatccccagacaccccccacccccaccccacagcgcgccagtgatcccttggtgactctcataattcctccctccccacccccactcctggagaccgagtttcttcataagagtagtgatggtagatatgacagttatagatttttccatatttaatattgtggacaataggaactatatgaataaacttgttcatatatcatttggcatgtgtacaagttcatctgtagaataaattacccaatgacaaattttcagttcaagcagttttcaaacaatttccacaagtttaaagaaataaaagagggtaccaataatctgagcaaggaataaaagatcataaaaatgactgtgaaggtttggaaaagaaacatacaggccacatataaatatgtttaaaaggagtgatgcctgcaacacaaatagtcaatgaaagagtagtacacagaagatacagagaattcctaaaaagtagtaagagaaaaacaaactcatacagaaatagaaaaaatacatgatcgcctatttcacaaaaatgattactaaacatatgaaaaattgggccaggtgtagtggttcatgcctgtaatcccagcactttgggaggccaaggcaggaagatcgcttgaggccaggagtttgagaccagcctggtcaaaatggcgagaccctgtctctacaaaaaataaaaccaaaaaaaatgagcggggcacaagcccatagtcccagctacttgggaagatgaggtgggaggatcacctgagtccagaagctcaaggttgcagtgagcccagatcgcaccactgcactccagcgtgcatgacagaggaagaccctgtctctaacaaacataaaataaaattaaaaacctcattagtaatcaggggaaagcaaattaaaatgccagggagatactatgcataatataaccaaaagattgacccaaatcaaaaagtctgataatatgaagtgttgatatgaatgcagaaaaatgggaactctcatactatgctggtgagaattaaactggcaaagtaattttgcagagcggtttgacaatatctaaaaagatgcacatatcctatgacccactcctgggatgtcactccccagagcagctttggcacatacgctactggtcacaagttcgtgaaagatgacagcagcactgttcgtaatagcataaaagggcgggggagaaagaaaagcctggaaacagtccaatgtccactgacaaattgagaatacatatataaatcatgatgtcctcataggatgtaatattatgcagcaataaaaataaatgaattacagccacatgcatcaacttggatgaatctcgtgaccagaatagagccaagggaaaaaaaaacgtcaagttccagaatttcactgcagactgcctgagactactagacaccctgaggacttcctagtgacccctagtgactacgaggaaccagtcacccagtatgattccgtttcaatgatgttcaaaagcaggaaaaactaaacaatggattttttttgagagctacacatatgtgataagctacaaacaaaagtaagggatcaatggacagaaaatacagaataaggactgtggggggacaggggctgccatggcgaggggcacgcaggggcttctaactcttggtcaggctctatttattaagctgagtgactgctacacgagagagttattttgtcatcattctttacattgtacatatatattaaacacattgttacacggatataaggtaacagttttttttaattcccatctttgatgcagacagtattgaagagctagaggaggatgcctctccaagtgcccttgctggcgcccaccactcctcagtcaccccggggtatcacactcaccagcaatcacagcctcacacacactcatgaggactgacaggcctggagatgtcacatatacagcccaacactgccacagccacatgcaaggacctgcacacgttcacatccgcagctgctcctgcagttacaatcgccaagccacccaggtgcaaggacatgcaccatccttaaagacacaatgcagcagagagacatcatggctcctctcctcaggatgacacagctccacaaagaaacggagagaaacagtctcaggaacacgcaaacgaaatcccaggcacttggtccaacagaaccactatggaatgtgcacacggagatgcgaagaccattccctctcaaacacaaacgaaatcacacacacacacacacacacacacacacacagagagagagagagacagagagagagagagagagacacgcccataggccaagccaacacacataataaggattcacaaatatccacacggtgtcactgagaaaacaatcggacgcacaaaagaatcgcgcacagaagtatcccggtatcacacacactacacacccagacgcaccacggcacctttctaggacacttggaagcgctcaaaccaaagaacacacactttcaaggacacgacacctccacaccgctctcctcacatcacacgcacacacactgatgcgcgcgcgccctttcttaaagcgccttagtgccgtggacagcgtcacaggcaccgggcacggagaggtgggcagggcacggttaccggcggcgccccggacaacgccacccgcacaggcagagaccaagtcaggtctcaggtgtgccggcgtggcctgggcgcggaccggcggccggagcccgggccaccctcgtcgatctctccgcacgtcccgggagccggctcgggcgggggtgaggcggcgcagccccaaccccaaccctcgccggtggcatcctcccccaacccccacccctcgccggactggggtcgcacctttaccggccgcgcgcaga

SEQ ID NO: 7034 - DNA, 2142 bp, artificial
  synthetic oligonucleotide
ctcctcaactatgacctcaaccggccaggattccaccacaaccaggcagcgaagaagtaggcagaacccccagtcgccccctcaggactccagtgtcacttcggtgaggccctagacccgccctgatgagggggagagggagcaagttggtcatgccctggactctgacccttctctctgattcacagaagcgaaatattaaaaagggagccgttccccgctctatccccaatctagcggaggtaaagaagaaaggcaaaatgaagaagctcggccaagcaatggaagaagacctaatcgtgggactgcaagggatggtgagcagggcctggctgcagtttagcctcgtatgacaatcaaaacccaaaggttccccaccctggacagttccctctgactcagggcctaaaatggatctgtgtctccttttttttttcctctgcaggatctgaaccttgaggctgaagcactggctggcactggcttggtgttggatgagcagttaaatgaattccattgcctctgggatgacaggtgaggctgggtcctccaggctgtctccaaaccacaaaaatacacacacttagagcccattagcaagaataaatcttttcttaccccagcctggatactggaagcagatgatttggggaggtagggctcacacttgaaagggttcttttatgtagctaacaaacatttattgagtgcctattgtgtgccaagagttggtgatacaaatgtaccaaacaacagacaggggtccttctctaggagcggattgatgagtaggagggcagatcattaaacagccaacagcagtatgaggtgtttaatgaagacagacttaagaccaggggattcaagggtgtataatagaggatcctaaactagtatccgggcttcccagaagcctttatagaggaagagacgtttgtactgaaacagaaggatgaaacctcccgtttgctttacttttcaaaaagaatcagcaaatccttttggctatatgttcaaaatatattcaccatctgacctctcctcaccacctccactgccaccatcatcatcactcacctagacttgcagaggcctcctccctggtcccctacttccaacctcacctctattatctgttcatgcagcaacctaaaaaaatatgtatgagttgatgtctttgttaaaatactttaaggaggccaggcatggtggctcacgcctataatcccagcactttgggggggccaaggcaggtggatcacttgaggtcaggagttcgagaccggtctgaccaacgcgatgaaacactgtctctactaaaaatacaaaaattagttgggcgtggtggcacacacctgtaatcctagctacttgggaggctgaggcaggagaatcgcttgatctgggaggcggaggttgcagtgagccgagattgtgccattgcaccccagcctgggcaacaagagcaaaactctgtctcaaaaagtaaaaataaaaaaaaaaaaagtactttaagggcaaactgttgccctcaaggtaaagtccaaatttttcatcctggcctcaaaggttccacatgatctggctccacatcactttgtgacctcatcagccaatccttctcgcccacactactccccttgttcttccaacatgccaggcaccctcttgcctctggtctgtaccctgaccaacccctttcccagagattcttttcggtcttctactcttccagctgcctttcacatcccaatgagactttctcagagaaggttttgcctggccaaaccctaccccaatacctgatcttattttcctagcccatgacattgtttgctaattatcatacttgtgtgtttaccaattaatatctatatcccttatcccaacctaagactaacttactatgggaaaaagacttcttttatggaatacctatttaccatctattgaggagctagggatacagcagtaaacaaaacaaacaaaagcctgtgtcttcagggtaaagggggaagacagacaataaataaacaaaaagtaaatgatgcactgtggtagaaagagcagtgttatgaagaagcagtaaagggaggatagtaggagaaagtacagtggaggagacttcaattttaaataggc

SEQ ID NO: 7035 - DNA, 1677 bp, artificial
  synthetic oligonucleotide
atggatgtggtatcattcatagtgatataaaagagatagaaaaagaaaaaaagaaatggcacatgttgagaggtccaggagagggaggattcatgaagaacatggcagggctgtgagttaatctgtagttgatctacaaaaataaacttgcagccaagcgtggtggctcacgcctgcaatcccaacactttgagaggatgaggcaggaggatcgcttgagctcaggagttggagtccagcctgggcaacatactgagactactgtctctacaaaaaaaaaaaaaaaagttttataattagccaggcgtggtggtgcgcacctataatggaatcccagctactcaggaggctgagacaggaggattgtttgaggccaggaggtcaaggctgcagtgagccgtgattgcaccactgcattccagcctgggtgatagaatgagactctgtctcttaaaaaaataaataaataaacaaaataaacatgcaaatgggttagttaaaaattgttaaggagctaaaagagaaactaaaaacgataatcaaattgtattggaagagatagtaatgtgaatgagctaaattttcatttgtcatagcagggagttgctaaatcaagaaatagtggtgcagccgggcacactggctcacatctgtaatcccagcactttgggaggccgaggcggggaacacttgagccaggagttcaagaccagcctgggcaacacggggagacccggtctctacaaaaaataaaaaaaaattagccaggcgtggtggggtgtgcctgtggtccctgctactcagaggctgaggttgcaggatcacttgagtctgggaggttgaggctgcagtgagccgtgatcactgcactgaaggctgggcgacagagcaagactctgtctcaaaaaaaaaaaaaaaagacgccaggcacagtgactcacacctgtaatctcagcactttgggaggctgaggtgggcagatcaccttaggtcaggagtttgagaccagcctggccaacatagcaaaaccccatctctactaaaaatataaaaattagctgggcatggtggcgtgtgcctgtagtcccagctactccagaggctgaggcacgagaatcacctgaaccagggatgtggaggttgcggtaagccaaaatggtgccactgcactccagcctgggcaacagagcaagactctgtctcaaataataataaataaataaataaataaacaaacaaacagtggtgcatcagttagggactttggaggcatgtaggagaaaactcaactaactgtgggttaaacaagacaagagttttcttttcgtttcactgaacaaccagtccagaggtagttagtcaggtcatgggcagtggctgggaagcaagaggaagtgaatgagcaataagggccagcgcagtagggttgggaggttcccagaagccccatccacacctctgcccccatctcattgcctggtccagctaacgtggcctccggacgtgctgggaaatgtaggtttttaaagttgggtacacggttgaccccactgaaatttctgttgtgtttataagaaataaaggggaaatgtatactgggtaggcaaattgctatctctgccttgagtggtataaacactatttggagatatggaaataatttcaaggagaaataaa

SEQ ID NO: 7036 - DNA, 3459 bp, artificial
  synthetic oligonucleotide
tttgcactacctacctgtgtcacctcccacagtcctcagcctgtgccctcccattcctgccccttgatctccaggcgctgagccagaggattgtcgggaggaccctgggcaaagacgcctaccctgccatgctgcgccatctgccctccaggctgccagtcaagatgtggggcaggactttggagaaacaggtgaacaagatggcccctggggatctggggcaagggtgttggcactgaaactggtctagtaacctgtttcccttctctgcgggctcccatttcctgtcctcctctctccctttctctttcagagacaagcagagggcagcagaggcccatggaaaggcccggctctaagccatggagggccctgtgctcaggtgtgcagggctgggccggggctgagggctggctcctcccccagtttagccagggacaggtggagagatacaaaggtggctcacgcagggtgcccccaaagctgtcatgattaaggccatgtggagagaggctaggaaacacagcgctgaccttgagctttaggagaggaattcagaggcccctggcaacctgaaggggaccttgaagaggaccctgtaggaagacagaacacttccctgtagaggaggccaaaggaggaaggacatggtgttccgggcactctgactatagggattttatatgctgtggtgagaaataaaatggattatatttttgtagagtgtgtaaaacggggcttggcacacagtaagccttgtgtgattactatgtctttttttttttttttttttgagaccgaggtttgctcttgtcgcccagggtggagtgcagtggtgcaatctcaggtcactgcaacctctgcctcccaggttcaagcgattctcctgcctcagcctcccgagtaggggattacaggtgcacgtcaccatgcccagctaatttttgtatttttaatagagacaggatttcaccatgtaggccaggctggtctcaaactcctgacctcatgtaatccacccaccttggcctcccaaagtgctaggattacagacgtgagccactgcacccagtcctttgtgtgatgactatgtcttgatcatcattttataaagcaggctttgtaacttcacctccaagagtctgcaggatccagaccctgccttgccctcccacttatctctcactcactcttgggttctgagctacgctggccttcctgttattgaagacagccatccctgctcgtccttgaatttgcaaggatggagctccgagtctgcaaagcaggatctggggagtgaatctaagctggcagggaagaatagaataatgggaggaataggtggagtttatttctaacagactatcaaaatgatgcagatgtggccaaagcagtgcttagaggaaatctatagttctaaatgcacagatcagaaaagtagaaaagttgaaaatcaatgacctgagcttccctatcaagaaactgggaaaagaatggcaagtggaacctaagaaagtagaaggaaggaaattataacagcagaaactggtgaaatagaaagcaaagatacaataaagccaacaatgttaaaagttgattctttgaacagattaataaaatactagcaatgtctattttctctcgagaaattaagaaaatatatggattgccaatatcaggaatataaacagggtattgtgacagattctacagatgttagaaggttaataagggctgggtgcagtggctcatgcctgtaaccccaacactctgggaggctgaggagggaggattgcttgagcccaggaattcaagaccagcctgggaaacatagtgagccctcacctctacaaaaaaaaagaaaaaagaaaacaaaaaatagttgggcatggtggcacacacctgtaatcccagctactagggaggctgaagtaggaggattgcttgagtccaggaggttgaggctgcagtgagctgtgatcatgccaccatgctccaggctgggcaacaaagcaagaccctgtctcaaaaagggaattaaaaaagaaagttaataaaatttatttcaacatatgactttattttcaatggagccaaaatgtcggtcattttctctttctgcagttcctatgtccatgtggatcttttgtatccaccgggagagcaaaactcagcaactttgctaatgcctcctccactcaggaaaatagaatggtacaggattttttttagctggagctcagtgaaatcaattgtttaaaatgggctggtttcaatggaactaaacgcagtggaatagaaaataataaaatagcaaagggtagaacagaatagaatggaatccaatggaatcgaatcgaacagaatagaaactagtcagactttgtgccaagcactgtccctagttgttgcagtagatatttatttattgaacaaatatgattgaactagttgtttgggaaagagtggggaacaaaacagacagaagtccctgctcttatgaagcttacattctagtcagggagacaggcattaccatctgcaaaggcccataaatgaaaggtacaagggtggtccttatgaggaacaggctaaaggacagtgtagattggagttcaagagcaatggatgaggctgtagagatagggtgtcattgtaactggagtctagattttaacaagatgaccacacatcatcatcatcatcaatcgttttatagcacttgatatgtattaggcattgttctatgcccttaaaaacagtacttttttaaaactctcacaataatcctacatgtataaaatcatgctcattttatagaaggggaaaccaaggcacagataaattagataaattatttaaacgtcaatctggttccagaatcttcttttttttttttttttttagatacagtcttgctctgtcacccaggagtccggttgagtgatcatagctcattgcaacctccgcctcccaggctcaagtgatcctcccaccccaggcccccaagtaaccagaactacacgtgagcgccccacaacctaattttcatatttttttgtagatacagggtctcactgtgttgcctaggctgatctcaaactcctaggttcaagggatctgtctgcctcagccttccaaagtgctgagattacaggtgccaccactagaatctattcttttaagcattatactccattgcctatagtgccagaccacaggtgctttataatcctgtagcatagatactataaatattcaaattactaaataattcaagtcaagagaaagatctgatgggaagtgtgctgagggcgggaaagtggaaggttggggagtggtcctccctctgggtgtcaaggtggatctgtaaacacgcacgcccagaaaccttcatttcttctgagatgcccccttcttgtcttgttctctgtgactgaagctgcagaatgggaa

SEQ ID NO: 7037 - DNA, 1526 bp, artificial
  synthetic oligonucleotide
accggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaaca

SEQ ID NO: 7038 - DNA, 1638 bp, artificial
  synthetic oligonucleotide
tctcgaacctactctcagatggccactgctgcttcaaccaccacatcttatgtgaggtgggaagaaagaatgcggggcaaaatgaaaaagaaagagaaacggtcaggtgcagtggctcacacctgtaatcccaacactttgggaggccaaggcaggaggatctcttgagcccaggagttcaagaccataggcaatatagtaagatcccatctctaccaaaaaaaaaaaaaatcatccacgcatggtggcacacgcctgtaagccccagctactcaggaggttgaggcaagaggatcgtttgagcccaggagtttgaggctgcagtgagctatgatcgcaccactgcactccagccttgggggacagagcaagactgtctcaaaaaaagaaaaaaaagatgcctgtaatcctagcactttgggaggccaaggcgggctgatcacctgaggtcaggagttcgagaccggcctgggcaacatagcgaaacctcatctctactaaaaatacaaaaattaggccaggtgtggtggctcatgcctgtaatcccagtaccttgggaggccgaggcaggtggatcacctgaggtcgggagttcgagaccagcctgaccaacatggagacaccccgtctctactaaaaatataaaattcaccaggcatggtggtacatgcttgtactcccagctactcgggaggctgaggcaggagaatcacttgaacccaggaggtggatgttgcagtgagccgagatcccgtcattgtactccagcctgggcaacaagagtgaaactccgcctcaaaaaaaaaaaaaaaattagctggacctggtggcaggcacctgtaatcccagctacttgggaggcttaggcaggagaactgcttgaacccaaaaggtggagtttgtagtgagccaagattgcaccactgcactccagcctgggcgacagagtgagactccatctcaaaaaaaaaagaaaaaagaggctgggtgcagtggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtag

SEQ ID NO: 7039 - DNA, 1276 bp, artificial
  synthetic oligonucleotide
ttcagtggattcatttgaagcgagggccactggtatttgaaatagatgacatcatctgccagcagaggcgtgaggcaacttgaggcggggtgtgggcctgacgtcatcacgcagcctcttcctttccccgcccccttctcttggcgaacgaggcgtcagtttaacacctccgtgaatccggaagtatgctgtcaaaacaaccaaaccacggggctgggggaggcggggcctcagtaggcgtctgcacgctagctgaaatagagcaaaatgcccgacttttgggggcggggctcctggcaacagcactctaggcgcaggcgcagaggcgacctccaggcagggccaggtgggagggacggtggggggtagggtcgcgcggcgccctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgat

SEQ ID NO: 7040 - DNA, 2060 bp, artificial
  synthetic oligonucleotide
tttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggaggcctgattggctggaaaactgaaggatccccattctgattggttgctctgagtgggacacagaggagagaaagcaagagagatgaagggttggtgcctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctc

SEQ ID NO: 7041 - DNA, 2625 bp, artificial
  synthetic oligonucleotide
ccttctcccttccacgtcacagctaagcatgtagtgcagtaagcgcccagtaagtgctcttttggaaaaataggcccttcatcagcctaggtacaaaggggaatgcctagaaactgcagcagtagggtaggtagaaggcgggtgctacataaatctttagtgttggtgcagatagaggtgcggatggggccagtgtaagcgctttcttttttattttatttatttatttatttagagaaggagtttcgctcttgtttatttatttatttattttggagaaggagttttgctcttgtcacccaggctggagtgcaatggcgtgatctcggctcactgcaacctccgtctcctgggctcaagtgattctcctgcctcagcctccggagtagctgggattacaggcgcccagctaaattttttgtatttttagtagagacagggtttcgccatattggccagcctggtctcaaactcatgacctcaggtgatccatccgcctcggccttccaaagtgctgggttacaggtgtgagccaccacgcccagtctttatttatttattttgagacggagtttcgctcttgtagcccacaatgacgcgatcttggctcactgcaacctctgcctcctgattctcctgctttaacctcccgagtagctgggattacaagcgtgcgccaccacgcctggctaatttttgtatttttagtagagacggggtttcgccatgttggccaggctggtctcgaactcctgacctcaagctatcctcctacccttggcctcccgaagtgctgggtttataggcgtgagccaccgagcctggcccttaagagctttataaatgccccccttttaagtgctcggtactagcctccctctagttcacagagaacatttactagtcgctggggtcaccttcgaagcaaagagtctgctggggaattaagcatgcaaatcacttctcaacgacgacacgccaagtgctcacagctcgtccccaggggaagcacaggcgcctaatttgtgttcctaggtgacacagtcattacttataaatgttcctggccggtcccaggaggtgggagggttgggagttacttcggttctctcaaaggttggggaaggagagatctcggtttgttttcccatctgtgaaacggggacaccacggtatttagaggacgtgcgcgggtgactatttgggggtgcagcggcttccctcctccctcccccatctttcccttctcacttccaaggcttggaaatttggagattcggaagtttgttcttggatggccagaaatcctccggaggcagacggtctggggctgaaaccgccacaggccggaaaggtgcgggcgtgaacgtcctgcgcgccgacgtccccccgcgccggtctcccctcaatcctcctgctcccctcctccgcgtccccgtccccgcccccctcctgctctcccattggccgagccggcggccgggccgccccgggatttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcag

SEQ ID NO: 7042 - DNA, 1174 bp, artificial
  synthetic oligonucleotide
tcaatcagtcaatcaacaaaataagaatctggccaggcacggtggctcatgcctgtaatcccagcactttgggaggctgaggcgggtggatcacctaaggtcaggagttcgagaccagcctggccaacgtggcaaaacccgtctctactaaaaatacaaaaattagccaggtgtggtggcgggtgcctgtaatcccagctactcgggaggctgaggcaggagaatccattgaacccaggaggtggaggttgcagtgagtggagatcacaccactgcgctccagcctaggtgacagaacgagactccgtttcaataaataaataaataaatataaaaaataaaataaaataagaatcttatgagtcccagagagagagagagagagagacaaagctcttcctcacagtaaaatcccaggtatatgtgtaaaagaaaaatcattatttggccaccatcagagtagttattgcttcaggcaagaatcaccaatgaatgctaaagtagtgagtaaaagtttgatttaaaaaaaattgcagagttacagtctcaaagtatctcccgaaaagctacttattaattacaaaaggggatcatgcctgtaatcccagcactttgggaggccaatgcaggaggattgcttaagcccaggaatccgagaccagcctgggcaacatagtgagactgtttctacaaaaaatttaaaaattagccgggcatggtgactcacacctgtagtccttgaagattacatgagcccaggagttcaaagatgcagtgaaccatgattgtgtcaatgccctcaagcttgcgtaatagggcaagaccctgtctccaaaaaaaaagaaaaaaaattacaaagggaaaaatagtaaatttatactggtgaaaactagaagaccactttaagcaaaagatcaatgctaatactaacaatttcgagactaactgaaccctcctgcctcctgataacgctgagaacacagcgtcacttctgtggaattcctgccaaaaatgcagaattcaaatctaatcatgaggagacatcagataaacccaaattgaaggacattcttccaaagaactggtctgtgctctcccaaaacatcaagatcatgaaagttaagtgaagatggagacattgttccacattggaggagactaaaaaaacctgata

SEQ ID NO: 7043 - DNA, 1860 bp, artificial
  synthetic oligonucleotide
gactcacaggaagaagatgacccccgtgtgggccatggcataggccagccccaggatgccgctgcccatgatggcgttgctgaggttgaacactgacattccaaacgatgtcttcccctcgaactgcacgcaaggagcaaagcccgggcacacattgggacagggcacagggtaaggagactaatgccagggccagggaaagactagagaagaagcaagcggggtggagagaagccaaggagagaccatcggaggagggaagaggctagcagggaagaagagttgaagatggaagaggctgcgaatggggagagctgggaagggggaaactaggacaaactttggagggagcagctggaagtggagaggaccgggggagggtgaagcagccaccagaggtaaaacagctggggaggggagacgctgcgggtggggataggctgaggatggggagtgctggaggaggaagaacagctggaggagaaaggcaggccgggaggggagcagccagggagggcagtcactgggccgaagagcgggtggggagaaacaaggccagggagagagctggaaagggcatatctggggaagaggagtatctggagaggggagcgaccaagtagtgtgtagctgtgctggggagatagctgggcaggggaacagcagggaggaggaggagtggggaagagggagcagtgcgggaggagattagctggggaaggtgccaccaggacagatcctgtggggccactcacatccatgaactggaccggcttgctcccaggagcaggaccacgactgggcaggaagccctcacgttcttgcctgtagctggatagggcagggaaataggggccgataagagggaaatcctaacccctgatccctgagcccacctccttggacccctgactcaccccacagcatccgaagggagggctccattcatctttggatcctgcagttccatcctgtgggcaaagaaatggggtggggggatcagagatggaacgagcatgcttcaaagtgaggggagctgaagaaggggggaggggagtcccatagagaccgatggaaagacggagaaagagacaaggcaggggagcaggaacagacagggatagaaatggaggcagactgacagagaaagagatgagagagagagaagaacaaaaatcagagaaggagagaagccaacagttagttactcagagagacacagagagagccagtgagagagaaatagtggggaagagagagacagaaagctacagagagagccggaccccagcgcagatgagccgaccacgtggagaagggatagcctctcctcccagaccccagactcacgctgtctctcttgccatctgtgtctttcattccccggtcccccgcgccaccccctctccttccctccaccctcaccgcgtggccaggcggctcactccttgcagggacacgtgtcggcctggctgccccacccctcctaatgccctcacccccctccttcccgcctgggcccccaagcccgagaccagagctaatgcaacctgttgagtgagctgagggttggggacagactcggagacccctgccccagacgctgcaaactgctctctgccacgactctgaatatcctcactagaagccaaagacaagtgcccgaaccgagccccttcccagggacagaaatgacccagggactcccatttgaccccaattctagggcctagaggtcttttccagggcccctagcaagtcttaaacactcatcttctggcagaagtcaatttggagacactgccagacttgagaaacttcctaggtgtggggtgtggggtgtctcaggaacctggcccg

SEQ ID NO: 7044 - DNA, 626 bp, artificial
  synthetic oligonucleotide
attaacagaagtaggcataaagagaaaactgaacagtccaggcacagtggctcacgcctgtaatcccaacactttgggaggctgaggcagatcacttgaggtcaggagtttgagaccagcctggccaacatggggaaaccccatctctattaaaaatacaaaaattagctaggcgtggtggcacatgcctgtaatcctaggtactcaggaggctgaggcataagaatcacttgaaaccgggagggggaggttgcagtgagcagagatcacaccactgcactccagcctgggcaacagagtggaactccatctcaaaaaaaaaagaaagaaagaaagagagaaaactgaacagagaaccaggtgcaaggtcaggcctgagtggcagtgaaagtggaagagttaacacaggaccaagatcaaggctcagatctgaaggccatagatggcagaaatgtgacccaaggcctagattcagtgtggagaagagaggacacataatctgctgtgtagccctaactaaagccacaatcatgtctagacttcatcagtgttatgcagtagctgctgtgcactgaattgtgttccctcaaaatttgtatgttgaagacctaacaccctacatgact

SEQ ID NO: 7045 - DNA, 1221 bp, artificial
  synthetic oligonucleotide
gtgtgtgtggggtgggggtaggatggttgccgggatgccacagagacagttgggctcatcagaacagaagcctaagagagagaaacgtgcaggatccaggtatgagctccactgtggccagtcactgccctcagccctgacaggatatagaagagcagaacacccagaagctgccttgcgatttttccctacacaaaaggaaaatgtgaggtactttctgcagcctaagaaatagccaaagcaggaaaagggatgctcatgtgtccccagacttgtctgtacctagaactttctgttacctagtttagtcatggcctcatactttctcttcatatacacatagacgattttctccgagactttcatcttttcccactcttccttagagaagtatttggcaatatcatcgaaggcctacaaaaaaaaaaaaaaggaattatggcagggactcagctaggcatgtctgccattcagctggagtcgcttcctgtgtgctggatctgggaagtggggataatccttcctggttgatgccacggctaactgacagaacatgagggaccttcctagcttcacccctgccacactgtcgggctttaatgctgctggctggctctcctcccaccttccagaatggactgagagtcaccaaatgtagtgcaaggtcacagacttgtctccagggatgctaggtgatgacagagtgagggtgggaggctcccaagggtccagatctcccctgagaccctgctccttgtctccagtatctctgtcctcccctcctcagaaaccgggtcaccccacactgtcccctgggtcactactctgctccctctaggtcacctcaccttttgtatcttctctggtatttgagcaccaaccgtgggtctccttgcaaaggtgtcatctccgttcatggcacagggagtagtctgacctgcaagagaaacagattgagactttccagccgcaggacctttggtcttgtggagggagaaatcagtgaaggccggccactcagtcacctggaatcaggtgctgcatttctccatccggggcttatctgtccctgagtaaggatatggggagaaatcagacgaaaaccaggaaccaggggtctctgggagaagtattgataggggatgacaggtttcctatgggcaaagcagccttgagtctttgggagggggttggctaatgttgttagtaatttccctggag

SEQ ID NO: 7046 - DNA, 2273 bp, artificial
  synthetic oligonucleotide
atctgcttcccaatcatggtgacatttaacacttctgaggaaaaaaaaatgcctccaaactggcctttcaagtaagtggagtagttactctccccacaaagtatcagaaactgttctatgagccacttactcctttatgtcttgcacagtccctatcaaaagtcaaatactcctgggagacgtgacctctttagtcttcaagagtcaacactttgggaaaggcagaattatttcaaacagctgagcacaagaaaggcaactagcttgtgtaattgttcattttctgttttttcctactgaattgtaagctacaaggggtctaggaccatgtctatcttattcatccctctatttccaggtttcaggacacataggagaccctccacaacgcccttgggaaaaaagcagaagaggacaaacatgggaaaagaagggagggaagggggagataaaaagcctaattaaattctcacagagcgtttatcctaatattaactagttaatgacctcaagatatgtattgagcttttactatgcacgcatggcaggaggggcgtgccccttccttgccttaacctggtgtggttctttgactttttactcctgtatactcgaagaaaacaatacaaaaatcaaagctgggaaaaaagttcctgtatggggtatttcaccgttttaatgcattaaacatgatgtgctcaaatgccccagcctttgggattgaaacattcataatgagaactccgaagcgaccaagatgaaatacaaacttcaaagaaggcgcccagttttgtcttgctactctagcctagttcagtggcgcctcaaactttaatgtgcatgcgaatcacctggcaatcttgctgaatattcagatttggagtcaataggtctggagtgaagcctgagatgctgcgtttttaacatgcccccgggtgatgctgatgcttctaacccaaggaccacactttgagtatacaagggactggagaccatcacctctaccgccaggtgtgtgtatgctgagtcccagcgttccagatcagtgtcccgcacgtcctcggccttctgccagtaggggaggagtcgggggcggagcgggaggagtggcgcgggccccgcgtgggtcctgccagagatcacctcggccccttgaagaggcagccaagctgcggcggcgcaggagggggcgggttcagcgagggcgcggcctctgagggggggcgcaggacacgcatcccccgcgatcgcccgggccactcgggagcctcgcggcagcccggcgccccacttggccatccgctccttgcccgcctcctcttgtcacctcccgtctcatccttctcgctccttccccgccgcatacaccggcatccgagtgcctcagagagccggaggtggtgtgcggggctgcagggcacgacttcaagcggtcctcagctccgcactagggggcacgggcaacagcatggacaccaagcgctgcttcgccaatcgcttcgatgactaccagggcagcctgctggcgggccagtgtgaggaggcggtggcgcccttggtcaccgccaccatcgagcgcatcctccaggagcttcccccactcgggggcggcgcggaggcccgaggggcgacggcgggggctagcgcctgccagggggggctttatggcggcgtggccggagtggcgtatatgctctaccacgtctcgcagagcccgcttttcgccacggcccgggaacgctacctgcgctcggctaagcgcctcatcgacgcgtgcgcccgcgctgaggagtggggcgaaccggacgccgacacccgcgccgccttcctgctcgggggcgcgggcgtgtacgccgtggccacgctcgtataccacgccctgggccggtccgactacgtgcagccgctgggcaagttccgggctctgtgtgccgtctgcgcgccggtctccttcctggagtgcggctccgacgagctgttcgtgggccgcgcgggttacctgtgtgccgcgctggtgctcaagcagaaactcgcccaggaggtaagaggtagcccgggccgcgggagggcgctcgccgcctgcccggcctcctttccccggactccgtggctcgggcagcactgtcccgagttgctctccaagtctttgttactcttggtgtggtgctagcatttcttcagtcccttgaggtctatctcctgcttttgtccctcttctttcctgtcgttttcagtctctcatttgttgagattcggcgtctctgcgctttgtt

SEQ ID NO: 7047 - DNA, 2414 bp, artificial
  synthetic oligonucleotide
acatggcacagtgaaaagtgaaatcttttcccacttggtggtgggtgcatgacaatatacttgcactttgaaaagcctctgtgtggtctggttatttttaaaaggccagaaatgctggccctttgaagaatcacgcgtttcctcggcccagaaaatagactgggctagaaaggcgcccggactccaattctgggcccgggtggttgcagtttttcaaagggatgtgaacggtttcccaagataggacccaagggactctaggacccagaggctgcgcgcgacgcccgcagggcgaactgcatccttttgagctcccgctccatggcctgagccgtcgtagggcgcgggttcgcggcccgccaggggacggtcaccacagagacgcagccggcactggcgagcgagcgagcaggcggcgcacggagcgcgtgggcgtgtcccggcggggctgcgcagctcgccccaccccaccccaccccagccaggtcggccgcccccaccaggtccagttccagagcccaggccggtcggccgggcccgcgtgccctcggcgggctgcgcagagcgcgggagcggtttggggctgggcatgctgggagcccctcgggcaacggccgccgccgccacagccacacagccgccgccactgcgtccgtccccggtgagcgccgctgacgcgcggagatgaaattcccggcctcggtgctggcgtccgtgttcctgttcgtggccgagacaacggcggcgctcagcctgagcagcacctaccgctcgggcggggaccgcatgtggcaggcgctgacgttgcttttctcgctactgccttgcgcgctcgtgcagctcacgcttctcttcgtacaccgcgacctcagccgcgaccgcccgctcgtactgctgctgcacctgctgcaacttgggccccttttcaggtgcgtgcagaagcccagagccagccccaggccgcagcctcggtcctgtagcctgatctccccacctgctcgagtggagggaggcggttttcctgtggagacaggtggctgagccccaagccggtccgccatgcccctcagccccattattccagtcaggaacgcgacgaatcatggcataatggttataaagttggggcacactgaattcctgttaggttccgtcaaatgaaatagccaacattcaactgaaattgaccaacaaaaatggcagtttcttgtggttcaacctcattaaagacattggtttctctggggtcaagtaggctctgacaggattggcttgtgttgtcacaaacccttgggaagtgtgttctaagctgtggttacggggacagcatgtacaggtgatttaattttaatttatcaaacacatggagcttactgtgtgccaagcactgttctaaaagctttaacagtatttaattctcatagggaagtcaagaaatccatgcaccattcttttctcttggtggcgttacgaatattatgggatatggaaacatatggggttctagaaatgtcttccggccctggcaaacttataaacgtagccattaaagctggtgcacaatgcaccatgaaaacaaaacttgctgtgtgttaagtaaagaaaaactgttggtgacatttctggaaattaatttttattaacacaaagcaagtagaaatacatggtaataaaacagactggcttatctaaggagtttaaaatgtgttgttttagtacctttcatcactataggaaaagcaaaacaaaggccgtccatttggattagaaataagtttataatactgaattttagacataggcgacagaggaatttgaagagatggaaaggccagagagacacctcagctgccagaaaattcagctagccctaccaggaaatctctctctctctctctctctttctctctctctcttacacacacacacacacacacacacacacacacgcacacacacacattgaggagcaagataaattttacaaagttataatttttttttttttgagacaaggtcttgctttatcagccaggctggagtgcagtagcaagatcatagctcattgcatcctccacctcctgggcacaagtgatactcctgcctcagtctccagagtagctaggactgcaggcaagcgccatcatgcctggctaattttcttttttctttctttttttttgtattttttgtagagacagagtctccctatgttgcccaggctggtctcgagctcttgagttccagtgatcctcctgtctgggcctcctaaagttctctctatgttgcccagtatggtctggaactcctgagctgaaatgatcctcctgcccaggcctcccaaagtgctggaattacaggcatgagctaccacgcctggccataaaatttttgcacctcatattaaagaaaac

SEQ ID NO: 7048 - DNA, 1472 bp, artificial
  synthetic oligonucleotide
tttcatttttgggacctttagagtattcccagcattttgctattatacataatgctatgatttaaattgttgcaatacgttttcttctaagtgagatcatacgtgataacatgtcataactaaaagtgctatataaatattaattttcgtttattattattattattgtgcatatgtcccactatcccatttagattgtgagtgcccccaaatgaggcaggggtatccagctgtctgcattccccacagcacttagtaaaccacacccgcattcatctcatatttgagaataaagatgattatcagtttattctgtttttgttttgttttagtttgtttttttgagacagagtctcgctctgtcacccaggctggagtgcagtggcgcaatcttcgcctcttgtgttcaagcaattctcctgcctcagcctcccgagtaggtgagactacaagggtgcaccaccatgcctggctaattttttaatttttagtagagatgtggtttcaccatgttggccagactgatctcaaactcctgacctcaggtgatccgcctgcctcagcctcccaaagtgctgggattacaggcgtgagccactgcccccggccagttcattctgttttctaatctttgatgtgatcagtggtccaacagtgtaaagttgctaggcctcatacagtcctcagtcattaatttgagttttccttcagagaaaattcaattggacgtgcttgggattgaactcatggcctgaacttcattgacattatttccaactgaaaaaactggtctgtgtggttttacattgttttcatgtaatatattaaagtgttcttgaccccatgggacaaaatgtcgtacacaaatcaacccccccccacacacacacccacacacaccatacaccttctttctcctagcaacaaatgaacaatggtattaatcacaaaatatgtccactttgagctcaccagaaaggttcctgcatttcctctcttacatcaagctttattttattatttcaaattataaatacattccagttgccgtagtcacctcaggatgagagtataaagttaacattataacataaacattcaatgaaatagattaagccattaaaatcttctggcagcatcataaggttgttataaaagtgcatgttagaggagggacaaaaagtcctttaacaagttacaaacctacggccatgaatatttttcttactcctagggaaaacacatttttaaccagcattttattatgaaaattttcaaacacacagaagacaagtttaaggaattctatagtgaacacccaagtactcaccacctagattctacaattaacattttgtttcacatatttatccatctatcaattcgtgtgtgtgtgtgtgtgtgtgtgtgtatgtacttcaaagttaatcacagacatcagtattcttcccacttcagcatccatattttta

SEQ ID NO: 7049 - DNA, 1529 bp, artificial
  synthetic oligonucleotide
gattttgaaattctattttggagtggtgctgcaacaccacacccaccgccaccctagcagggaggagaatgattcccttttgtcatcttcccctaacaaggtgaccttcttaattggattggcagaattttctagaaaaatggtgcctggctgtagggctgcaggcctccaagaatcagaggtattgtgatcctctccactactacagatatctggcacacacttgtgcaattctttttcaaaccaatgggaatgctgttgtgagtgataggacaggactgattagaagtgtcactgtagtcaaagtaattttgtcatttttctcccagctcccaccatgaacaaatattaaaaattcaaccactgttatgtggagggtgaccttaaagtatgtcttttgtaattgaggttattgggatctattaccctgggaagtttttttttttctgctgaaatattttctcctatggacttatggtatagtcttttccttttaaaatgaggatagatcacccacacatcatgcggcttctctcatttacagcttgattcaagagatcaggaaatatgtttattttaaaagtgtactgtaaatgtcctaccttaaaaaagtacattatctaccttcacaggaagtatgtaatcaaggtgaaatgcttctatcgtttcaaattattactaaatgtatattactatcataatatccatcaaaataatatgatttctacagtcttcaattcacctcccagtttacttccttagccttattataaataatatcagggtgctttcagctacaatttgtagaacacctggttaaaagtggcttaaacaataggattttgttatctatattaacaagcagtttggaaagaggtgattctagattctggcaggcaaactatccttgggccccagaggctttccatctttcctgtcaccttcaacctgttcctccatcttcacgcttgtcttcacattattgaagcatagtaacctgacctccaggtatcacgtatacaaaactgaatctgagcttctccttcttgaaagatggagaaggtcccaagagttccggaaggaggcaaagtggtctttttcagccgccagggtcacacatttcctccagtaccgtgagttacagagaaaaagtcctaatccttctgcctgaatgttgaccttattttctaggtcttagaattctttggtattgctttacatttcatttcccacccctcaaactgaatttattgtgtactttctctggagaactggttccgaaggaaaaagaaaagcaagctttctattaagccctaaagagctaacagggtacagcaggacaatttatatccagacagagcgttggggtaataggagaaaacaaatattatgttcttggagccctggtatcatttgcatatttccaaaggaaaataaatttgatgctagaatgccatctctttaaaagcactcagttcaacatctaatactaattccacaatattaacaccagcaatgtccagtatggc

SEQ ID NO: 7050 - DNA, 1160 bp, artificial
  synthetic oligonucleotide
cagggagataacaactgacatcatgggtttctggtgagggttgggaaagcctgagtcagtaagcaagggctcgtaatccataaagcacctccttgcctaatcctggcaagcattaccgggagcgggaatggcagtgccaccaggaccccgagactccgagccatgggggctgcagcacccgcgctgaggaagccaagggacggaggcagcagcgggaagacccgttttcgaggcccgcccggtaggagggcggcgcccgtcaccccatgcccactcctcgcacccaagtcaggcctcgtcctcccaaccctgccccgaccccaccgtctgatccgcgcgctcctggccacccctcccaccccgaatctcaggactttggggtggggagaacgggtcgggcggggcggatcccgggcccaggggagaggacccgggctcggaggacgccgcaccccaactcttgggaccgccctcgctgggagaccacccggcaagagccccgcgcagaggaaggcgggagtggggggcgctcccaggtagccaaggggcggtacctcgtcgcagtggcgatggtactcctccatggtagcgccggctctccctggggcggagcgacacgccggtagagcaccgcggccgcgcactggcctccggggaggccccacccccgtttatggcctagggcctttccctacgcaatccccgcctttgtgtcgcagtggcgtcacctggcagcgctgggcgggcttcgggcaacgccaggcgtcacttcaggccacgcactttttcctcgcttcctctgccctttctggaaacaagggatgaatgtaaagaactgggaatggcgccagtgtggatcagatggggtgacctagtggcagttagtctagactccgcactagtggttgagtgcccactgctgtgattacttgcacgtatttgttcattcaccatcatgtggcacataaatgtagttaatttcgtggtaaaccagccactttgatttgtccacttactagctatgttacttggaaaaattcacctcccacagcttcagttttctcatatggaaacttaccatcatacctatttcactactggttgtaaggatctgatgagaagctgtatacacggctcctaaagtagatgcttctcaacaa

SEQ ID NO: 7051 - DNA, 1954 bp, artificial
  synthetic oligonucleotide
ggtgacagttcctgcaaggtagggtccgaggaaaggaaagacctatggaaaaggatacacctgggatcttgaggagccagctgcacctgtttctgggctgagaggcttccggagccaccacaaggtggagaccaaggatggcgggggtggggtctttgcagaccggttgttaagtcctggggctggctgtgcatcctgaagcccgtttggcacagcctgcaggagggactttgcaaagccgcgtccaggtagtatatgaaaggtgtgttgagctcaaatggtcagcccggggtcatggggtcctggggtggcggggagccgagaagagggagatccacgaaggaggctttcaccccttggcagcgggcggctgccttgaggggcgggctgtgcctggcgcgactctggcgccgccgcctgggggcatccggctgtgagccccgtggatggggcgcctggagaccgcgtctctcgaggcactaggtcctggtacttgctgggggtggggagggagaggggcgcacagcgccgagaggcggacgccaagcgcgtgagtcactctgctcccctgggttaggagcgggactttgcctcccgcctggggtctgcatttcagctccagcttcagtgactcatcccagcaggctgaccccctcctgaggctggaccagctgcctctccgtctaggtgagggccaggcaagtttctcgtcttctgatgcttactgtttgggggactcgcggggagggggtcttccagcctgtgtctgtctgcctttgcttcctccctctggctctctccattggagacagaaagttagatttaaaaaacgcaacagagaatataaaatctatgctcagaccccagataaacaaaactctggggccatattcttaatttaccgggtaccttcacatgtccgaatgcggcgtttatggagctaggaatgttttatttgtttcgtgtatttccctcctctcccccattttcctccggtgtaattcttagaggtggggacaggagagccagagggcttagctgggatcctttgccagagtggcttcttcattctctgcgaggtagcagatgttttactgtagcctgagttgggatcttggaacaaccctctccagcccaggacatgccagcgcttaaggtaactgcagttgttgcatatctatctcgttatcactgactgaatcgaaatgttccggaggcacaattaatgtgaatgccagaatgttgaaacaattcattgaaggacactattgaatgttttattttcaaagtatcgtattccaggaaaattttagaagactattgctggttttattttctctattttcagatatgctccaaagcctattattcccttgcaagacaaccagtgaggacctattctgtttcttataaggatttaacagtgcaaaactacgtgttagtttctcctctaaggttagggacctccttctgttaacctcttttagaaaaatcattttggtggtggtggcggggagatgtttcccctttctctatcattaaatgcaaaatgtttctgtgactattaagtaaatactaattattgttatttttgcttaaaaggagcagaggagagcatctcccagaatgcatgaatttgtggttcatattgataactgattgctttaccatcaaattgtttggtttgatgcaatgttaacaagtggtcttaattcacaacacagaagtattctattccagaaaacaaccctgctgatatgcctgccacccccaccccaaaatgcacacacaaaaccatgtttttgtcttgctttgtgggagagaaaaatggatggggtatcttttctggcagttgattagtccccgatctttcttgaattgtcatttgttttataacctataattatagaaaagaaccctccttgaaataaaattaataaaaccttacatgttt

SEQ ID NO: 7052 - DNA, 218 bp, artificial
  synthetic oligonucleotide
aaaccttttcatgtcttcaaaactgaaattgacttctgtctctccaaaaaccccatgatgagtcaagacagagttgaggagagagaataaaggaatatttaggaggaattatggtagcattccttttataaatcaattgaaaaggagaacaaataaacaattttcaaaggcttaatgataaaggtacccactgagggtgttggaatagcagtaatggc

SEQ ID NO: 7053 - DNA, 768 bp, artificial
  synthetic oligonucleotide
ctaatttcagaacactttcgctctgggcgggcatgtccacagaatccctggggtcttaatttcaaagccacagaccttgtaggagtcttgaatgaacttcaaatgatttgtgaactttttctaggatccacagctttcactatcttctctaaagtgataaaaatataagccaaaaatgtattaagaaactctagaccagaatggccttgaactttaaggtacaaatcactgggggaccttgttaaaatttagattcaaattcagtagctctggaatgcgctaggcctactatcattaattttaatgataggaatgctcactttaagttagatgttatgtgccctaaaattccattcttctctttagtagatctatgctatgaaataactgcactcaattattattgttatatttttaatgtcatcggtaaaatattggcagacatttattttcttgattgatgcatacttatccacaaaatagctatggttttggctcttggcgcaaaaagtctaaaatatttactaattgttccttaatagaaaaagtttgccaacctctaatatagaccatgggggaaagccacctttaaggagcagaaatgttgttcatcttactctccacagctccttgctacatgtggcagacatgacattatcaatcagacttataggaatcctaaccaagtatgaggggcagcaagctggctatatttatgtataactcctcctctagaggagaaatctgggcagatgagggtcaacttca

SEQ ID NO: 7054 - DNA, 5617 bp, artificial
  synthetic oligonucleotide
agggtaattagctgtatgatttgagtgattcgtggcatgaaaatttctcagaatgaggctccatcacctagcatggaacatgcgctacagggaacaaacaactattttcattttcattccctttctctagttggagtctggatgggcactgacatcacctagctccttagatcttccttgtctatgccttggttcactgtctccttttcttcaccctgtatttctccggaaggactgcgttatcatcaactgcattctatcttactaaatttatagtcatagttcagtgctgccttctggagaaaacatcctgattttcttgatagagttttgcctacttctgatctccttagccaactgttactggaaaggggtcccgatccagatcccaagagtgggttcctggatctcacacaagaaggaattgggggtgagtccatagagtaaagtgaaaacaagtttattaagaaagtaaaggaataaaagaatggctactccataggccgagcagccccaagggctgttggttgtccatttttatgcttatttcttgattatatgctaaacaaggggtggattattcatgcctcccctttttagatcatacagggtaactttctaatgttgccatggcatctgtaaactgtcatggcactggtgggagtgtagcaatgaggatgaccagaggtcactcttgtcaccatcttggttttgcagcttcttcactgcagttttatcaacaaggtctttatgacctgtaccttgtgctgacctcctgtctcatcctgtgacttagaatacttaaccctctgggaatgcagcccagtaggtttcagcctcattttacccagctcctatttaagatggcattgctctggttcaaacacctctgacattttccccttcccttttacaagagaatccttaatcctaagggttgcagaggaatgaagatccatcttttgtaacttcttcatgctgaacaggggtgatgatattcctgcctaactattagggtctcttgtattcagagtagagaggagctcagttggaaagtgtcattacagtgagggccattcataactcttgagttctgacaaaaggtgatatctggaagattagtaagtgttcaatttaagaaaattttcagtaaacttattttgcattattacacaaagagtacaactgcaatatattccacaacagtaaagcaaaataagcaaaattatcccaagtaaactaaattagaaggctttccatgaactgggcaactgttggaaacaagctgatatggagtcactagccaattccaatatgtgcccagaattataatattgaaccatatttttacattacacagcccttttgtttcttttgagatgcagtcagacatcacgaattggttaacaggaataagcagggtcagtctaaattgcaggaaaaaaacgacaacaacaacaaaaaacaactgataagactagaatttaataacagaagtaccatacttctagaaacacaatttttctctgtctagttttccatttgtattaaagacaaatcatggtaagaccaatttgattgcaaaataatccttagtcttatatttaggctgattatttgtataaagtgcagcaagaataattatttttcacataggctttttaaattggctttgatggaattctgtcccataagaaatctcaaataagaccttttttttaaagccaagcccagccatgggtttatatcctcaaatacctatgaattaattcttcttcttttttttttttttttgagatggagtttcactcttgttgcccaagctggagtgcaatggcaaaatctcggctcactgcaacctctgcctcccaggttcaagtgattctcctgcctcagcttcctgagtagctggaattataggtgcctgcccccatgccttgctaattttttgtatttttagtagagatgggggtttcactatgttcgccaggctggtttcaaactcctgaccttgtgatctgcccacctcagcctcccaaagtgttgggattacaggcatgagccactgcgcccagccaattcttctcctcttgaggtcccaagataaccttcagctcctggacctattagaaagtgatattctttacttaccacaagtcagaaaccctgtacagggaatgtgtagacaagatataaggtcagttttcccaaggggcttttattggctctacaaatcaagtttgattccttaaaggaaaatgcatcattccagtcaaagccttggtaaaataatcagtttctccaattgtgtcctgttgcaaaagaaaacagattcttattgtgcttatgcaaataactatattgccataagttaagaatactcacaaataggttccaattctggagaagtcaggtagagagaaacaaatatgcctcaaattttgttcacaagagtacactttactcaactgttaaaagctataaatagctcaaaagaagagttttcttgtctctgaaaaacaaaacaaaggatcagcaacgttttaagcaaaaagtcaaaaagatcactttggtcttctattagctcaatccatgcagttaactcctgtcctgcttgatatttattaacatttcagcttttcatgagagtcctgaaagtttttttctttattctaatgtcataatccccaatgttatcagaaacctgcattcaagaacacctgttaaagtcctttagctgactataaaccaccttttaaataggattaaaataagacaacaactgttggtggatgacaaaatgtcttagggcagtcacagtcaaaagatatgattgacaaagcaatttgattacctcggtggcaatgttgacaatgtttcctgtatgatttttataccaaataagccaaacgtcatttttatattagtgtactactaatgttaaaccctatccttaataaaactttatagatacatctaaccaattttaatatttgaccataaggtaagattcttataccttttataactctttacaaatttatgttaaaaagtagattagtgctctaagaaaaacctgttgtgcttatattccaatgttcaattcatggaagaactgaataatacccctttaactttagccaatatgttcacacacagaatttcttttaaaagattagtttgtcacaagactttcccaactcactcaaaccttcaagcatatcctatctaacttcaaacaatcctttaaacttttaggcaaaaaaaagtccacattcctatgacttcttataatattttaccaaaaacgcatttcagtttctttacacaccttgcatgtaaaactgtttcttcagttgtctcaataacatattacaatgttagcttttagcaatttttacttttggtgaaaaacctggttagtaagcgattttaattatgtaccaggtgtggcacctaagacaacagataagatttgactttttccagcatagctagggggcatggctaacatcacatgtccccaggtcttatctagaatctaatgctctaaagtaggtaaattgaacaattttcaaaagtcaaacaagcagtttatgaccttaaagcatttagaaagcttaatatctgacctgtaaaatttagaccaaatgtctttattttatcaataatctttaaaactgtttttactttccaaagattacttaagtcgtgtactaaaaggcattacactttttacttttctgacaaaatatttgatttaagctcttatttttaaactaattaaagtttttaaaaatatctcacacacacacacaacacatataaatacacatacagaagaagattcagtagttgtaagacttttcatttgccagtttctaagtttgtctttaaggcatgcagtttctagggcttaacttgcaggcacagctggaaggcaaaacagatatacaaaattaaggatcccatttttatgccagatcctggatcccaaaaagagggaatcagcccatctccataggagtcttatctctcagcggtgggtggggacttttttttaaccttctaggttgccaacagcatacttctctgatctaaacatgcaaaaagccacatattcccccaataactgccattagccttccccaaaagtatatttcctacctagttattacacaacaaagttctctcataatactaagcaatttctgaccccccaaaagtgaaaaacgttggataatgcaatgcaaaacagaatagaaccttagatttttaaaggaatctatccatttccaattcctggagtttcatgaggaaaacaagtttttcccagaacccagtctgtggtgcctcctctgtttttcccaaggagtctcatgctgttagagcttgaatatccgctttaaataagctaaattttaaccatagcgctctttttaaaaagtccttttaaatctcttattaccgaaccaggccaaatggccaatattcctgtcttctgaactttaccaaaggtaatctcccaggtgctcaaagaaaggaaaaattccagaagggaagccggaagttgttcatcatgggtggggaagagaatctacaaatggcaaaagtcacacagatatcaaactagaaaagactcattccctaatcctggaattgaagctgggccaccgttgtaaaatggtgaagcctttgatgctgagctacagcattgggcagtttccattgcccttcccagaaggagcttagagcagccaattttgaacttgcaaaggcttttaacttctcaaggtaatttttagggctaaccatgaattccaaagttcctgctctccggaaggtggagaccaagagaaagtactgccacatagttataaggtcaagctctcaaggaaataaaataagatgagagggaaactttatccagttttttgtttttgttttttttagggacctgcagcaaagtttgtaactgaccagtttgctgggctggcttgaacagcgggcttacaggagtcctaagcctgtgttctatcttaaggtacccttctccattatagaacaacacagaaagacaaatttataacacaaagtacagattttactacagcttaagactagcctcacaattcctttttctgattaatcaaaacttgatagagttttggctacttctgatctccttagccacccatttacacaccagttacgataatattagtctgttggtccaggtacagatgaataaaaattcatttaggactaattttcttaattaaactctcacagggcaattttatttctcttatattctcacttgatctctcgtcttctctgtcaccttcatgtgctacccatggtgttacttccctcccttcatcctcctcacagggcagactcttggatttttagagagaagatttgtatttatagcccaaggcagggatagctataagcttcaggtcaagcatttttatagctaccaaccccttgaataatttctgaatatgattctataaaacattcacaaagtaaagtctaagtctgacatttcaaacacaaaatatgtcttcaatgaaccctgggtgtaatgataacatagtcattcactgag

SEQ ID NO: 7055 - DNA, 1143 bp, artificial
  synthetic oligonucleotide
gatgctaaatggcttgaaatgcatagtcttactgaatgaatactggcaccaaatgaaaataacactttaccttgacagtgccttttggtgcattcaaattacaatttagttaattaaagatggagtaaaccttgtgattgggagcatgtttctcgtatatggtgtagtaaaagcggaagaaacatctttcagcctgtttctaggcttatctcatctttcatccagaggagacaagtgcccttgtatttaagtctggcacatatggcgagaaggcttggaactgattccagtggtacttctgggtgtggcactagcaaggaaaggcttttccacataggtcacacagatccgatactacagagagatggtgtggagtacagttagaattaggcaatcagccatggcctcttcttccactcaaaccccagtaccttccagaatgtaggcagttcctcaagtcacaatatatttgcacagatgcccaccctcccaggaagtgtggcttatatgcccagaaattaggacatcatttctacaacctcatgctagaactcagtctccagggatttggagatcttaggagaccatgttcccctgctctaaaaatatcaacagaaggctgatgcagtcatccctaggaaggttatctcagtaaacctcccacagatgagttcaggatctttgtcttcagttaactctagaacactcaacaaattagaactaactgtgtgacagaaaaacttgggatgggaatggcattgccaattattatagacttccttgccctgagctaatctgggaaagtgaaagcagaatataaatttgctctcatttctggccattttgtatgtaaatttctcttctgattgtttgttaatgaggagctgaagaagtacagagccaagagcaaacccgccaggatgcagaaaagtcagacacttcacctgttgctgggaagaaggccagccatgatgggcccaagagaaaggggtaagacatggtctttctgagggaatttttgatctttattccagacacctctgaaatgaagactccttaatttttcaagtttgatgtcacttcaatgacccagaggaggtcagagactcaaacaaagtaacactttcttatcattctcctcag

SEQ ID NO: 7056 - DNA, 1432 bp, artificial
  synthetic oligonucleotide
aggaggaatagtgatgctccctttacaatccacgatgtgaacaccccctgctcctcccaaagcaagtgcctcctaagggctgtggcattttcttacccacacaggaggctggccggccgctccaggccttgttgtccatacatgtgacggtccgctcccctttcaacgtgtatcctggtgaacaataatactcacaccgggagttaaagtaggcaccatctacacacttaaaccctccatttgctggcatggcaagggtaggacatcgcttttctgaaaatgagaaaatcagatattcagcatttcttagtttttgtctatagagtttcatttcagagtctagaaactctgaaagcatgaggtgaaaagttaatttaaatataagaaggccaggcgcagtggctcactcctgtaatcccagcactttgggaggtcgaggcaggtggatcacctgacttcgggagttcgagaccagcctgaccaacatggagaaaccccatctctactaaaagtacaaaattagccaggcgtggtggcgcatgcctgtaatcccagctactcgggaggctacggcaggaggatcgcttgaacccaggaggcagaggttgcggcgagctgagattgcgccattgcgctccagcctgggcaacaagaacacgactttgtataaataaataaaacaaatggaatttaagaaacaatggatggttttatgtcacacagaagacacaaagtttcctgtcacactggcttgggttggcaacccagctaagccactatcttaggttgagctccccagaagcagattctgagatacggatttatgtgcatgaggtttagtaagaaagtgctcccagggagactagtgagggggtgaggaaagcagaacagggaaggggagaaatccaggcaagatgagatctcaggcaaagtcagcagcagcctgatcccatagggaagctctggagtgtgaatgacagctcattctgtcctgcccccaggcaaggaagctgggctttcataattctttatcagtcagtcattgggcagctacaggctgctcacaggagatgctttctcttgtgaaaagagaacgagagtgagagagtgagagagagagagagcgagtgggatcagtcctctgaaggagcagtcttctgaataaggttgaagttccaagtctttaagagcaaagtactcagaagctgggtactggatacatacaactagtaaaaggcatcgaggagatctgggtagagcagattgtccactacagtcacccagttgcagagtctgcatagtctcgatgacatggctgcagccttgaaacctcagtttccctgacaatgaagttaacataatggcacccatattgatagtgttactgtaaaaatcaaatgtatgtgaaattcttggcaaaccataagcgctc

SEQ ID NO: 7057 - DNA, 1320 bp, artificial
  synthetic oligonucleotide
ttatgacataactattaatcagtctacatatggttcagattaccactctggaaagaatgcttcagtgcttcttccacacaaatacaaattgtacgttggctcagaaatcagaaactcagagccatgtaggattctgtctctcagccatacctggagccaactgcatttataattttgctctccttgcaaaaactttctctaattcaacagattttcaaagaaatagccactctttttttttccaaagttcaaattagggtcttcctggcctatggaaccccacccattcattctgaatgtccaggtagataagatcatcgaggcaccaaagtcactcttaaataatacttattatatgtattgaaattacatcaggagactagatttctgaaggctagtagagtgttcctgctatcacgccataaggtttctcaccgtaaggtagggatgtggtagagatttaagactaatggaaaacttggcaaatttgctaaaactacatagttctttattgattatgatacctgacccaaattggtagatttgctggctctgtattatatttttagctcaaagtgttgggtttattttttagtcattttgaagacagttcttcattctttacattttgtttctcccttcatcattattctagacataattttaatattgtcagaaagaagcatatttaatagtaaattgcaccatcaattttatactgaaagtcaatgggaaaataaaatttactttgcagtagggattcttaacctgaggatcatggcctactacagaattaatgaaagggctttggagggcccatgaaccccttgtaattgaacatgttttttggtacatgcttttgatacatgccttttggtactagcatgctttttctaggggaaaaagatgttagctttcagtagattttaataaattttaaaagccatggtcttacagcattctttattgttaagcatgttagaatatttactgaagaagcatgtagtgtccttctttttgatatttaactcattttagtgttggggagagagaagcaaatatgtttttaaaaaggataaatgcttatcatactggtttcttctagattagtgctgtccaatgcaactttctgcaatgatggaaatattctttatctgtactgtcaaatacggcagccactagtcctatgtggttattaagcatttaaaatgtggctagtaaaacaagagaagtgaatgtttttatttcatttaattttagttaatttaaatttacatttaaatagccacatgtggttaatagctaccatactggatagca

SEQ ID NO: 7058 - DNA, 1536 bp, artificial
  synthetic oligonucleotide
caaaaatagcaaatcaggccaaagtaacctcatttctttggtttacccaagagaatgcctcctctagtaaatctagtttacataaaggtccattcagagaaatactgatttatgaattgtattcacagaaagcaattacttttcacttttttgaatacaatccacagaaaatgtttcatcttgtgactcagtacacacatacatttatatgatcgaaaaataagtttcatggaacaatatttaagtatgatgccctctcatatttgctattctattacatttgagtgtttaaaaagtgctaatcatgaccactacaagaatttcacaacccattaacaggtaacctcctctcaggagatatgctatagggctctgtgtcattctaccagtgaaggaagaattaagaagaacaaatctgtagaagataaccaagctggggaggacaagctcttagttttctttctcccaaagcagagtctgaaacaaggacttgggtgctgttgttcatttggaaggtgatcccaggaagcacagtgagaaagcaggggaaatgagaaaggaataggggaaaagcccataaagatatgctaatgagcaggttacttctgggggcaacctggattcattcccactgaggagcctctgaggaaacacaacccagggacacgaaaggttgggtatttacccacagactcctgccttttttttggctaagagctggcggggtgttacatctcctactcttccagaaattcttgctgagcgagctcccacaggactggagtaaatctaaaggcaaagcctctaagacatgtggacatctaaggtgagaaactgtcagcatgtttgagaactgtctacctcagctgcagatgaatccagagatgggcggaggggagatggcacagggcatcaacaatgttggctacagatgggcaaaaccaacagatgatgaaaccataggccatagctagtttgaaacctacaaggagaaattaaatagagattataaacatgaagtcttgtatttctctccctacactaagctgtacacccagcaagggggagagcttccctggcaggcttgggaaagagcagccagctagttgcccacattgtgagccagcaggtgaaatagtttcttaaaaaagagagagcaacagtggcctgcaagaggacagaggctaaaccaaagaagtctggcttatcctagactgaagcaaccacactggaataacagaccatttgggccaattctttttttttcctttcttttttttggacatgttataattgtacatatttatggaatacagagtgatattttgatatatgcatacaatgcataatgattaaattggggtaatttacatatctatcacctcaaatatttatcacttggggccacactttgagaaggacacagacatgccagaagatgctagaaagaaaaaacaaaaaatgaccaacagagactagctttcatagcaaataaataagtaaacaaataaataaaaagtttgttgaatggtgaat

SEQ ID NO: 7059 - DNA, 556 bp, artificial
  synthetic oligonucleotide
ataacttctaataagttcttaatttttgaacaaacttatctgacatgcctaatcaattagtgttaataatatgaaaatattaacaaaattaaaactttagggggttttgtagttcaaatattggcagacatgaaatatttaaatgattccgtagccaagagaagctgtgcagacactggaatatttatagtgtaagacagtaagaatcgtggtatttgtgtttccataacactgaggaaccatttccaccttggatccaatctagaaattatttttttcctgccaaagcctaacttggataaaatcctctccttcacaaatgtgaagcagaagccataggaggagaaaactgagtttccatagaacagaggacagagacacagcacagagaataagattttatttccagagttgtacaataaaagcaatgggatttttgtagaatgttggaggagatgaactagcctagtaatatagttgctacatctcaaaactttaaagtaatttttgagcagttactcatgtagacagttttctatacattttcagaaagacc

SEQ ID NO: 7060 - DNA, 496 bp, artificial
  synthetic oligonucleotide
gccaactactcacccttagtgtactatcatgtgaacaagaaataaacatttatcatgtttaataactcataattggagtgtctttgttatagcagttaaactcccaggctaatacagccagtgactttcagagaatataacctggaaatttctgctaattattactagaagcttatttgtgacaaataacattctgaaggtgtatagtaatttgtaagttcagatcagttattctcaattcttagtgttgtgtcagaattacctaggaagctattttaaaagatacatatcccaaaagactagccttgacctagcgaatcagaagtagataagacataggcagttatatttgaaaaacttccttgtgttttacatatacccttggctaggaaccactactctaagataacccaaattttatctttagatgaagccagattatctgacctcattgttttggggccatataatttattttcctggattgggttgtttt

SEQ ID NO: 7061 - DNA, 735 bp, artificial
  synthetic oligonucleotide
atctttactgagtcctatattattagcagcacatagttttgaggctgagaagtgggctcaaaggaacatttccctgcatgaaggagataccacagagtggaagaaggtatccacttagtggtctctgagggtcccttctctctaacacgtagaaagagaaggaaaggagtcattcctgaaaacgcctccaggtggcaaaaacataacaactgactcggcctgaatgcagctctgtcagactgaataggaagaatgttttaaaataagtttttgcttgtgggatttttccttttggcctgagtagaattaagagccttcaaaatgatataatttcaaaaagattcctgttttctgacaaagaataatactatggtctaacttctgacatcatcggcctattgtgaggttctaaatctttggatcatttacatttattctaaattgaattaaaataataaaaagttcacaactttatactttggaatagtaaacatggaattccatttttctcagccattaattcctttacttaagttagatacattcatttcacatataatttattttgtaataaaatatacccagttctataaatatataacagaaattctaatccatacctgttatcaaagctgtgtgattttctccacaagaaatataacttattgtttgatccctaatattctcaatgactttgggttctgaagtttcaaaaagaaaagtgccaagacccag

SEQ ID NO: 7062 - DNA, 2884 bp, artificial
  synthetic oligonucleotide
gactctgagggtaccgaatgacttagccaaattcaccaggagtgagtgactgagccagaggtcacatttgatcttcaaacatcattctcatcattctttcctttatatcacattgattccctcttcaatgcttggatttcactagggaagcacactggcaatttcaaagaaatatttcaagtttatacagatacttaaaagctcaaaatgtcagagaactaacattctttatatccccaatagcaacatttggctatttggaattttattctcagtaataggataaatgtgaaatcctagcatctcattaacttcttcgtctcccttctttcaacatccaatcaattttcatgataggcgaattctaatttctaaatcgctcttgcatccatctcctgttttctatttccacagccctaatatgtattcaggcctcatatttgtcacacaataacctctttgtctctttgcctctattttcttcacattgtacttctcacacaatggccccaggttaatggtttcaaaacccaatgcaaataatgacatatgtcttcttgtctgccccagctccaaaactttaataatcttcctttgactaccgattaaattctcaactctataatctggctttcaaggccctcagcaatctggcttcaatatttctttccaaaccttgagaaaatcctcctttctgggtgggagtagtagacagtggtatactggagccagctcacagtagcttgcaggaactttttttttctttttttttttttgagatggagtcttgctcagtcgctcaggatggagtgcagtggcgcaatctcggctcactgcaagctccgcctcctgggttcacgccattctcctgcctcagcctcccaagtagctgggactacaggcacccgccaccacacccagctaatttttttgtatttttagtagagatggggtttcaccatgttagccaggatggtctcgatctcctaagaactatttttatacctctcttcatctctgtgttcagtgatgtcacattagtagcttgaaattggctgtgatgggaatatttacaccttacaagtcagactgctacaattcagagcttttgttttgaagagctagttattaaacatttaccagcataccactatttacagaataactgggactaaacttgagagtgagggtgcaatatggtattggggaccaagttgttgacacagaaagctcaggtaccaactcaaagataggagggccagggggaaaagaagaagaagctgtgttgcaaaactgttgagaaggtagatctgggcaaaagttgagtttccatagaagcagacatcgagaaaggggtttgggttcaagtagttgatttgggaggtagtcccaggaagcactggcagggtagtgagggaaatgagacagggaagggaaggtggctaatacagggtagattgatgagcaggttattactgtgggcaattgaggttcaattccactggggaccttttggggagcatgtagaatgtgcttcatagttgccactgctatggtttgaatgtcaactgaaaagcttatgttgaaatttaagtggcattgtgatggtagtaagaggtgggactgttaagagatgtttagaacatgaaggctctgtcctcatgaatagattaatgtggttatcacaggagtgggtttgttatcaagagaataggttgttataaaagcaagttcaatcctctctgtctctcactctcaccctctcttgccctttaccttctgccatggaatggcaatgcacaaaggtcctctgcagatgccggaaccattctgttggacttcccagctccagaactgtaagccaaatcaacttttctttataaattacccagtctgtggtattctgttacagcaacacaaaatggacaaagccacccacacaaagagtgaggaatatgagaagtttatcctcaagaagacagcagtgggtatttgcattaagaagtggcaggtatgtaggggaagaccgaatgccaaggggatataaacaagacacagatactcgtagttttttgttttcatagcgtgcttggtggtggtggggcttcatttcaatggccaatgatggaatgtatttttccagttatatatcatttgtttttaccctacacactctatttgttccttcctttaggtctactcacaggttcctttttttgctacaatatcctttgtagctccctccagttttgactattttctgattcttgcaattcatcaaaaatcagtgccacctttttcaggaaccccatctaatccccaccccctgatgatagaagttaggagagggtcacgtcaagctggaggtctcctgtggcttgaagcaagggagcaggtaacaagcccctccacctggttaagatgtttggggtcagagagcagagacagaaattgtattctggagtcattccaaatggtgaatattggaaggaactcatcattcctgttttatcactctgtctctcagaacccacacagcacagaggattggcttatgatggctgcacaattgttgatggtggcagagaaaaatggatgaatgaaaggctaggtgaacaaagagaactagataggtagtgaaacaagaaagttaaaattgaattagaggaatcatggggtcaacaagagcccctggatgaattctgaggatgaacatcaaagcctgtaaagtaaaacagactccacatgtgacataatcagcagaagctgggtagttgaaatctacccctcaacaagttcattgagatgccctgccttttgagattcagtgaaattgcttttaacttcatcccacttgtgatgcagctccccttttccaatccct

SEQ ID NO: 7063 - DNA, 2343 bp, artificial
  synthetic oligonucleotide
tcgttctttgagtttggccatagggatatatgtgtttttaggtatagaacatttccaaatttcatggcaaaacttatcttaaaaattaatggttcctttcagataaagccactagtttcatcttcatcactgtcattctaggaaatattaaccatatgtctactttacaatatcccaaatgtcacctgctctggaaaatagtactgacatgtctaacttagctccaccatttttttagcttttagtgacttaactggtctcaattactgtatcagccaggatcttacttgcaaacgggagtccactctaggtagataaatggaaagtaatgtattaagagacattaagcggctcccagaatcttttgggaaaggaagtgcagtgaataattcttggacaccatatagccagggacaacacaggcagaaaaattgcccaatgacactgtggttcttttgtagccagaacaccactgacacagcctggtacctgaggctcttgaaaccagatgtcagatactccattatagccaccacagctgaaatagatttctctacctgcatatgtagcagaagatccaatctctccgaagacggcttccactgcatgttgtttgcttctgcacccaagtctggagtagatgcagctgagtgggatgcctgtaccctagctgcaagggagtttgggaaaggcagtttttagctttcagcctctggagtagagaaaagcaagctggaaaggactagcttctaattatttatctaatctataaattggaataggtttattgtgaacattaaagtaatatgtgtaaagcttttagtatagtacataacacataacacatggtaaatattgttatcataattattaccctcattatcatcatcttcactattgatctgatacagaccctataaaataagcaggggttcaagctcaactatggctgcttggcagccaaccgtgactcccttttcaatagaagtttgtatattaggcctaaatttgtcatatctaataacagggatgattttttttcactgcatctttccagcttgccacctcaggacactaactttggccaaaatgtcaattgccttgttatctaggccagtacttctgaagccttaatgtgcatttaaattacctagggggtcttgttaaggtgcagatttgaattctgtaggtctaagatggagcttgagatttggcacatctattttttttttttgtttttttttgagatagagtctcgctctgttgcccaggctggagtgcagtggtgtgatctcggctcactgcaacctctgcctcccgggttcaagcaattttgctacctcagcctcacaagtagctgggattacaggcaggtgacaccatgcatagctaatttttgtatttttagtggcgggtaggggggtttcatcatgttgcccaggctggtctcgaactcctgacctcaaatgatccacccacctcagcctcgaaaagcactgggattacaggcgtgagccaccgtgccaggccggcacttctaataaggacccagttattgcaggtgccaccatcctgcagaccacattttgagtagcaaagatctagatgacaaagaaaatgtgagctctccaaccacatacctcaggaagagacacagcaaaacattttccttgagctctgtttttcatcagaagacaattgaagttacaaagatatatcaagtaaatccatcaaagtagatcctttgtagaaattcagtagggaaaactaaaaggaaactttccaaaacatcaattatggagatgctctgaacttcttatcttttaaagagcttattaaacaacgtctttaaaaccaatttacttgaaaaattaaatacgtaatgtattcacatggttgaaatatttatggtgaaatcttacatccacccatttttccatccatctagatcttaccgccatctccccattccccatacccctgagttacccactattattagaggaaaatattttaaagaaaccaagagacagaatcgtgttaaaatgaaagtagagagtctaaagtagaaagaatgctcacctgggagtgatgagacttgacttctgtaactggccttaatactagtcagctgtgccatcttagcgtctaagtattaactctctaggtcccagtgtcctctcccatgaaataagcagattgagccatagagatggcaaatgagttttaattcttagatccctaatctcatcaacaggctacaggaattctgttgagaaggattttgagcctgcctatggtgtgagacagaaagagtggcataactgattagcgtgccttaca

SEQ ID NO: 7064 - DNA, 3310 bp, artificial
  synthetic oligonucleotide
gattggcaaccccagtagctgttcagttggtctgctccttgccctagcttcctgaggctgtgttggcatactttagtgcaagagtgtccaatcttttggcttctctgggccacattggaagaattatcttgggccacacataaaatacactaatactaatggtaactgaggagctaacaataaaaaattgcaaaaaaatctcataatgttttaagaaagtttacgaatttgtgttgggctgcattcaaagctgtcctgggccgcatgcagcccatgggccacgggttggacaagcacaagcttgttttcgtggttctccaacttaagtgtgcatcagaatcccctggagggcttgataatacacagattactgggccccacctgcaaagtatctgatttagcagatttgaagtgaggcctaagaatctgtactttaacaagttcttggggatgctgatgctgctggtccagggaccacactgagatcactggtctgagacaattctgaaggcttatatgaagggttttcacccccatatctgtaaaataccactataaagtatgtgacacaacccagattgtctgactattgctctttctttggagtcactgaggcctgagtttcatccttcctctactgtgtaacagttatccaaccctgctcttctgatctgtaaaatgagagtaatgctcatctcatggagttgttgggagaattaaatgcagtgacatatataatagtatttggcttagagcaaatgctcaacaaatattagcccccttttattttttcaattgtttttaacactattttttctttagccctttgtaaaaatttatatcccatcatcagaaagatattgagtggaatatttggtataaaaaaagtacaaggaatgagcttgtcttctgaaattggcagagcccagcagctgacactttatttagtcatttctgtctaggagctggtttgtaaatatgcaactcaggggagtgacttggctcattgccaaatggaatcatggaggccaacaagtctgaaaatccaatcaaggtgactaaattctgcttagaaaggcatcacaggaatatatatttatgtgaaataaatcaggggcatttagtaattgctggacttgaggtctagctggcaaaagaggaaaaagattaggaaggactcatcaaggtttattatccatctttgtctgagaatagcactgctcaaaagaggaagttttcacactgttcttaaggcagcagttctcaaaagttttggactcagaaactctttatgctcttataaattatgaagatcttaaaaagcttttatttatgtgggatatatcggtataagccacactagaaagtaaaacagaaattttagaaatatttatttattgattcatttattataacaataataaacatattacaggttaacataaggaacatattttatgagaaataactacattttccacaacaaaattaagttaatcaatggagtggccaaccttgttttatatctcaccttacattatatgtttttggaaaaaatgactattttaatagtctttgcagctaattgtggatatcttttgttgttacactaaaactccacaactgattataactccttaaagattagttgcaatgtggaatctgaaaccatataaattaacttttctacaccgttacattcaatttcatgtctatcttgccctttgaatggaccttttactcacacatgattccacattgatcatttggaaaatattagttcactgagttatacagatcttccaaatattggcacatttcattatataaaatcagaaaatcatatttgttaatagcactgctgatctcattagaaaaatctttaagcattgagaagtagatacacattttacacaattctagttttctcttgaatgctcaaattttgtctttgacaagaaataatgccaactgctttccttaaagtgacagctacactttgttcattttcaagatgtctgccaaatatccaagtttcaatgaccattttgtcagttgcttttttcccaagtaaaactggtgtcccatgtaaaaggtggctagttaaagcacaattcaaagaattgcaaaagtgcttttcttcaagacaaccatcatacttcattatgccacagaaggacttaatgctcacctcccatttcatcacacagaatattaaaaagatgtgtcctcatgaaattcaatattaacaatttttactgtttcatcaaatacttttttttttttttgagacagagtctcgctctgtcacccaggctggagtgcagtggtgtgatctcagctcactgcagcctctgcctcccaggttcaagtgattctcatgccacagcctcccgagtagctgggattacaggcacccgccaccatgcccagctaatttttgtatttttagtagagacgaggtttcaccatgttggccagactggtcccgaactcctggcctcaagtgactggactgatttggcctcccaaagtgctgggattacaggcgtgagccactgcccctggccattgaagacattcttaagtgaacttggcttttttgttaagtgcctctgtgcgatagtgaagaacacaatgatttttggttctactgctttgatttgtgctaaggtgtcagcaatttttctcaccatttcttttgcatcatctgctgatgctgctgttccagggaacaccctttgtaaagcatggccctatactgccttcagagatctaagagaggccaagaaggcagaactctggcttccatttttggaacaaccatttttgattaaacaagaacaaacgtttttgattaaacaagaacaactgaccccattctgattttttttttttttttgagacggagtcttgctccgtctcccagacaggagtgcagtggtgtgattttggctcactacaatgtctgcctccctggttcaagtgattctcctgcctcagcctcctgagtagctgggattacaggtgcctgccgccacgcctggctaatttttgcatttttagtagagacagggttttgccatgttggccagactggtctcgaactcctgacctcaagtaatccacctgcttcagtctcccaaagtgctgggattacaagcgtgagccaccaggcccagctctcattctggttttatctgtaatatttattagcattccctcaaaaagattctggtagaaaataaaaagtttatgatttactattataaaacaagtcttgactgtactatgaatacaatttacattg

SEQ ID NO: 7065 - DNA, 727 bp, artificial
  synthetic oligonucleotide
cacagacatttcatttagccagaagaataaagctaatcaataaatgtaattaattaagactatacattcacaaatgtcttaagtccaattaacatttaattatccttgttaatgggaaatggactgagtttgtgtgtgcaagatccacacacaagctaaaaacttaattacagcaagtggtttctaacttctgtctcatttaactttggctggaggtactaaaaagtacccatagtggttaaaaaattttttaaggcaatgtatataggttgcatttcctatctcttctacaagagaaaggtggtgaagtaaaataagaatattgagaacatgcatcttttaaacacacaaaaaataactttccaaaaaatgactgctagaatttgatatgatggtgacacatagttttaaaagtgacttaaaagtcttccaatgggcaaatactaaaacatcaacaacagtatagcttacctttgggcaactattgagatcaagaagacaggcaagccatgtacctaagcatggcaacaactggtcccaagttgcctggacagttatagttaatttttgttctggcataattgttaatagctccttctttaactctcagaagtgtcctgatttggatgataaattatatggtcatcctggctataaggaaacagcactgaaccatgactaagatgaaaaaaatattactttttcccatttttccttcctcaaaatt

SEQ ID NO: 7066 - DNA, 249 bp, artificial
  synthetic oligonucleotide
aagaggtgggttggacagatacagcttgagctggaaacaacatccagccttgaaatttgaagtggcaaatttgcaatgccactctctctttccctgcttgaagcccccgattgtactttctggtcatactgaaatctggttggaaaaggaaatcacctgacaggagattttgcttttccttactatagcatgatccaatttttaaaaatgtatgtgtgtgtgtataagtgtatatatatatatatatat

SEQ ID NO: 7067 - DNA, 2460 bp, artificial
  synthetic oligonucleotide
ctgtcttgactgcttgacactttctgaaggccttgaatggcaaacccacccaccattctgatgttccatgcacaacccagccttgtgtcacctccactcttgactccaatctagctttgccctaccgctgtagacagagctggggccaggtcaagaactcttcaagtctgccgttccctgtcaggtcttgaaataaaatgtatcttagaggcataagcaacaaaattcaagtgacatgacttgcctttgataactagcgctgcagttcctagttcccattacccagcataatcactcagataagccacagcccaaattttaccaggtgttctggccactctggtgcactgtccagatccctcttcaatgaggttcttgttgtctccggtgctaggagcactgatggcagacagcccttagctctaagcttcttcagggattgcctcagctgaagtgaaccactgtgaccaagaggtagtttccttgataaccttctggggttgtccatatccaatgacctaccaatgcaggaatagaaattcccagccaccttgctgctgggataattggcaagccacatgtaggagaatgaaactggatcctcgtctctcaccttatacaaaaatcaactcaagatagatcaaggacttagatctgagacctgaaactataaaaattctggaagataacattataaaaacccttctagacattggtttaggcaagtatttcatgaccaagaacccaaaagcaaatgcaataaaaacaaagataaatagctgggacttaattaaactaaagagctttttcatggcaaaagaaaaagtcagcaaagtaaacagagaatgcacagagcggtagaaaatcttcaccatctatacatctgacaaaggactaatatctagaatctacaatgaactcaaacaaattagcaagaataaaacaaaaaatcccatcaaaaagtgggctaaggacatgaatagagagttctccacagaagatatacacatggtcaacaaacatgaaaaaatgctcaacatcactaataatcagggaaatgcaaatcaaaatcaccatgcaataccaccttactcctgcaagaatggccataatcaaaaaatcaaaaaatattagatgttgatgtggatgtggtgaaaagggaagacttctacactgctggtgggaatgtaaactagtacaatcactatggaaaacagtgtggagattccttaactaaaaatagaactaccattcgatccagtgatcccactattgggtatctacccaggggaaaattagtcattttcggaaaaagacacttgcacacgcatgtttacagcagcacaatttgcaattgcaaaaatgtggaaccagcccaaatgcccatcaatcaacgagtggataaagaaaattatatatatatatatatatatatatatatatatatatatatatatgatggaatactactcagccatgaaatggaatgaattaatggcattttcagcaacctggatgggattggagactattattctaagtgaagtaactgaggaatggaaaaccaaacattgcatgttctcactcataagtgggagctaagctgcgaggatacaaaggcaaaagaatgacacaatggactttggggacttagggggaaagagtgggaagggagtgaggaataaaaggccagaaattggagggctgggcgcaggggctcacgcctgtaatcccaacactttgggagaccgaggtgggcagatcacttaaggtcaggagttcgagaccaccctggccaacacggtgaaacccaatctctactaaaaatacaaaaattagccaggtgtggctggtggcaagctacctgggaggctgaggcaggagaattgcttgaacccaggaggcggaggttgcagtgagctgagatcatgccactgcactccagcctgggtgacagagcaagactcagtctcaaaaaaaaaaaaaaaaaaagactacaaagtgggttcagtgtatactgctcaggtgatgggtgcaccaaaatctcagagatcaccactaaaggacttactcatgtaaccaaataccacctgttccccaaaaacctatagaaataaaaaattaaaaaaaaaattcccagccaccttggcccaactgagggcaattctgaaaggccattttaacttcagagctaccttgggggtctgcctaggctgttgttgggcctgcatcacagtttatcttctccctctacctgcttctgcttttttcccctcctttccccagatattggtcccaagggtgcaccctaatgaacatcctgtctcctatgctccatctcagagtggacttcccagaataaaagcctagcctataacacgtggtccagcccaattcactgacacttgttgcaaggtcgcaggattcctctagaaactactaagcccaggtgacaaaatg

SEQ ID NO: 7068 - DNA, 3753 bp, artificial
  synthetic oligonucleotide
acagtccaagttttcaagaatctggacctaagagatattccaaaaatgctccaaactgtgagacggtgagttagcttaaactgatgggtgtcttctgtgaatgtcatatattaactcaccaaattatctatgatgcttagcagtgtcactgttgggctgaacattgagatttctgacctctttacaaaataattatacatggccaagatcttttgatgctaaggatacccactgggcttgaagtcttcagtatcctttccctgctgctgcagcagttggaatcagcctggagtctgtaagaatgaaagagaaagctcctctctgaagttgggtttaagttcattgcagtatggggcaatgcccctcaactcttgcttaatattcagaccacctgaagagcttctaaaacgcggagctttcaccccacaccaaatgactccaaatagctgggattgggcacaggcattcataattgttttaaaacaccaggtgatgcaaatgagcacccagcatcgagaatcagtgtgccaagacccctttataacagacaccttgctcaacctgtcccttctttcacctgcacctatattccacccttgtatgcccacatacctttttgttatagttgacaatttccttaaacaggttctcctcttcctcatatttttgtcctgttcatacagttaccttattgacctgagaccacatataactggatagaggtaataattactcctgtaacaactgaccttagcaggcttttcccaagccttattgactctgtttttcactctttcacaaatatgtatccttaacatcatcatccacgattgagttaacctgtgatagtgttgctgtttttgactagtctcttagcaatcaagctaaatctcccactgaatctgtgtgttcctctacaaaccatatctgggtggaatgtacgtttttattgtgatataattaatatatcataaaagtcatcctcttaaagtatacaactcagtggtttttagtaattcacagtattgtgcaaccatcatcactatgtaattctagaacattctcattactctaaaaagaagccgcttacccattaaaagtcacctcattcctgcctcccactcgctgcaaccactaatctcttttgtctctatggatttgtctattttggatatttcctatacatgaatcattcaatatgtggtcttttgtgtctggcgtctttcgcttagcatattttcaaggttcatccacgttgcagcatttaccagtagtacttcattcttttttgtggccgaataattttccgttgtatggaggcaccgaattttggtcatccactcatcagctgacggatatttgagttgtttccaatttttggctattgtgaataatgccgctataaacattcatgtatatggttttgtgtgggcatatattttcatttctcttgggtaaatacccaggaatggagttgctagatcatatgcaaactctgttcaactttttgaggaactccaaattggttgtgaacattattttttgacctcaatgcagctttcctttacaggagggaggtggactgtacttgttagcgcgctgcaaatgattctcaggcatattaaacatttttctgtattctgttaaacattgtatgcgcagcaagaatgacgcctcatacagacctttcttgtcatttcgttttattatttcaaaatgtaagacaaatctgaaaaatggaggagcctgcagatacctgtggtggcgaggatttggggtctgtctgagctccggcgttcctgcccatccctccagctgtatctctggccacctgtctgttcctggcacaaacaaggcctgctggttgccaaggacatgactacggggccatttccatgtgagaaggccctggggggtgtcaaaatgcagaaacgtgactgatgggcagcggggcacccataaacttcccatagccaggtgcaggcatacctgcaaatgtaacgcccaactgtgtacaaagcagaaatctaaatgccagggcggactgggagaggttcccgtgacctctgacccggcctctaaattctcccattccctccccactgtcctgccgcgccccgtgtcgcctcgcctggcctcgcctggcctcgcctccctcctccgctgggggtctaagcctgcgcagtattgcgaacgcgggcggcgtttcccgcatgcgcagtcactgcccggcccggctttttcagtaggagccccgcgcggtgcgcgctcacgcacgcgcacggcctcgcctgcgcgctcacgaggcctctcgcggcacgcgcccccgccccgcgccgccccgccccgccccgcctcttccccctcccgcgcgcccgcccgccgcctgccgccgccgccgccgccgccggagctctgtagtatggcatcgaggagaatggagaccaaacctgtgataacctgtctcaaaaccctcctcatcatctactccttcgtcttctgggtaagtgcccacgccgggccggtggccgagtcgctgtccatcggtccgtatgatgatgctctgagaaaagaagtggggaggaaaacccaaaccaaaaatcaaatctgggacccctctttaaggagacaggcgcggggtgctgggtcggggctgcaggatggcagggtgcgggtcggggctgctggaaccctagacctcgctccgcgcaggctgcaaggggctgcggagtgtcggtgactgcaggttgtcgaccttccaaaaaaaaaatgttaatgcattagtttcttttataatctcccgggatagggtcagctcctggggaaagttgcgggtttattcgtctgttttcctcgctgtacacctttctctcccttcccctaccagccggttcgcggcgcctcttggagctaacctgtggcgggctaggagaggacacgggagcgtggggtttaatctcagattcccagttattcctgaccccacggggctgcgggagggaggcaccagaagcaccgtgcctgcctggctgggcaagggcgaccgaagtctcccaagcgcacgatggggagcaggcgttgtcaccgcgtggaggcgcacgaaagggagagggtcttacataagccgggggcatctttgaggtttcttggtgacccaagagatgagtctttggattcctttcccacctccctgcatccttacactccctatctggtggttctgtcactgcatgagcacaatccgcagcgccctggcagagggtcccctccacttggtgatagagatagcgccccaactctactccccatctatccagtgctgccgccggtccttgaagctcaatgcagaagggtgacgtcacccctcagccagggccgcggggggctgcgtggtgcacctcgcggagggatgcgcctttctgcgcgggggaggggggaggaggaggagggggaggaggaggaggaggagggggctccaggcttgtgccttacctcatcctgtttggcaaatcatggaatcagtgcagggctgacactgcagtgattcactgagagaggtgcgtggtacttaaagaccattccctgttatttctcttttcatgtcggtgaccccgtcttccctagttccttacgcccataatcaagctacagctaccccgcaggggaatgaatatcgaccctcttccccccttgtcccccaaatctgggtcattttagcttctacggcagtcattttgaaatctgaggctctgt

SEQ ID NO: 7069 - DNA, 1143 bp, artificial
  synthetic oligonucleotide
aggtagcttgtgactgataggtagaatatacatggtaattaatgaaggataacacccttgaactgacttctgaattttaccatattttaatattaatctaaagattcttaattttacttggacatgatttgacccctggatgattggctgagaggagtttctatattgtgaaacaggaaatctatattaacatctctcataaaatactgagttttatgtccacaaattcctagattctctttgcatcttctaggtcttttttattcctgcaggtataaaacaagactgagtgtttgaagggaaaaacagaatatatacttctttcctaaaggataatttccagaatgttggttgctttggtagttgaatttaaccttggtaagtagtagcagttgtctgcagtaaagtggatggaaacccttgattccattgctgaaccaccttcttagagtgagaggtttgtcttgaccactaattgctataattggagcttgagagatggtttgagatgagtcttgaaatgataagtgtgtctatctgcttggcaggtgttttctctttccttttaattccctttccaaatcaaggtggtatttgtagtcaaggtttcatagggagtttgctaatgcgtctctaggagaaacatagaaaagctagatagaagggtggtctaacttgatttgtgtcctcatcattgtggtgtaatgagaatataccaatttttgcatgatggcaaaaaatgaggtaagcactggagcactgaaacatttagaggtatttaactacatcttaatactataggctatggctcagaataaccataggaatcttgctgtttttatttgtgggtttattttaggcaaactatcaacagtgctgaaatgatactctgtgaaaaggaagaaagaatgtacccacaaatttaaaatgctgtgcttgctggttttcttctcttagccttatccatcaatcaagaattgttggagaaaagtcacgttgaataattctgccagttccactatgtaatcttgggatgaattgtgtcgctctgcatggtaacctcagtatttcataactgaggatgaaaatggtttttcaacttgagaaaaatcaggactcttttggaacaatatttcaaattcc

SEQ ID NO: 7070 - DNA, 2910 bp, artificial
  synthetic oligonucleotide
gtatagttaacaagcaagagcaaactttgtttatgtttaactcagactttgttcagaccaacagatcatgtttcaaacaaagctcgattaatgttgtctgagtaatgtctccacagctctcattttttattatttttttatttctttttatttaggacctggtgtctacaacaaaccacaactctaatttctacataggctatctcagactctaattactttttccctagccatctgtatctctggccctcctgcttagcaatgcagatgcactttaattttattccagtttgttcctaaaactttctaattgaaatgtggaatatacagaaaggtgcataaattatgtttacagcttaataagttaccacaaaatgaacatagctgtgtaaccctcgctaagattaaggaatagaactttagcctgatggtttgttttttactagacagccttagagaagtagaagagcttttcttcttaagcagttacaaaacctgtgagacattttatctcacaagagaacgtgggctcagccaacacaaatatgtttcttgttgcaatttcaaaactatcttttaccatgctttgttattttttgtttttgttttgcagctcatgaagtgaattaaaccctcaaccctccaacacatagacaaaccagagtggggtcacaaacaatgcaaattaactcagtctccagagacatttgaaaagtcattgctactctgaaatttcttctagttgctataatatttcaataataatactcagcaacatcactctaatgactgagggacattttagaggatccccaaaccctggtgactgatgcaaatgtgcaagatgcacttgacagccttgaacatcctgtttacttaacatatgtatgtgtagcatcatattgttaacatcaaaagggcgtcttgtgtttggcatttgaggagacctgtcccattggaggaaaaaaaaatattgctgaagtctcccctaatagctatcctagaaccataaagggagattatgctgatactgtacattaggagaagagagcctcaaagaacctggaatctcatgaatgaaacaccttatcatccaagaatattcccatgtggccatgagcatgagtgtgtgtgtggtattaagaggatcctattttcattaatgagatgaatcaaatcaaatggatccttctccaagtaatgaacctgattaatacctctcttccactcttctctcacacatcccaatgaagaaatgtatgattagacaaataattatctggcctgattaatctctctgtgctaccttaaagaaatctgtgatttgtgaattgttgaatatgcactgtgaccctctaggccagtaagagagcggctttggccttaaggaaccccaactctgaaactctctgcagtgagtttaagtctcatcaaggtgccacatagttgttggggtgataaaacacaaagcccagtggcatcataccatggtgcccatactgctcacccatgtggccaggcaggtccagcagggcagagacttgagacctgctcccaggttcaggcaggaagagaaatggctatggctggcttctgccagccagatgcaccaggaactgcagctatttatggtgctgtcagcctcaggggtcctgaaagctgaagttggcttccagacgtccatagatccagggcatccctgggacaatggtggccacttaccagatgcctgttcacaaagaaccagccctactgattctggtcagtgacctggaaccagacctttggctacatgtgttcagaaattttagagccaatgtcatagtaaaatttagcaaatgttggctgatattgatgaaccagttgtgttggcctatgccttagccttcctataataaagaaggctctactaagttagaggccacagagaggacaaagtaggtaggaaagaacagagctcgctctctctcttcctccctcccacttttgctctcctgccctcgacctttttcttgccctttgctttgcttgctcttgtgacctccgtgctatcatcttttggaagaaactggccatgcacatctattgtctcaaagattaaaggtggtataaagtattaggaaaactaagctgggtctagccttttaatagactgggcaagaactttgtcccctgttagctaacttagctaattgaaagctcctgagtgctgtttttgaacagcagcagggttgtgtcaagcattaaacacttctctctacaaacgtccattacctttgccctctcaaggtaaacctcatttgtctggacttgatgggcagggtctgctgccctataaatttatagcagaaggttgagtgtgtttagtagggtacctcttcgctgcatctttggcaactgctctttcactcgagggcttgtggggagagtgagagatggagcatgcacgcacatcacccctgtcctatccccacccccaaaatggcctggaagacaagagccatgggatgtctgggcatggacatgtttattgttcaatttgtgacattgtgtatatgtacatatgcatgtgtgtctgtggtggggtggtggggtgtcctctgggcttctgtatttagtacttctgtgtctaaatagacccagggctttgctagacttggaacctgttaggctggattaattccccatatcacgtaatattatagtcctgagtaaagacagtagagctgttttccagaaggggagggttgagtgactcgcttgaagttgggcagctactatagatccaggattataattctgacctcttcacctggcttgctgtattaacttttaaggccagagatcacccttgttcctgccactgatagcacctgaagggaattcattttgtgcttttataacaaaaag

SEQ ID NO: 7071 - DNA, 477 bp, artificial
  synthetic oligonucleotide
atgtaaaaataacaagtagaaaaaaaaaagaaaccataaaagcatttcaagaaatatgagtgaatagaccaagaatatagatgaataacaaaagaactaatataaatggcttctaaaacctgtaaaaatatgcctaatctcagttattattatagaaatacaaatgaaaattaaatcacattgaggtattatttctcacctctaagactgacaaaaatctaaacgtgtaacaatacattctattgatgaggttatgagcaacaagtatcagatattacaggtggaaatgcaaattgacactatcagaattacaaatgtgtttacgttttgaactcattctacagatgcacctgcacatataagaagtgatacatgtttataattattcactgaagtactgtttgtaatagcaaaagactgggcacaatccaactctcacaatagcgaactggttaaataaactttgccacatccaca

SEQ ID NO: 7072 - DNA, 1594 bp, artificial
  synthetic oligonucleotide
cctgtgttttctactggctcaaccttcccggaagccagggaaatggagtgccttgtgatacagagtggaggatacaaaagggtgggtataggtctgagagtagaggtgaatgacaggctcatggaccaaactctgcagtgatagctccacacccacatgctaagacagcttggaatgactctaccttttggtgtgagagatgtcttgagaagaactccagatgaggcctgtgttgaatgaagacctaatctgttgattgtttgttatcaaacattataggatgctggatttgtcagttagcttgtcactcattggtcacctgaaggctcaaaatcatttagtcatacgtatgtatgaatgaagggatggagagcaggctttgagtgggtaagaggtgagggatgatgaaataactcatgaaagaagaatatattgaagatgttaaatattcaatattgaatgtattgtcttggctgcttttctcacttatctcttagaaacaatgggtactaaaggcaaggcaatgggcacagctggctcagggtacaggcaagaggaggacacatttttctgtgaagaaactacaaacaacactaaaaccaaccacaaattggtctctattttcttgttagcatgtctaagcaattctaaacaacgtcaatgataaaatactcctccttcacctccaaaatatctttttggatcaagttctacaattgcagaggttagcgctgagttttaaagaacatatgtaagtttcaaattggcatattttcatgacttacccttttaataaagtgttttctgcatggacaataatgcgagaacccccactcacacagcaggctgctgacctacgtggactcagctacaatccatttgattctagagtaagttcatgttggttcagaatcacttgaactcacttcagatgcaatttgcctctccatttgctgtggtacttacatattcctacatttaaacggtagctttgaaatcacaatgagaggaccgtggctgaaaaaaaaaaagaacttgagatgcttcaatctgtcattcggtgtgcacatcactcgcggaatcttgtggtgttcaatgaattggacatgtttcttcatgtgggttccccctcctttaaatacattactataaataaaaatattaattcagtttatttttcctttttggtactgtaatatttatttttgttttgcttttttcctggtgtgaaaatttaataaaaaatattttcactatctgtgtttctctgggactgttacaattattactttcatttcgtgaatgttactgaaaatgattttgttatatgaggaagggagtgtaaaaataatctactctggatgtcaaatatgctaggtatgctactgcttataataaaaataaatctgtctccacaaataaggaaactgaggctcaaagatgttaagaaaattgcttaaaattacacaagtagtaagttatagaccagccattctaacaaagattgtacagtcaatatacagcacgtaggcttaatacataggaactcatttaatactaacagccatacgaatggagaacatccccattttgc

SEQ ID NO: 7073 - DNA, 1866 bp, artificial
  synthetic oligonucleotide
catcaaattacacttaatgcagaaacacatcattcattcctcctaccaaaatttactaagtgtctagtgtatcaggccttatactataaatagatgttgggtatatagcaattaataaaacagacaaggtgcttatcttcgtatattctagttggggaaagacaataaacaaataggcaaattaataatcactgactatggtaaattctatgcaggctatcaacagggtaatggagtatggagtcacgccgatggagatttgtcttagatagtatgattagggaagacccttctgaattgagacctaaaggacaagaatgagctgcccacaaacaaaacaagaagaggataccagacaaaggcaagggggttgaaggtgacagttttgagatgggttttgggcttgatgactaactggatatgaaaaatggagagagaagtgtcaaggatggcttccaagtttctggcatgaggaactggctggatagtggtcctatttcatgagaaaggcagtagtgaaggagagtaggtttgtcagggtgaaagtattgttttggatgtgttgactctgaatgtgcggtgggggagggggttggggtggttggtgggtggagaaatagaatagatagaccagaggctaagaagaaggattttggctagagacacatattttgagtcaaccatatatggatagtacctgacaccatggatggatgatattgcccagagcaaaagtaaaaactgagaagagaacagggtctaagagtttttagaatccttaggagctccaacatttaaagattgggtacagaaggataaattcacaatggagactgagaaagagaaaaaggaggaaaactagaagagcatagggacatggacgctaaggaaatggcacatttcaatggagataaggttaatagtgtcaaatgctggcaatgtcaagtatgatgagaatcgaaaggtggatttgcaacatgaacaatggctagtaacatcagcaggagcaatttctatggagcaatggcactggaagccagaatggggtgggttaaagaatgcacagaaggtggacagagattgtagacaactctgggagaaggcaggctatgaaggcgaagagagagatgatgaagctggcgaggagaccggggatatttattgttggtggtggattttttataataaaaaccctttttggtcctttgaatgctacgggcactagaatttagggcagcacctttaaaatactatgattcagatgctatatctgaacacctaggcagtgtctgtacttgatgtctaataaatatctcaaaattaacatgcttaaaagtgaattctggatcttctcacacaaacatgctatgctatctgtctttcccagctcagtgttaactatcttttggttgcttgggtaaaaaacttacttcattgaatccgtttttttcacatctaaataaaatgccagcaaagtgtactggctcaactttcgaaatatgcacagaacacaaccacttctcactgatgctacctttggctaagccacttcaatctctcctggattattgcagtagcctccaaactactcatcgatctcctatccttactcctctaaagtccattctcaactcagataataacacaggtccccttttaaaatgtaaaggaaatcatgtcatgcttttgcttgaaatatttcaatggtgccatctcccccagtaaaaccccaagtctttaaaatagcttacaagttcctatgtgatctgacctcatcacctaacactctccccctcactctgttctggccccagagcatgcctctgcctcaggagctttgcagtggctattcccgctgcctggcct

SEQ ID NO: 7074 - DNA, 2934 bp, artificial
  synthetic oligonucleotide
gccactgcgggagcaccgcgcgtccacgtgcacccagcatgcccggtcaccctttattacgtaagagtcccaggatggagttgtacctgctgccggcccctcttccccgacggctaataataaacccgggttcctgtttcccggccgcggccactccagattcggggctgaggggctcactctgcaaccaaggcacgtgcattctggtcatcccacgcggggagcgcgcgcaaggcccgcccagcccccacatgccagccccaccctccagtcggtccggacgccgacgcctttttgaccctcgctgtgcccggccctcctcatctggcctgcccagggcttggtgctggcggggtccagctgctccaatccctcctcctctgctctgccctgccctgccctggcctgccccggcgccctccctcagcccgggtatcaggcgagaggcggagctggcccggcgcgccccgcccccgctgtagaaagggccgggcgagtgttactcgcggtcatcccggcctgggccttttatctcggtgctgccgggggaggcgggaggaggagacaccaggggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggtgggtgcccacgccccatcgctgccccggccagcttggttgcttgagctcaggcttttcggagggagaagttgtggtggtggggggacacccttctccccgcggccgtaggtgggcgaggaggtgggactgcccagccgcggggagccacccaggcgccgtcccggacgagctgtagccagagaagggggtgcgcgcgggcaagggcgccaggccccctagcagggtgaataatctaatctgttctttcgtctccgtgtatcaaacaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaactaaattggacaagcgtctggtcctcattaatctgccaatgaatggtttcgtcattaaataaaaatcaatttaattgatttactagcaaaagtaaattttgtgttctctctggtatttcatggtggtggatattcatct

SEQ ID NO: 7075 - DNA, 3309 bp, artificial
  synthetic oligonucleotide
aggggtgagggaaagaagtgagctaaacaaaggagctaaaagtggctggagagagagagaaagagagagagagagagagaagatacagtgccacataggaggacctctcagcagagaatggacaacccagccaggcaaagaatgaggacataggcacatctcaaaagacttagacagatggagaccaagagggaggcacctcttcctactgatactgagacagcatttgggtaagacacaagctgagctccagcccaggagagggagaaggggcagcacagggaattctgagtttgtttgagcttcaatatggatgacagagaaaatcactgaagtgtctgacagcctattagtgatcagactatgctttctgcattagacagatgggagctccgggtagaatttaagtccagtttagagggaaatttttaaaagttacagttttgtatacttgaatttgtgaccataatatttatactgcccaaaccataagaatttgaacaaagcactttaaattcttcaaagcccacttgatgtgctttgttgatacacctgtcaagaaagaagacaataaatgcctttgtgcattcaaattcttatggtttgggcagtataaatattatagtcacaaattcaagtatacaaaattgtaacttttaaaaatttccctctaaactggacttaaatcataaattgggtattgatgggacatatctcaaaataataagagctatctatgacaaacccacagccaatatcatactgaatggacaaaaactggaagcattccctttgaaaactggcacaagacagggatgccctctctcaccactcctattccacatagtgttggaagttctggccaggacaatcaggcaggagaaggaaataaagggcattcaattaggaaaagaggaagtcaaattgtccctgtttgcagatgacatggttgtatatctagaaaaccccatcgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagacaatgaaatgcctaggaatccagcttacaagggatgtgaaggacctcttcaaggagaactacaaaccactgctcaatgaaataaaagaggatacaaacaaatggaagaacattccatgctcatgggtaggaagaatcaatatcgtgaaaatggccatactacccaaggtaatttatagatttaatgccatccccatcaagctaccaatgactttcttcacagaattggaaaaaactactttcaagttcatatggaaccaaaaaatagcccgcattgccaagtcaatcctaagccaaaagaacaaagctggaggcatcacgctacctgacttcaaactatactacaaggctacagtaaccaaaacagcatggtactggtaccaaaacagagatatagaccaatggaacagaatagagccctcagaaataatgccgcagatctacaactgtctgatctttgacaaacctgagaaaaacgagcaatggggaaaggattccctatttaataaatggtgctgggaaaactggctagccatatgtagaaagctgaaactggatcccttccttacaccttacacaaaaattaattcaagatggattaaagacttaaatgttagacctaaaaccataaaaaccctagaagaaaacctaggcagtaccattcaggacataggcatgggcaaggactttatgtctaaaacaccaaaaacaatggcaacaaaagccaaaattgacaaatgggatctcattaaactagagagcttctgcacagcaaaagaaactaccatcagagcgaacaggcaacctacagaatgggagaaaatttttgcaacctactcatctgacaaagggctaatatccagaatctacaaagaactcaaacaaatttacaagaaaaaaaaaaaacaaccccatcaaaaagtgggcaaaggatatgaacagacacttctcaaaagaagacatttatgcagccaaaaaacacatgaaaaaatgctcatcatcactggccatcagagaaatgcaagtcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctctgggatctagaagtagaaattccatttgacccagccatcccattactggatatatacccaaaggattataaatcatgctgctataaagacacatgcacacgtatgtttattgtggcactattcacagtagcaaagacttggaaccaacccaaatgtcctacaatgatagactggattaagaaaatgtggcacatgtacaccatggaatactatgcagccataaaaaatgatgagttcatgtcctttgcagggacatggatgaagctggaaaccatcattctcagcaaactatcgcaaggacaaaaaaccaaacaccgcatgttctcactcgtaggtgggaattgaacaatgagaacacatggacacaggaaggggaacatcacacaccagggactgttgtggggtgggggagcggggagggatagcattaggagagatacctaatgctaaatgacgaggtaatgggtgcagcacaccagcatggcacatgtatacatatgtaacaaacctgcacgttgtgcacatgtaccctaaaacttaaaagtataataaaaaaaattcttcaaagcccttccccctcaactatctcatttgattcttttcatgtggcaggtaacacaggcatcatagttcccattttacagaaaaagaaactgaagcttgaagagatatgagtatattcccaaagtcccaggggccaagcaagaacctcagcccaaggactttgaactcctgattctgtatttcttccatgccagaactctgaggataggttcagaagttcttaccatcccattggaagtctgtttgggtttatatcttccaagttatagaacccaaattatagagtctactggatcatttgggtaaatgtgtcaccagttctgctcattgactgtagtgaaataggaatgtcctgtgtgtgtgtgtgtgtgtgtgtgcgtgcacgtgcgtgtgtgtattgcatgtgtgtgcacctgtgtgcatac

SEQ ID NO: 7076 - DNA, 2638 bp, artificial
  synthetic oligonucleotide
ttgctccacccctctctcctgcccatagaagctccttagctaccccttacagaggagaccctgggctgggtggacctttggtttcccctgcagagcatctctgctaattcttgtgtctgtccttgtccgaaagcagtcatgactgcagctgccccagggtgctttcatctttcaagtcctgatctctcgtaccccttaccaccctcctgtcacccaaatcgcctttccctgctcagatccctgatctctggctttcccgtctgctgccagttgctcccagcaagctcttggtaccggatggatgggccttcataataaccctggcaggcagctgtgggccagggcctcccctttgaggtggtgtgtctttgatttctagacagattagcagcacacagaagcaaagcccatgtaaaaacctggagtaaaaggaccagctctccacatgacacatgcctgtagtacaccgtgactggcaggtaaggggaaaatctatttgcagagcccagcaagctagacgctcgttctgaagagcctgcgagacctaaaaataccacaaagggtgggagggagagaaaggaaactttagcatggaatattttcaaaaaattaaaaatagaacggcctttggtaaatgagagtcaccagttgctgttctggtcaccacctatggggcttttaggattcctagcagacagccagtagctggcgtggcaggaacagtgacattattttgagaaacagactcaagccaccaatagatagatggtagaggcaagtgtggagagatgaaattgccacgtggtgggctgaattgattgggattgacaataaactggcctgggaattaatgagatccaatagatgtggggttcttctctgatttgatgaaccactttgtcaggcttgcttaaccttggtctcaaatcagtgagattgtgtagtttgcaacaggaccctgattcttctcctttttttattaggatgctgaagtgctgccccaaatctcttgtacagcctcctcctccctctcccttcctcctccccctacagccttttcattcattctgagctctggcaggtgtttggtttggtttcattcttactgcctttcttagaaaatgcctggattagtgaaataaacaaatgtcttccatatggatgagtggtcccaatcaagggcctcatatataaatagattgggcccagcactagcaagatcttgggatgagggaagctgtgatatgttagcagtctagaaggtttaccttgtatctctatccaggcctggaagaaaaatggtacctgaaaaaggatcaggcttatgcagaggaggaaactggatttctgctctctaaggggttcaacaattcaactcatcagtgtaggcacagttgggaagggtttagaacaggggcacgtgttctcaaaaaggcaattcccaagggaacccaaggtacaaatgtagactgcaggctctggaggcaatctgatttattttccagttcccctataacagatgaagcagagaagaccctcaataaatgtttgtcaaatgaataaatggatgatggactaggttggcattcacgccaaacgaggggacttaccctcaaggctggggatttttcagtgaggagtacagcaaactgtcttagggttctccaaggactggctggttgtcacctgaactgtgcccagattacacattcccagctgtcaagttaccaactgtgtgccaggggtcagggccacctccatccaaagagacagttggcaggaccattgtgtcagtaatgtcacatacctgagcatgaccttaagctgccctcacagtccgaccctgtcctgttcagctcgtgagcaagatcaggcctgtgcatggttgaaaattcctcctcctatagacaaactaggttgataaatattatatgttgctgaatttccatggcactctctgaggatttcaggcactccatatcatggatagtcttgatgtaaaatgttgtatcatataagatgcaccaaaaactcctaagggtatatggaggtacttagataaacagacaacctgggcaaaaaaaataactccaactgagttgactttggagatagaagacttgggaggaatttctagcgtttttagaacagctttgttgttgggaattcagaaacatagtatcttgggtataggttttatttttaatttatttttgttgagacagagtctcactctgtcacccaggctggggtgcagtggtgtgatctcagctcactgcaacctccaccttctgggttcaagcaattcttgtgcctcagcctcatgagtagctgggattacaggcgtgtaccaacacactcagccaatgttttgtatttttagtagagatggggtttcgctatgttggtcaggctggtctcaaactcctgtcctcaagtgatttacccgccttggcctcccaaagtgctgggattacaggcatgagccactgcacccggccgggtataggctttaacatgtacactaaagattacaaggtatctaatttaatatattcagtatataaggttcagagaagttaagtgactcttcatggctcatcaccagtttaaagcctcacaatgttaaaatcagcta

SEQ ID NO: 7077 - DNA, 1328 bp, artificial
  synthetic oligonucleotide
taccttgagtgtgaactggatccaatgactattttctatccagtagaatatggcaaagatgatgagaggtcaattccatgattatgctacagaaggttgtgactttccttttgctagcagactctctttctagctggccttgatgaagctgtcatgacagaaggttgtgactttccttttgctagcagactctctttctagctggccttgatgaagctgtcatgttggaaaggcctgtgtggcaagaaattgaggatggcctctgagcaatagccattgaggaaccgaggccctcagttcaacagcccttaaggaattggagtctgccagcaaatatatatatatatatgagtttggaaatggatccttctccagttgaaccttgagatgagactgtagccttggccaataccttgatgatagactcttgactctaaaatagaggacccaactaagctgtgcccagatttctgatccatgaaaatggtgagataataaacgtgttgttttaagcttctaaaatttggggcaatttataatgcaacaataggcaactaatacacccacaagcctggattttaatctggggtttacctgtaatctatcgacactgacaaccttctagtttcaagtagataatcttagagataaacgcatgttgaactgtttctggcacccatgtgcatttttaaaccatgaacttctggaaaaactgccctatcttacccttctggttacctaatcagtgtgatgaaaccactacatgtttgtttaaaatcttattcatgtttgaaattgcttctgaaaaaggaaaaaaaaaacagggagaggcagacagaactaaaatacgagtgttgtgttccagattaccatggctggagaaacctggaactttctccatccacatgaaaaacagaaaaaaacaacagatgctcaaagagtaacagagaatctctagaaaagttatttgtgccttcatcacaatcagttgcccaatttcaggagatgagttagggttagtataaagaacatgaagtatcctgttgatgaaagagaggataagagaagtaaacacatttggaaggtctggcagcaatggattcacagtccttcaagccaaccattgatgaaagctgaagagaagctgaaccttcgggatagagcttgaacaattagttgttcaattaactacctactgacctccaatgctgaagccatgtcagtcaccatctctcatagtgcttaaaattactgattcctttccctgtaattagaaatattattttgtttccatgtctctattgaaagccttgcctgtgtgggggtgg

SEQ ID NO: 7078 - DNA, 2586 bp, artificial
  synthetic oligonucleotide
cctcagctcaagttcttcttttctgattccctttgtgaccaaaggaaaaatatttgacctttgagagcctaagtttcttcttttgtaaatgggagctcatttactgtcaacaaaaagagccaaactctgtaaaatatctgaagagatttattctcagctacatatgagtgaccatggcccaggacacggccccaggagatcctgaaaacatatggccaaggtggtcgaggtacagcttgattttatatattttagggagggataagccatcagtcaatatatgtaaggtgtacattggttgggtctggaaaggtagggcaactcgaagtggggatttccaggtcatagagggatttaaagatttcctgattggcaattagttgaaagagttaagttattatctaaagacgtggaatcaatagatggggatgtctgggttaaaataagaggttgtggtgaccaagttctttttttgtttttgtttgagacaaggcctcgatctgtcacgcaggtaagagtgcagtggcatgatcacagctcactgcagccttgaactcctcggacttgggtgatcctcccacctcagcctcccaagtagatggtactacaggtgtgtgccaccatgccttgctaatttttttttttttttgtagaggtgaggttttgccatgttacccaggctggtcttgaactcttgggcttggcaactcaaagttctgggattacagacatgagccaccacctccaggtagcaggcttcagagagaatagcttataagtgtttcttatcagacttcagaaggtgccagactgttagctaattctctcctggatcaggaaaaagacctgagaaagaaagaggattcactacagaatgtagattttccccgcaagatacagcattgcagggccatttcaaaatatgtcaaaaatatattttgaggtaaaatacttcagtttcttccagagcctgctatctgtaatgttggtattttactgctacaaagaatctgctttgtcagtgttaaggtctctgttttaattttagtgctggtcagttgtgcctgaattccaaagggaggagggtataatgaggcatgtctgaacaccctcccccaccaccccgcttcccatcatggcctgaactagtttttcaggtaaactttggaatgcttttggctgagaaaggggatccattcagttagttgggggtgcttagaatgttagttttgttttacattaccttatttaccatacaagggagttgtatgtggaaatactttagaaatataacatcctactcaaattctgagggatctctattgtattctctttaagtgtcccctaaacttctgtgctgaccatccttccatcagaaatggttttgcttctttgtttttgctccacattcgctgacaaggcccatctggtcttctgtcttgagaaatttcatttcccttgagccttcctatttgtttgttgaacaaaccacacatcactagcaatgtcatattcccaggctttctcaatatttcttgattaatttcccccttgtccttgcagctttgctgtttttttcccaggctctcccctcagaagggctgcagactgtgtctgattgtgtccacacttgccaaaggccaaatgggaattcaagagcttcggttttcttttctgaagttgttattttgtctaattagccccaaatatttaattattttgaaatgacaatagtctcatttttaaaaactgacctaagtgttcagcctcgtaatttctatttggggccttcatccctctctccatccctccctgcctgggaatatgagggtgagatcaaacaaacacagtccctgcaccccattttacatttacattctccgtgtgtgtgtgtgtgtgtgtgtgtgtgtgtgtgtgtgtgtgtgtgtgtgtgttcatcattgaattaatgctaagtcgttctatttaacttgtcttggcctaataagaaaatcaaaaagacagaccttatatgtaaatgaagcatttgcactgaatgcacattgcttgagccaaggtttcctagtaatttgaaaataatttgcaaagtactaggaaaattaagccattgtttgacctgtggttgtgtaggcataatgtcctctctcatactctcagtgccagtttagtttagtttcagcaaaacaatattacccattatttcaaaccaatgttgttaattggaattgtactagtgttacagttctatttatattaatttgtaaatatttaagggcctcaaggatgtagacgattggtaatataagaattctgtggtcttaagtttgcatataataagcactgttttaactaaatactactattcaataatgcacatccaagagaaaaaaatttccctcagaaaggactgtacattactcaaatttgaaaacatgaaagcttcagatttttctctgaatcatcaccagcagcagataacagtgaagctatattcaccactcccacccctgctatcatcttggtaggtctgggaaatggcttgaatgcaaagttgacctatgctttatctcaacagtcattttgcaa

SEQ ID NO: 7079 - DNA, 1236 bp, artificial
  synthetic oligonucleotide
attccttttgaaaaatggtgagtacactttatctccctcagaatacaaagcctatgccaaattgacattcctttccttctaaaaccttcttacacaccagaattttgggccttcactaaaggggatggaggaaggagaaaatgtgcttgtaggttgtgctgaagcattttcattctgcctgtgatcacattattgaaacttcttcccaccgttgatttgtctgacatgttgcaaagcaagacctgggcttctgctttagctgcaagcattaaactttgcaactacaagaggtcttcaaggccatcaagacaaacttctttgttttatgaaggcagaagccaaggagtgacatgaaaaatctcccagatgcagaacagaagactccctgagatctcgtctgatcccaactcctaaagaccacattccctaattggaaaggctgaccctctccaaagttgcaccatgatgattccaggttccagattctaaagcaattgctcccctttgtttttagctagattcaagtcaaattagtttatgaacgatggcgttgcaaaatgggcgtggggacaccttgaatgatttatcaacctggaacgagattgagctcttgtctcagaatctctgaagggctttgccctgtgcttgtagctgtttggaacaggatctattttgtatgagatgacaggaggcatcaactggtggttttcttcagaagaggaaggtgaatagcccatgacaatccaagttaaccagaataggggaaggttgttggtgaggctagtgatatggctagagtacaggagagacctcctctgcttttctaaaaagactttcttctcttttacattttcctttcagttttctccttttattttcaagctaaaagagaaacatgggttggctgcaaaaaaattcagacaataaagaaatgtattttctaccagttatgtattgctatgtaacaaaccaccccaaaacttagtggcataaagaagcaacatgtattttgcttttgaatctgcaatttaggcagtgctcagcagggaaaacccgactctcctccttgcgatgtctgtgaccccagctgggaatgatcggaagtcataggggctggcccgtcacttctctctcctttttcaggtagtcttaaggcacatgtctcagtgccacatgttcactttatgtgtcctctccagcatggtagcctctgggtagtcagaatccttatgtgac

SEQ ID NO: 7080 - DNA, 2091 bp, artificial
  synthetic oligonucleotide
gaggtcccctgtggttactgaccatagcgaatatattgcaaagcaccttgaaggtccctcactggacttggggttaaagagtaacaccccaacttctgttttaaaaggaagagaagagggcattcactgcagagctatgactcagttccaatctcctcacatacaagcctctcttcccacactggccatttcttgtattttctaaatgggagatgggtttcaagagttctcaagaatagccatttaagaaagcaggttgatattacctcctaaagtcgagcattcacacatctaggtctatccctaagagtaaccttggcatattcagtaagagacacgtacaggaatgttcatagcagctcagttcccaacctagggttgtcagataaaacgcaggatcccagttaaaattgaatttcagacaaacaacaaataggattgttttttctgtctggtctaagtatgtcccaaagattgcataagctatagttcaaaaatttcatgttttaagttcaaatttaattcagtgttctttatttttatttgctaaatctggcaaccctatcctaaaacaaatgcctgtctaagggtgaatggaagaaaaattgtggtatttacacacactggacatacgcaggagtctaaataaatgaaaaacagttacacggaaaaatatgaatgaatttcagcaatatgaaatctgaaaaaataaggctccaaaatattacatacggtatggttttttgttgaaattggaaactactaaaataaaatatttctatatttttaaaggaatctatctagttgcaataaaactacataaaaaggaaagggaatgatgaatatatatatgattcaagacgatgatacattttctcaaatggggagaaaagggtataaattgatggtgtgatgaagtgtaggctattagcaaggttccaaggtgctagctttttttttgggtagtggctttcctagtacttacggggtgtgcatagaccaaagatgagaatatttcattagccaatgcttataactaatcaaataatctgcacctgatatccaaaaagaaaataaaaatttaaagagaaggaaaaagaagaaacaactgaggttggaagaattctattatagaagcatacagtgtttgtctaggcaggaaggaaagtggtattggcacggaagatgtctccaaggaggtaacagctgaattggcccttgaagtatgaatagaaattcactagatggagaaggagggcaaaacattccaggaacagcatgtcagaaagcaaagcagcacaacagagcctggccttctcagagaacaggctcaggatggtcacaaccagaagtaggtgacagtggcaagaacagaagccagagagctggggagaaggatagggtgtggaagaccttatgagccctgtcaaggggtgtggaacttactcttgggcctcagggtgggaaaacagcaaaaggattatgcaggaggttgttattgtggatccccagaagattattataccaaaatgggaagtctcttggcttcacatatgcaaactattgataaaactgttgcatttggtggagggtagagaaggcaatgaggcaggcgctaaaaaatcatagcctcatgggcttcatggatgctaagtaaaaataggcaagggatggattataattatggttcaaaatcatagatacagtatgattgacagctctgagaataaagatggttatcaatttggtgggaaagtggggatagcaggaaaggttggataattctccaaagggcagttccaagaaaaattaaaaaccattaataaagaaatattagtagattcccttgatggcacctctggatttcttgtgtattgtctgcatcagccactcctcttctgccaaacccttagaatttgttctctcaattcgttctgttccatttagcaaagtgtactgtgcaactattattgaatgtcaggtagaatgttggatgctggaaatactaagatagataaaatacagctcatctcctcattaggattacatctgagcaggaatacaaaccatcaacaagtatcaataatatat

SEQ ID NO: 7081 - DNA, 2228 bp, artificial
  synthetic oligonucleotide
tttatatttgaaaatacctttatttgtcttcatctgtaaatgatattttagctgaaaatgaaaatctaggttgacaatgatttttcccttagcagtttgaagatttcactgtctctggcatctattgtagatgagaaatctgctttaagtttactactgtttttttttgaagataatttatctttttcattctagtagcttttaaaattttctctttatccataatgttctaaaatttcaatacaatttgtctaaaatttggatttatttttattcataccatttagagttggtgtgtcttttaatctgagtacttactaaccttatataattgccataatcctggaaaattctgttcctttgttttaaactccaattagttgtatgttgaagccttctctcagtcttgcttttaactggtctttcattttataactaggaatacaatgtactctttgtactcttttacaaattccacaagactatcttccaattcattaattttctctttgattaagtccaatctagaactgacttatttattgatttgtatattgctttactttcataattgtatttttatttccaagattgctaaatggggccaggcgtggtggctcacgcctgtaatcccagcgttttgggaggctgaggtggttggatcacgaggtcaggagattgagaccacaatgaaaccccatctgtactaaaaatacaaaaaattagctcagcggggtggcagtcacctgtagtcccacctacttgggaggctgaggcaggagaatggtgtgaacccggggggtggagcttgcagtgagctgagatcacaccactgcactccagcctgggtgacagagtgagactctgtctcaaaaaaaaaaaaaaaagaaaaaaaagattgctaaatggttcttcttcatttccacttattccagtttcattttagccactttgcctacttgcatttcataattttctattttttctctctctgtgtcatagtctttcttttgtctttttgaggatcctagatatactaatattaaagttattctcatactattatgttaatttcattttatctgaagaaaatttatttcctaattgttgatttcgtcagctgtcttaatgttcatttcttcatgtgtttggaaatttggttttcaggcttatttgagtgggagtttgatgtcagtatttttctttctttctttatgtggtcacttctttctgtctagcagttttggagttgcttccacgtgatccactgggaccccaggttttgtgttgcctgctcaaagctcccatttcatgatgacactgggatgtcaccaatccagtcacagagccatgagtagcttcaaccaggtcctagttataggatactcttactcccggtttaacctgtaattactgagcaccacctccttccctcgacttaaacctgattctcgattctgatttattgccaaagaggatcttagcttttgtttaattgctgctttgagtttctgctttctttatgtttcccagagattattttataatttttgaccttggctaggtttttaaaattttatcttaaaatatttgatctgtcatccctgttgatctattggaaaaaaataagtataatcttaattttattttatttccttgcctttattttcccttggcctattttctacatctatttagataaattattatatcaaatgagtttattcaaactacctccactctcccctggtttgatgagtagtacaaacaaataaatatagaaagataaataaataatacattatattccacctacagatttttgtggttggtaaggcatcaaatgtccctcacttgaaccccgtatttttgcttatcagaaccagatcttcagataacctttcaaaagtgattctgattaccctacctcttaggtccagtcctgcagtttgctgttggctgcagaacccctaccatttcattcccgtgatacaaatataaccactgtggcttttgatcttaccattttgactgtataaaaagaaaaaaatgatcattctttcaacagacatttgttgggtgatttactacatgtcaggcattatggtaggcactgtacttatacagatgaatgagatagatttctacctttgatgcaacccatgtctagttagaaaaaaaggcaaattagcaaacaattctacatggcatcataagtattatgacaa

SEQ ID NO: 7082 - DNA, 1680 bp, artificial
  synthetic oligonucleotide
aggatatttgctttctgaagacttctcagctttagaccagttttatatacacatatgtataaacatacacatacacatacatatacatgcctacatatttgtatgttttaataaaccaattcttacttgagctacttcaatagggtttctgtgctggcaaacaaagactcaaacactacccttttaagatctgtttcagttcaaggactgaccttcagaaaaagtctaaagaagctcacctgaaccaccacaaagcaactgcatcggttgggtcagtttgagggattctaactaaagaagaaacatgaatttcatgcagcttaatatgaactgacactcaagcacataccctctataggatttcacccatgactaacaagccttttaatcatggcagaagacacggagattttgcaaacatgcttttacagtacccacatttggtgttcctgaccctgttttcttgccagattgtgagaagcacctgctccttttcaaacagttgtcagatcaatatttaatcaattgccttttgatatttggtagcgctgaatgaatgggatgccaatatttctgctcagagctgttcctctggtgtacctcattcgttttctgtgaaagccttcaggaacctgtgaacactaagtggcatatcctccgagttctgtggctcctccctctactgcagaaggactctgtggctagaggaggcgcaagacgctggtgcctgtgctactcttattaaaatgacgtccaaactgagtcatgaaaggaggagagcagagccgcatttgggacactgggggagctttgccaggtgagggctatttaatagaccagacacattaaagaaaggcggtgatgtagtgaaaggagcctaatgagcagtagtgaggctaccgtatctaaagagaaaaaataatgagctgcgaaatatcccccaaggcgagattgccagccttctggaaggaggtctcagcctacaggtaaaaaggctcatgtggtcccttatccttgtatggtaaacagaagttttgtgggcaattagggactgagctgaatgtgagatttgaaaaccgagaactatgtctccgactctttggagatttccacacccaagaccccagctttaattcccaaaggaaacagggaacatactcaacctgtgaatagaaatgagaagcatcgtatcatcaaaaacaaccttcctggtgtctgtgcaacagacggacatctggaaatctcagttctagcaagctcagggactagcactacagaatctttataaaactgtccttaggggccatgccatagggctgccttgagggcaaaaccactttttaatgaggtcctcttggtctttcagtaatgactcctcctagaataagatccatgatcttatataagatcatgggtaaggcatgctcaacttggatcttattctaggaggggtcattactgaaatgctagggcagattttggtacatctaggtaggaaaaaattattaaactcaaagctttactacattactaatgcggaaaaaaaagatttggttcccaccatcaagaaatgtacaaacctataccacatagacaataaactattaacagagcaccttttcaagttcacatagtggaaaagaggatggtacccatgcttcccagatggggtaagagaca

SEQ ID NO: 7083 - DNA, 2130 bp, artificial
  synthetic oligonucleotide
cacagataaaaacaaactttgttaatacgaaataagatataaatcattatcagaatcacagaagctgggatgggcaagttcaatccactcattttatagatgaagaaacagattcagggagcagaagtgacttgcccaaggtctcccagcagctccttaaccaaaaataagcccaaagttcctaacccctggttcagggctcatttataacacccagcttctagaaatctttatggggttgcctgtctttttttgttgttttttttgaaacaaagtcttgctctgttgcccaggctggagtgcagtggctctatctcggctcactgcaacctccgcctcccgggttcaagcgattctcgtgcctcagcctcccgaatagctaggattagaggcgcccaccaccatgcctggctgatttctgtatttttagtagagaagaggtttcaccatgttggccaggctggtcttaaactcctgacctcaagtgatccactcgcctctgccccccaaagtgctgggattacaggtgtgagccactgtgcctggctgcctgtcttcttaaaagcaacttcaaactcaggcagattccaaattttctaaggcaaatttgtcttaagtacccctctctgtcggaagctcctgtccttagcagagttctgtcgctgccactgctcgccagcgccagtgaaaggccggccagccagagaggccttggagacatttgcatttgggtgaaaggagctgatggtcttggactcacagctgaaggttttctggggtggaaattaaagtggcagcaggaagcagaatgcgacctaattagcagtttggtctctgaggctgacctcctttcgggaaagctggcactcataggagcataaagcagctgttgcctcttccctgcctggccaggtgggctcagagcagtgccagcccagccgtcaccccatggcagatgccctcctggaaagaagtcttgcctcacccctcagctctccatctatggctccaagcagggttgtgaaaacgagcagtacgcccagcatgaaactccttaaaaaggagggaaggaagagagaagacaaaagcctttcatatctctggcgggggctggcggggaggcttaatgacttgaatggggctcaggaggtggagggagggggagcagagggctgcgctgtgggcagttgatgtgttcaccagcgtctcgcacctgttgttgtcttctgtgaccacacgtgcaggcaaccctgggagctccagctaaacaggcgaggagtgtaattaatccattgtttagcattattggagctcactgctgtgcggattcttcctggcagttctcccagcctgatggtggcggtggaggcagcagctcagcgagcaaggagggggtttggacggattgagatgtcaggtctggggaagggcaactacttattaaagaaggctcatgcctgagggtgaggggaggacaatgcccagctctcctccctggtggctcacttcccactgctaggaaataatgtctatctgtttggctcctgttgagaaagcccattttcctccttgttcctgggaggctggctgagctgtgagcacagtatggatgatgtttgcctagaggcctgggcctggtctctgtctcaaactgggctgcttcctactacctggcctcttgtctggtgcggtcggtggctttcacctgacataatgatccagcatcagcctacgtaggagtcttagcagcctccccaagggtaagagccaacactttgacagctcttactaagtgccaggcattgttctaagcactgggcatgtattactgcattgaattttcacaacaatcctacgagatgggtgctattcttatccctactttacagatgaggtaaaggaggcacagaaaggctaagtaacttacccaaagtagcacagctaataagaggtagaggtgtgattcagagtcttgctgcagaccttatgtgttcaactgttgcactgtacaacctcttcagctcacactcctagcaccagtgggacacaaagaacatttcctggtatttcaatccccatacctacctgccaggggacatttctatttctgccccatgagtccagatcatc

SEQ ID NO: 7084 - DNA, 693 bp, artificial
  synthetic oligonucleotide
tctgggtggaagtacagctgttcccagtctcctagagcccaggctggtgatccttccctgcaagggtagagcaaagcaagcaaggtatctgggggcagtatttaaggaggtacacactttcatgtttgtgcaagtgcagagttgacccttgagagtgagcacctccttaaatattgagttagtgtcagcctacagctgctgtcttccaagatgtaagggaaaatgttttcagtgttggtcttgctataaaacattctctttggatgaactatgattgcctttgctccagatacataatatttccagttgctcttgtttcgccaagactagaaatgaatagcatgtggaccaggacgggagagtaaggaggaacgcatctgaggatgcgtcaactcttgatcatgttctctgtaatttcaaggattttactcatgtgaccagatcacagtggcacagacagtctgtcccattacagagctgtactcagtgttctctctccattccctccggccagagatattttgtttcaggagatacttatttgaagtttcaggccacagggaaattattcatatcagatcttatccatggaattctttttgcctggctgttatgaaacatcatctgcaaaaaagtacaggagaatggctccctaattctagttcccttagtggggcttctcctacagttttc

SEQ ID NO: 7085 - DNA, 2204 bp, artificial
  synthetic oligonucleotide
ttgggaaatgatggaaaatgctgtaaaattagattgtggtgatggttgcacaactctataaatatgctaaaattaatagaattgctcacttttaaagggtgaattttattctatttaaattataaatcagtatatctaagaaatatctgcctgtcatgtttattgcagcactattcacaatagctaagatatggaatcaacctaggtatccagcaacagatgaatggataaagcaagcatggtgcatatacacaatggaatactattcagccataaaaatgaataaaatcctgtcattcacagcaacatggatgagcttgtaggacattatattaagtgaaataagtcagacacagatagacaactacatatgtgggagctaaagttgatcttatagaagtagacagtagaataatggttaccagaggtagggaaagggaggagagccggaggaataaggagaggttggttcaggaatatacacttacagctagacaggaggaataagttctagtgttttatagcactgtaggatgactatagttaacaataatttattgtacattttcagatcaagagaggattttgaatactcccgacagaaaaaatgacaaatgtttgtggtgatggaaatgctaattatcctgacttaatcattacacattgcatgcatgtattgaaacatcacactatacccccataaatatatacaattattgtgtcaattaaaaaataagcaaatttttaaaaatataacttaaaattgaatcattattcttaagaagaccttagtaagtatcagaactaggacccagggggagactgtggcttctgagaagaaccacctgtgcttttgtcctgcaatatgttgtgactttctatggaataaactcaaaatagttgttaatacagttaatacaactggcatgccacataggttacagatttgctggggcagtactgatctttacagcccttggggccactgcctggaacctggagggcagaaaatcctctttcaattgcttctggccaagaacatctttttttcatttgccctagtgcgtcaaacaaatattatacattttcttgggtcccataatgtgaaaagggctagaaagcactgccttagggaaatgccatatctattgaccttttctacatttcttaaccagagactgagccttgcaggggtgagaatggcactagaattctcgctattggcagatttggggctgtagtaaatcaaaggaagcgaggctgggtagctaggagagggtgccctgggtaaatgtgagggcagccagaaccaactgtgggaatcaacttggatgcttcctttaatcccacagagaaatatgtttactcacctggaaagcataaactgttgctaactggagcagaaaagtaatttccatttaaatatggcagaggaagaccagaacaacaagaagaggaaccttcatattaaagaaatagggtcacctgtgtctccattttcaaatatagaaaccacagtccaggagtaactccaagtgctctggaagccacctgggaggtgtagtgaaaatttagagtattttaggctctcctttaggccgattttaaaagccctttgccaggcgtctctaagcttatcttacttctatgacctacctgtctttggggaatgatacggtttggttgtatccccactcaaatctcatcttgaattgtagctcccataattcccatgtgttgtgggagggacctggtggaagataattgaatcatgtgggcagttgcctccatgctgttctttgtggtagacaataagtttcatgaggtctgatggctttataagaggtttcccctttcgcttggctcacattcgctctttacctgccaccatgtaagacgtgtcttttgacttctgccatgattgtgagggcctcctcagccacgtggaactgtgagtccaaaaagagattaaatatctttttcttcacaaattacccagtttcggatatgtctttatcagcagcatgaaagcggactaatacagggaatgttagactcctgagattgttatagatggagaatgtgtctcagaatttattacaatttgccaccaataatcctttctggtgccttagtttgggttctctagaagctgaccctgagacaatgaattgagtgtgagtaatttatttgggtggtgcaga

SEQ ID NO: 7086 - DNA, 1550 bp, artificial
  synthetic oligonucleotide
tttgtataatacatactgttttatgcatatgtgtttttcatttacataagtggtattatgctgtaaataccattctctttcttatattgttcactcaatactcttttcaaagatctacacatgttggtgtacatttagttttttcttctaactgcagcatagtgctctagggtgtgcatgaacatcagtttgctcatcggttcccctaataatggacacctagtttgcttctaactctctcgcctcacaagaacatccatatcactttacatacctctgcatgaacttttctcggccaaaatcccagaggtggcaccgctgggtcataaagcatctgcatattaattcttcgagatattgccaaattgctctcaaaacgcatgcctttagcaaagagttattgggcaccaaccacatacataccaggcactattctagccacaggagatttagccgtgaacaaagtcctgctctcaatgaacttagtcaagtgtaagagatagcaattaactcataaatgtataatgaaataacacaccgtgaaaggtgccatgaagaaaatagagcagggtaggggacagagagtaacaaagagtgctattttaggtaagaaagtcagggaaagcctctctgagagagggcccaatgaaatgaaagagtgagccatgtattggatctgggggagaacattccaggcaaaggaaacagcaaggcttggagatgggagcggattggttgagtgtgagccacagcaagagggcagcgtttggggtatttaagcaatggatttattgtctaattgatggtaatgctagtaaaatgcttagcgcagtgccaggtgccacttaagtgctcaattgtgacaaactattactattattggagcactgtgattagattggaggtttggaaaggtctttttcattgtagaagaaagaagggtgggagaattagaggccaatgagaggggctggggcatggactgcggaagtggagcttcagcttagcattgtttaaacagccctagaaatattgttttgtttgttttttcacaagtgttctttttaacaatgcttgagaactggttttggagccagaaattgagctgatagtcctcattcatcttcattgccttagttagtgaacccagagtatggtccttacagaagagggagttacttcaaggattaaggagatactcggaagagaagctggaccaaagtgtatcctttgctcattgggagtttagagtgaacagtatcttggcaggatgttgcagctaaatgcccaaatgatcagctaattacttgggtctgaacacagctgaacaaatccaccttcccaagacactgccagaggtttgagcaacttcattctggctggatttcagcaccacacaccaaggactagatgactgggccaggagggacatttttcactttcccacttccttctgttaaaaaaaaaaatactacagtacaatcaattttcctactgacagatttgatagcagttatagaaaatataaagagatattcagcctcactaga

SEQ ID NO: 7087 - DNA, 1776 bp, artificial
  synthetic oligonucleotide
tttcctgttgagggcaaacctgtaagatatagggtaaggagagaccggctactttcttcatttccttttcaacttaaatgtcagccatctgacttcttgtttttgaatcactggacaatttgagattttgaacttcccatctctatcttccccagcagatgcatcttgttcttaagaaaactacagcttaacatgctgttgactttttgaagtttgggaaaattctctggtgatatatttgcttaccgaatattagccatttacttaccaagagatgcaggacctgagaagtttatatcccctggcaattgaaggtcagtcagtgaagacaaagaaccattgaagccttaatccaaatcagtggaaagctaaaatttgatttataatatttccatttctcttgaattttccaggaatgttggtaaatgtgaaacaacttggcttcagttttactggttaaaatgtaggttttggagataaatgactgggttcaggaactaagtgacattgggcaagttacttaatctttctgtgcctcagtttttcacctataaaataaagataacaatactatctcctctagggtcatatggggatacaaaaaagtatataaagtatttagtaagatgattttggctacaagtgacagggatcctgagtcaaaatggcttaaacaattaggaaatatgttatctcacatagtccagtgacaaaagagagctctagatgtgacccaatcaggcctccagcccatatctgtcagccattctcttggcttagccttcttcaggctggacctcatggaaacaagatggctgctggcagcaacaggagcagtgggattgcttattcatagccagtggaagagagagagaagccactcccaaatatgaaaacaaatttttcccctcaatctctttgggccaaccttgaatcaattactattgccagaggaatactcacatggtgactggtttcagtttgggtatgtgaactagtcaggggaaaagaggaatggattatggtgcttgattcacatgagtcaggattcattgttcttgctgggggtaggggttgccttcccctaagtcacatgatctaggtggagaaagtgtaattactcaagcaacatcaagatctcattagaaagcagtaatagatttgaagaaggcactcaacagtggtgaccagagctggccgaaagtaagtgctcaataattgtcagcttattttggaattctatttttgcgtccataggaatttttgtagcagccagttgtggttttatgataagacaactaatacttggcctttagcattccctaaaagacaaatttgggaactcggagatgacaaattgtttgcattggaagcttctctttcctcttcttttttggaaattaacctggaaaacaagctccaaggacctgtgaagactaggaaggtctcagttcagttccttatgtcattgccaccttgaaaagacaaagttgatagtgcacagcaatttttcctctccttatgccaagcaatattttctatgaaaaatattatacttcaacaatttttgtgcaaaatgctggcactctgtggtggacatctctttgcctttttatttgctttatttattatttctacctttccttcttctctacctaacagaacctctatttttatggcaaacctattctatattatttggatgaggctgaccttatctacacacgtgcatgcacttgaccaatcaaagcacatcatcctttctttggagagagt

SEQ ID NO: 7088 - DNA, 1466 bp, artificial
  synthetic oligonucleotide
tgaaaaaactactctgctatcgtattagttagcttgggctaacataacgaaataccacagtctgggtggttgaaacagagaaatgcattttcccacagttctggaagctaaaagtccaaaatcaaggtgtcagcaggtttgattccacctgaggcctctctccttggcttgcagatggccaccttctccctgtgtccccacatggtctttcctctgtgcatgcacacccctggtgtctctctgtgtgtccaaatcctctcctcttataaggacacctcttgccaaccttggattaagccaaccataacggcctcatatgaatttaattacctctttaaaaaagaccctatctgcaaatacagtcacattctgaggtacaagtactgggggttagggtttcagcatatgaagcttaggggtacacaatatacaattctgcccataacaggaatgtagaaataaaaataaatgaggcatttatgaaggggcagtaggaactgccaagttctcgcctcttttcagtaactgcaagagagaaactatacccaagttgaaagagattgtgcaaaaagcactggggatcagtcagctagggagaggtacagcgccccctgttggcacgctggcctctgtttaggaaaccaccttggctcaccctctaaattgcctttcctgttgttattcttccctaggtttagaaacactttcttctttcagcttcatgagagagaacagtctttggcactggcaccagagtggccgcccgaggcagcccttgcctccgccttcgaggatgtttctttccccagaaaaaagcgaagacccttcaacctccccattcatcatcactacgggcaatctaattacagccttgtcttaatgaggaactcatttacaattgagacttcttccttatgaaaatgtaacatcttgaactatgtttttatggcccctttttacaaaaataagaaaggaaattaattaatttccttgtacacaggaaagactcatgaggtcttgccggttgtgcgcagaaaggatgtgcgctctctttctctctcactctctctttctctctctctctctctctctctctctgggcctcctgctgtgtgacagtgaaatgctaaaatgattttggcaggagaatattctcaaaggctgtttttatttcagcagcagaagagtatctcagaacgcaggctgcacctctgccctgtggggctgtttctaattgcatgaggtgagctgcagaagtccttcccccagccggatggggagaaagtggtaagaaacctaaggaagataatcgtgtctgccacactcagcgctcgccacttaaaggaattaacttgttggaatgaaatatttctatggatgcagaaaactatgcattagaataatgagactaaccccttcttacgcattgcaatcactggggtttgtttcttccctctctaatcata

SEQ ID NO: 7089 - DNA, 1556 bp, artificial
  synthetic oligonucleotide
gtattaaataaatatttactgcactcctgctggatgccaggccctgtgctcactggggagttactatgggcctctggagctggacaggccagatttgccatttgctagtgctatcttgtgcaaagctgtaagtgctctgaagtcatatttcttcacctctacaatgggataattgcatcagtttcctaagattgtcatgagaatcgagtgagagaatgtgtattgagctcaggccagaggcataagggccctccataaacactggggctgaaatgacgagtttcccttctctttcccttcccttttccccacatttcctgtcatgcatggggtcctctcacatcttctccaccagccctgacctgcagctcacatgtgctggctcaggccccgatttcatatctcctctgcccacctacttgtccccacttgtgggactgccccatccctccctgcatgggcagggtggggacagggatttcctcctagggcccctcccaggcagcttagctggtctgtgggtcttgcactccagctgccttcatgccaacccagggctgtttgagtcatgagaaggagattccccaacaccacgcttgctccaatcacagcgaagcccactaattgattcatgttattttattttctatactggtggttagggcctcaagcaattttatgcaaatttatgaaccttatgcaaatgagggcatccctagactaattgcacacaaatggaagctttgcgggcacctcccccattcaagtgtgccctgattccttctcatcccttaaatgattcccaaagttccccatcaccaaatgtccctaagatcagcagcctcgtctcctccctgcctccccaccccacaggcttctcagtggctgtttggggattttgagggacagtgtcagccttgtttgcaaaagctcacggctgccttatgtcccaggaaaccatagcctgggggaaaagccccctagcttattttaaaattcatttgaatcccacccagctccctcttccaatcctcctaggggaggtgtgactagcccagaacagcctaggacctgccagaagctcacatagttggcccatctaggttggggcaaagctgtgtgtggcccctccacttccaaaaggcccactcctcaatcttaggcccatccttggtcccagctgtctgacaactaattctcaggaaggggctgtcttaggtccggttccctagagacagacagagtgcaagataggaattgagcaggaagctctggagtgtgagagcaccacacagttaactaccttgaggaaaggtgatgagtttttgtatttccccttcccctttgacaggcaatggctgccagtagccccagggggcaggatagtaacctctggagcattttcagggcaagagggctcccatcttgcaaagaggtcagccaacattcagcagctgggggatgggtgtgccagcccaggtgagggaccagcagcatctcctagaggcatatttgtttgtttaacttgatttaacttcaacatccctgtaaagcag

SEQ ID NO: 7090 - DNA, 4782 bp, artificial
  synthetic oligonucleotide
gagaacagggactctgctggaaagagagagctagaactaaggctccctaggacttattacttacgttggaccaagcctccagtgaggcttcaattgaccaccaggccacagttgacccactctcctcctgagtacttttccccatgcaagacaactggctaaggagtataaggagtataattgtaagcaccgtaatcaatattgcaatagcacttaccatgtgtctgacattgtgctaagtttctccattttacagatgaggaaactgaggcacactgaacttaactcacacagctggcaagttgtagtgccagaattcaaatgcaggaggtttggcttcagaatctggacccttaaccactacactgatggcctcttcatgcttagtgttttactatttaagatactccaagaggctcagagaatgggtgagaagatgatctgagaccattttttcaagacagcagccacggagacagccccatttccctgggggaaagtggccacaaagatgggagtttctcgctaactttgccctgcattggtgggctgtgtgcctgggggttcttgtgtctctggtcctgcctggtggttctggccacaccccaacccactagaaacctattttcccaggaacaggaagaaaaaaatgtgcatttcttctttccctggcacttgtcctgggagtcaccccatacacagacacctctgtattaatcttatacactgccctccccaccttttccatccctgtgaatgccagtgtaacctacaaccactgctactctttgcactattgcccctgtgacataacaattggcaagagtcaggaggggtttggctttactgcaagagaaggaagcatatcaccagtatgtccttcatggtctcctatgaatgaggccaagaactgacagcttccaagatcccttctatttcaggcaccagtgacaatagcagccatttgttgaggacttattctatgccagactcttgacaaacagtattgctcatcctctcagcaccggtgaaagacaagtatccttatcctcactttggaaataggaaaactgagatgtagagaagttaagtaatcttgtggttcaaggtcacacaggaggccagctggacccccaaacttctactttccccacatcatgttttcctgctgggtctcaaggggaaatttgatgtctgccctcttaccacctcccactccgcgcccgcccccaaccctcagcagaggcactgtgtctcccagagccctcctcactgctcctccccaccttctcttgctccttcttccttgctttttcaaaatgtccagctccacttccacctgccaccagcccagctaaagcctgaacatgaaggtggagcaattgggatgtagagggaaccatgcctttccccacctctccaggtcctgactcaattagcgttacctatctctgctgtaacggaagcaaaatctaagagctgaggacacagccagaacatgcgcgtgagtgtgtgtgggagtgagcatgcatgtgggagcaagtgtgcctgtgcaagtatgtgtgtgagcaggagtgagtgtgcatgtgggggtgtgtgtctggttgtggtgtgtgcctgcacacccagcaatatctatgacaagggacaggggaaactttagtaggttaggaaaggggtattcctgaaggatagagccatcaagatgggtagctaagatgtgtgcttgccccagcttcaggggcccatttgtctttcacttgctccatcagaactgagaagtgaggctctgggtcgccttcacattggaggagtattttgtccacttggggtattaaaaggtggctgggctgaaaaggaaggtggggatgaccgggaggactgctggaggcagaagcctgctgctggcagctctgggtagtgggagggaagttagaccattctgatctaggaatcatgaggaatggcaggcttccctccactaccccagggtgggcctccatcacctttgacttctgggcccttggagaaagaagggcatgggggtcgaggggatggtggaaggtggggattgataagaggacatgaagtggcagcttgagctctaaatgaaggctttggcttcgacttctcagctggttgcatcagcataaaattgagaaaaggtgaggtagaagggccggttgtcacatcctagaaggacccaaattgcataagtgctagttcccaaaggccttgggaaatctctctgtgtggtccaacccccactcccatcccatcccaccctgccccctgatccctgctgacaaggctgtaccaagccttcgatcctgcgcgggcctgggccataggcagcattctcattatgagggctgccttctgcaatgcgggggcaagtctcctcctcctgctggagtgctgagaaatgaggcccaggacacatcaatctgtttcacggcatagttctgtgctaagaacaggcagcttctgataggtaacccaccagcaatgggcaaaatgactctctgatgcaaaggcttgggtattgcagacatatgcttcccaaagacatagactgaggcatgcatctctatcacttcaactttgctctgcctcagcacaaacactggagttattaggggaactataatctgacaactgagtggcctctgcatgtcccctcaccaggaagagaagaaagtgggggatatctgtatcggagatttctgctcactccctgagagagcttttctggagcttcctatggctgggtccctgtggaatttctgtaagtcaggagtgcttcctgggcctttgtcccacccacctttaacctgcaggggcatgctttactagaaaaaacttttgctgctgctgctgctgctgctcagggatttttttaaggtagcacctcctcaatccccatttactggaaggaggagagatggagtcccaaatgaaaatgctccctgcatcttcctctcatcccggacagggagtgttcctccaggaagggtgagtcagcctccccaagggcctgcctcctttaggccccttatgactccagcttctgaggggaattagaacgaaattcaaatggtattgaggtatccagggtgaacaaggctgcttcttgtccctccttccgctggaggggcttcagagcctgactggaacacctgcgtgtccgtgaggtccttcaggaggcttctggaatgggctcacttgtactgtgcacatcagcatccctcagcatgaacctcaagcttgttgcagccaccgtattgggaattaacctcagcacactgggaagagggggaagtgtttcttcatcattggcttttctggctgaggatgctgttttagctttggctgcatcttttatgttgccacctgaggcatttagctcatctctgggctctcctaaactgacagaatgcagacaggttactcagaagcatcagcacagaaaccacagaatctcactggctgtgactacaagcctcttgccttctgacccgcggttggccacacttcctgcctgccaggtcaggccgggcagccagctgaaggctgacctgcttgcagaactctggcctctggtctgcaggagttagcaaggcgccatttccatattctctggcaataactaattagcgattataaagctctttgaaatatgaagtgctgcatgataatatctgtaatgagactgattctttccctcttgcaagagggaggggggagtaggttgtacacccattaaggggagttgggtgggaaggctgcttccttttcctgacctgcctcagtgtcctggacctgatcaagtgactctggtgagaggacttgagccctggtgactggacttggaaagcctcccaacggcaaaggagcactttgacacctgtactcctccaatctcctatccccctctccatcagctgcttaccagctgctgacttaccctcccctgtgtgggggatgtgggggatgaggatgatggatggaaagagcagaagagaaaggtggagttagggtaaggagaaccagttgggctcgtggtatccttaatgtgatttagaatttcatattaatatatcacctcggaaaaaaattaatgagaaacgtgaagaaaataggataatgaatatgataatatatggggagtgctttgggcttcttggaacaaaggtgcaaggaattattgctgcgattttctcacggtgcatatatatttttattaaactctaaaaaaaaatgccagtagattcacttctttgcaaggtattaacgccccgcagaggagtcgttcttcaattagttccctgagcctcggcccacctcttggctgttttctcatggctcttctcgagacttccagcttaagggacccaaagagcagattagaatgctcggtgactgtgcccagtagagtatctggcacacacgtgcctggggagatggcttcctgagcaagtagggctcaggagaggggcaggggacggggaggagtgaatacaaaacagatgggtgaaaacttggggtagctgcaggataagagcgacttactcatctccagactactgacctctctcttctacccaaggatccacttaggccagactttttttaatatataaattaaatataattaaatataaattcccagttgaaaggggacttcgtgtggccaccttgctgagggaccacagagactagaactgagagaaggatgacaatctcagtctatttgtcacttccctataccagtggccttca

SEQ ID NO: 7091 - DNA, 2066 bp, artificial
  synthetic oligonucleotide
gacagacattttctatttctccttatacatgggaaaaatccaacaccctaggggatcttacatgttgtgacagttaactttgcatgtcaacttgactgggctaaagtatgcccaggtaactggtgaaacagttatttctggttgtgtctgagagggtatttctggaagagattaatattttaatcagtagaccaagtaaagatctgcccttgccaatatgggcaggcatcatccaatccattgaaggctaaaatagaacaaaaatgcagaggaagagcaaatttgctgtctcttgttgagttgggacatccatcttctactgacctttgacattggtgttccaggttctcaaactttcggacttggatggagacttacacaccattggttctccagttctcagccttttggacttggactggaactataccattggctttcctgggcattcaacttgcagattacagatcatgggacttctcagccctccaaatcatataagccaatgagtcataacaaatctccttcttctttctttctttctttctttctttctttctttctttctttctttctttctttctttcttctttctttctttctctctttccttgtttttctttctttctttctctttctttctttctctttctttctttccttctttctttctctctctctctctatatatatatatcagatcatgggacttctcagccccccaaatcatacatatacatacacacacacatatatatatagttctgtttttccagagatccctgactgatacatgtgtttttgccatttgtgtataacagatatttacttaagttgctgtgaccaaattcccaattcctgaaagagaacatcaataggcacatcttaggtcagttgtacttttatggtccctttaagagaggaagcaaatggggttatggagctggctgtccactcagaagggacttttttgagaagaagatatggcaaatgcaggcaaagtaaccaagaagtttcttgaagtgccctcaagaagcttgctatttatttgactttgctgagaagaaaggaatctggaatttagtgcattttactggcacattcttagctggaggactgggagtagactagagagagctgtgcactgaggcctagctgagtgtcttcttgaaaacccctaatctttgctaggcttcaggttcctcacctatgagataagcaattggacctcgggtgagctctactggctctcctaccttcaaaattctgtgactctaagggaatgagaaagcagaggtgacatctccagatgtcctcatggaaatgtggtgcctatcattgtgtgaccagatagtcaaggtctccagcatgtgctggaggtgctcagggctgtgagatccctggccaacactaagatcagtagtattgatcttgaggacaatcaaaccacgatgccccaacttttagaaaaaagaatgtatttgtgggcaaagattcagatacactgaactttagaagctctcagtggccttgagccttatacagttgaaggctacctggagaatttacaaggcggaacattttaaaaatagaaaaaccaattttatccccaaggctgtgctgtcttcttgcagaaggttgttgggatgaacacagttgcttttcgaataatgggctggggcgcacccacatgtgatattggtctcatgcacccaccttcccacttcctcttacacacacacacatgcacacaccatctcctgagagtcttaatctcaataatctctcttcaggctttctctcagccactcagagttcagcctgctactgacatcaccatatccggagagaagcaccaatcagcctgcttcttgccttgtgttatttgcatgtcaccaccttattccagtgttggtggagattttggtttttgttttattaatttcaatgtagaaacactttcctccccttggcatttctaatagctggaaggagaaatgggtggaaataattacctctgctcatttcatgcctgaactagaagaatgtgtgactcaggtctggaa

SEQ ID NO: 7092 - DNA, 1520 bp, artificial
  synthetic oligonucleotide
tttcctgttagaatttattcttattagaagccgtggctggtctatgggccagtgatttcaaagccactaaattcaagctaagattgacagtgaagtgtttcaccaagtaagtttcattcagaaaagggaaattatgcagcaaacttcaaatgagaaaacttgataaatgaaccaaattctaagttgatgaggccaactagaatgtaggtaagttgtcaactgaaatatttcaccctttatttatctttggctgaagatattagaacaacactttggggtcacccagatttaggacacgaagtagatgctttcgataggccaggcttgaatttggatttaaaagtccatactgcttttggtttttctaagacttgcttactagaaaaaaattctatgaaagccctgatgtaacaatcaccttgacaaatttacttatactgctggaatgctttagttaatgcaatgggatttttaaacaggagaaagaaagcaccatcatattcacccttgggcttaacagattaacatgactcagtaaaccatccatgcagttacttgttcatttattaaatatttgttgaaaacctactataagataaacactgtgctggggatacaaggataaaggtgacacagctggcctcaagaaacttacagtctagtgaggcacatagacaagtagagagaattacaatgctagatctgaagagcttggacatatcagtcacaaaggaggccatgctaagtcatccggctgtcctgtagtagaactgagttggctgtgtatcatatcccatcaactctctgataatactgtccagatgccatgacctcataagcagatgactcttatgctgtatgtcagtttcctttgagtgaatgtttcagtaattatgttgtattctgttaaggctcatcatttgagatcagcaaagtaagacatcttcatgggcaagaaagatgatcttttctgaaacccaaggtcattcccagaagggtgagtccttagatagggacccagaactcaaggagaagcctcaggcatgtaagagaaagcttagcctctcctttgccttaagcttggtagtatccagacatctaacatatgatgctgggaggggggttttaaaggccagaaaaaaagcaagaaatcaaataaaacagaaatcaaagaaggatttcttctttttcctgggtcctacatggatgggaaaagatgagtgagcttcagaaagcaatgcatgctttgagggcgagactgtgctgcttcatgatactctgtgtttacagccctttgagcagcctccagcccagtgctcatctaggagttgtcaggaaccacctgtgtcagattattctggagcactgggtaaacatatacattcttaagttccacctcagattcacacctctcaatcataatggagagggagttgtaatgtgcattttagtaggtccccttaagtttgagatttcctggtcttgacttcattgaggtctttgtgaagtttaatatggtc

SEQ ID NO: 7093 - DNA, 1060 bp, artificial
  synthetic oligonucleotide
cagagagagccttcacacatgatgcaggtctaattctgtagaaggaagggtaactgggaaagtctgacttcagtgcatgtctaagaaagttttggcaaaactaatgaggagtccttgggccaaaggggcagatcagaggaatcctgcatctcccattgaggcgcctgccctagtgtccctgctgtgctcactcatggctgagagcagctggtggagggtgtggcttcaatgtgataatggatttcagagtgcagccacaggtcagttacactcctgccagtaagaggtctgagaagggcattcttgtggctgccacaatctccctattgcaatcatcttctatcagacacacaccatcactgcttttcactgaagattttatcaccaggaacactatctttctctccaccactacaaatttcttaactctttgtcatttcaacaaacacctagagagaccttccaacattgtgacctctcattgccttgacatcctcactttctgtggtctttatcatctccatctcagctacctattgccaaggtggcattaacaaaactgctccattcccaagccttagtttccagcttcccatattcccacctcatatcatcccagctctctttctctagtgttctgaagccaatcaatcttgggcccctttaggtccccagtcccgccattgcaccaacttttcactgcatcttacctcctttactctctccttattctcctatttcaccttagagtccacagcccattcccataaccacttcttgcacatattgtcaattccttgtacattctctcaactccattattttgcttgcccttgttaagcaagctggtgaaaaacactcaaccatttctgaccggtctcacttgaaatttatgatggcagacctctagtgggacctcagtgcagccaagcaatcttatcgcatttccccagtcaattctctctcctcattctctgagatgactatttcatactttttcacctttactctaacctccaacaattcctcccccttccttcttctcagctgatgaccttct

SEQ ID NO: 7094 - DNA, 3431 bp, artificial
  synthetic oligonucleotide
tgggctggctcagacagcagtattatgtggagagtggctgaaagcaccccaggaggacaaatgtgagatgggaccaaggagggaaggcaggcattggaattggacacataggtctgatgggagggtgaaaggccatgggtcatgagcacaggcactgagaggaacagggaaggtgggagacgggcgtgggacagctcaagggagcaaagatctagggtgactaagaacacaggcagaccttggatctctttgggactagcagacttcagttcaaatctgactctgccacagggatgtgatccaagcctcagttttattttccataaaactggtcaatatctctatcatgggattgttatggagagaaaacaaggtcacctttttttttttttttaacatgcttgaggctgtgaactgtgcagggtgctgtaaggatgtatgtatgtagttccacaaatttggtgctcggggaggagcagcccgccaggttaaagggaatacgcaaaagtagatgctaagcttatttatgaaacagcttctttggccttttggtgaacctagagaacaatttacttctggcaaggcaaaactgtgatgagaaaaagattccgggctttgtgagctgtttggggcagctccctgggaaaggaggccccttgactctcttgagcagtagacacctggctttggccctgccctaccctgccaagggtgataaatgtgggtcaggccctacagaggtcaggcttcttctctcttgaggcagttagggaagaggaacttgcaggaaatgaagtaagaagggctctatggggttaaagggactggggaggcatggcaggcaaaacacagaggggattggggatgggagagtttatacagtgcacgacctacacagctatatagaggagcccaggagtggggatgtgagaatcaacagaattaattagagcagagaaaggcaacaggcagggcagcagagagaagaacacaggggacggctgttccaggtttgatttcatgtgcagtccaaagagaactgaaaggctgttgcctttgttgttctttcttctgctgaatagtctatcataaatgaaaaagcacaatccacgggctatctgcttgtcccaaaagaaggaaaagagaagatgagttagtatccccaggagagggacttatcaaacaagcttgctgtcccctccccacttctctccatcccccaccctgcatggggatgaaggaaaggtgagaatgctcctttctttttctggagctacaagaagagattctctcttctactggatggtaaagggcaaatacaggaggctctgctactcctgggctacctacaacccccacaggaaggcctgtgagcacttcagcatagatagggtgggtcgagttcctctgaactacattgtactgtgctggttgcagagcaaggcccagaatggggtgagggcatgggtaggaagcctggtagaagaaatgtttacctaagaacccgttgtaccatgagagagatcatggcagcccagggttggaggttcttaggcagttgtttcattaagctcttaggcagtggctctgacatgaaagaaaggtgcccatcctggcaccaagtatctgtcaataggcacttttttttttctttttggtaaagatggaggtctcaatatgttgctcaggctggtctcggactcctggccccatgccatcctcctgtctcacccaaagtgctgggattacaggcatgagccaccgcacctggccaataagcatttgttcaacgaacgaatggatgctggatgagagcagaggggtagctaggagcacagcacagtgagtgtgccaccctgtaacagtgagtaactgacctaagaaggaagaatgtggggcccctgatggatacaaggctctgactctggagagatggagaactgagccgagaggagcaagctatgcacgagatgagtggatgaaggacagtcacatctgaacaggaactgaggaggggggctagggcaggctcacataggaccatcctgttgcggccaaggagagaacttcaagccagagttccagaaatttcactgaggtaaccagagccagtgactattcttggtactgttactggggccttttcttattcacactccagcatcatggggggaaaaaatagattatttgagaaactcagtttattcagtttcctcagtctgaggtatgtctttttttaatgttcaacttactttgattagaactccccatcttgcaatgtctcttctctagcacctgctgctacccttccttctctctctgcatcccataatgagtccaagtgctgccagagcacacttgctcaaggagtcaaaaaaattgagaaaatcttttccagccatggtctcattatcatcattcaccaaatggtccttgtgttcctaggcaacatgttccagaatcttaacagaagcttggtttggaacagccagactggaagccgcccaatatacatcaaaaagggcatggatagatggatcagcatatattcatacaatgaagtactacaaagcaaggaaaatgaacagcaacatggatggatctcacaaatgtaatattgagcaaaagaagccagatgcaagagtccagatcacataagttcatttacgtgtctatttcaaaagcaggcaagaggaaggtgtggtgttagaaattaagatgtgtacagtggaagaaatgggcataataagaagagggcatgaaggaggcttctagggtgcttgttttgctttatgtcttgacccaggtggtgcttgacacagatggggcttgtgtggtcattaagtgagcttctgcatatgtgtgttttaattcataataaaaaagtttaaagtccataacgccatcacccaggaaacagggaaatgctggtggtacacagtctaagtccaactttgttccatgctgtggaactaggcatgcaactccaagatttacacttgtctgtggtagtcccagaccacagtagaactgggctcctgggttttcttttgtttctaaacatctgttttctagatgccctcctaggcaactttccaaggacacaccagctcagcaatgcaccctctcttttcctcttcatgcatgaacaccaggcttcttgcttggcaacatcatgctcctcagtccctcagggatggtctaaaacccccagaaagaaggtgtcaagattactatcccatttttcttacaagatctcttgctcctatgtacatttgccctaaccttccctagaaaatatcaagttcctcctccctgagcttcatggagggacagtctttgacaagccttctccatagcgagggttctacttgccttgtacccacaaaacaaaaacgtccagcatcagtgatgggctcttcataaacaga

SEQ ID NO: 7095 - DNA, 820 bp, artificial
  synthetic oligonucleotide
aatgaagctcttggtaagagccaggaaaagtcatttagttaagcaagagcatccagttcatgggcttccaggatggttagccttaagccaaagacccatgttgaaccagcaagaatgcaaaacctttgtagcaagccaatttctcttagccagggaggcatgcctccacgtagaggagcatggccacataagtacaaggagatttgtcatccaattgaaaagtgttgtaatccaagtaatttatttccaaagttaggaggacttcaagttcagcctaatatcatcaactcacaaaacacactcccttatcacacacactcatacctgctttctcagaccatataaaaatagggcctgcaggcctcagcttcctttctccatctgtccactcctcaccataccacaattctcctttcacaaccctaggttctcaagtatttcctagatgatcagtgggaggcctgtgcccctttccttgatgtgaatctctttactcacctcctaccaacagcctcctttcatccaggaattggtaagaatatgactggtgaatccatttgtagaaatgcagttgctcattgtattagttaaagtaaagccagaacgagcctaacacaatggaagtgtttttttgtttgtttgttttttttcaggtaaagtacacttggtggaagaagcagggacttttcttcacacagtcactgaggtgttcaaacctatggagagctctgcctctctgacagtagaaattctaattccattagttcagggtgggatgtgtgcacagaattttgttttaagtatcctggtgtctctcttg

SEQ ID NO: 7096 - DNA, 1217 bp, artificial
  synthetic oligonucleotide
ttgtgacttcaaaactcctgacttttacaagttcctgcttgcctctagtccagccccgacattgtactcctgtcttcaactgtgtgtaccctaagtccttgccttaattttctacctatttctcttgtgcttccaagtctgtagccttatctttagggccagcctatcccttccctctttctagaaatcaaataggaggcaacagcacctttcagaaaacaagaatggaatctcaaagtcccaacctctttatacttttcccatgatcagtctgcaacattaagacaagggaaagtttgagcaaggcaaatggcatgatctggacgtggcaggaaaaaaatgggacagactccgttccagtgctttgaaaatctgttggttgtaagatctggagaaggaactcaagttccaataaatgtcactgaacaaattgtacgatgtatggagctgcctaatgtttcatctgtttggatgaaatggttgtctttaaataagctaggtgcaaagtttctaataaccactgtttttcagcatgtctcagagctcatgttgttaatcaagcaaggttagcttatttttattgagtaaaggatgtgttaagaaaggaatggttttgcattttaagcaaaatggatgaataatgaatgaattttaagtaaataaataaaacctttaagtgactgtttctctttcagagaagtcattgatggaagctatgtactgattatgatgatgctgtcattactctcaacattccttcaattcctactgtgaaaggcaaccctctttaggttgtacaaattctagtttggtggctaattaagccatgatactagtttgagattttttaaaatcttcattctcatctctccctctcctagtgtttgaggactgatcattcctgatcttagtaacagagtaattcatgttggcaggtgtcatttaagccctcgtagcttgtaacttcctgacacaatttggagttagcccattctggcattctcctgctggatatcacctacattcttaaatcttaatgatgtaaaattattctacatttttaatgatccgttggagctgtttcctccaaaccattagcaatacaagaggtatataggaatttgacttatttacaaactctgtactattctttctaaacagtttccaaggaatacaaatgcactacatattggttactaaaaactgtttgggaattg

SEQ ID NO: 7097 - DNA, 3144 bp, artificial
  synthetic oligonucleotide
aaaaatgtgactgaagggacaattgggcaatttcccacaaagacctgccatgttccctagaaactagaaggctgcaaaagaatggctttctccacctcttgcctcataactagggggggttaatattgggtgagtggactctgtcaatttggatggggaaaaatcatatttatttgcactaacctctgactgcagtttagcatgtccatagttgtattagtgatatctatgagtttatcacaaagagaaatcatagatattttttcatcacgttatagttgttgcagatatcttgaaatatgctcagcactatatggaaattatagtagttattagacttgccagtagatcatatttaatgcattagtaaatgtgcatttatcacatatctggctttttttattactgtatttcaacatcattagtttcttttgtgattctctgtattttatttcatgtgcttaagactattattctgagaaaaggtctataggctttaccagatgccaaaggggttcaatggcatggcaaaggttaagactcacccctaaataagttttatcagtacttctttaagtcacaaggattggtgagaaaatgcactattagactttccattgcaccatcctcactggccaagaaggagttaaatggtgtccccagcactgtattgtcatccagctggtgctggtgccaaagcggctagtgcctgtccttcctgtagggacaagggaggagaggagcaaaggaaaggaaggaaagaggagggaaaaggagaaaagaaatgaaaagataatttctcctgctttttcacatcactgaattgaactttgcttttaataaaagcattattaaatagaaatggcattctcattattttgcatttaggtgatattcagaaacatggtcccagtaattatttgtgctgggcagggccagcacattctcttttcctgagtacagttgaaccagcatgtcttcttccagggcagcctttcccaaggctatggagagatgtaaacagtctctactgtttctccccacttacatccatgaaaccaataggcacccttaatcaggcccagagttcacacactgggcatgtggtacctgacacttgatatagagaaatatttcacctccataatttataatgttttcatcagaaggcatcccagaaataaaggctctcttctttatacacatcacagctaatcagaccagtgcttagttttggttctccctgaggcacaccactacacagcattcaagtgtagctagtttatttgggaaatgcaggaaatacctggaaggacatggagcagtgagacagggaagggagggcagacaatgacaggtgcattatcaatccaggtaccacagtgggtgactgggtctcgatctcctggggaagctctgggaaagggtgtagagcatgtgcctcagagttatcccatctaaggggtgagggaggtggggtatttatacatgaacccccatagtcacttcttgtgagctgcttccaggggatattacttcctcagtgcttccagctttcacaaggaaagccacttttcacagttttgaaaatatccttgggcatagatctgcagacactggctgttgagggttagagggagccaactgaattgggaaagagggaggggcactggtggggtgctgatggcatctgctactgacctaatgttggtaagccatctgctgctctccagtgtaacaacctcttcacctctccccatctcagtttctccatctctgcaagaggccaaggctcttcaaaagttgcaaaccaaagccctgagaaccaaatgaggtacttgggtggattttgtgtggccttcatggcttttaaaaaatttttaaattgaatcaacttctcaaaatcacgaacttttgcatgaaaacatgactatttatgttctctagaaaaatatttggcaacactagaccccaaactagatgatccccaatgccatatggttctgagaatctagacgttcctctttcctgccaaagtaaaatggtttaagggaaacctttcacggcttgtgggcagattctctcctgtccctgttttctgaaaggtttttggttcagagtgtttttgtttgtttattttgtgcgtggtttgggggttttgtggttgtgatttttgtataggacaatgcaattttctgccttttcacatagctgaggagtggggaatttttggttttaaaaaatccaggtagcctcagcctgccctgccagggttttagagccagtatgttgtagcatcagctggcaagccggctgcttgcagggaaggcccagccatctgttcccggagacggtgagagagccatcttccttcctccacacctgccctgaaacacaggcccagagacattttataacccagaaacagctcttgtctgtgccaaatataggacctcaaattcctctgctctttcctgtattctccattggctccttgttggttatctccagctcaaagaatctctccagctaccgggttccagccaaatgccagaggccaccaactgtgcctatcaacagaagtgggagtcaagggctctcagccccgttgctgagctgccctgggagtcagcagctgatgacacgggctgtcccctgattgccaatctagatggcgctttgaaacatcccatccccggtgatcccctcaaaggcagctgtgattagtttagtctccgaagtctttgagaaaaacctcagtgactttgaataataataagaaagcccacctaaaagcatagaaagtctgaatccaagggtctttttgaacaaaatgaagttttattcatttcacatgcatgaaataagggctaacaggatggtcaaggagcaactttgacttaatgaatggataagaatcatcgattgggtcactgtcttgtctttttttttttttttttaacaacagaaatgggtactgttaaaatgattttcaggtccatagaaacaatctgaattcttgacctagctgggagttgccttttaaagtgtgattgagaatatggctctggcatcaatcagactgctggggttctgaatccaggctctcccattcattagctgtgtgaccttgggcaggccttg

SEQ ID NO: 7098 - DNA, 677 bp, artificial
  synthetic oligonucleotide
gcagcaaggtggcagggattgggatcccagctctgctacataccagccatgtgaccttgagcaagttacttaatctctctgtgcctcagtttccttctctgtaatctgtggatactaataaactcacctcttggagttaacatgagaatgaaatgagttaagtttcatacagctgttgcgacagtgcctgggtgtatagtaggcaccaagcgtttgttaaagaaaacttcagaagagggtcactctcataacatcatgtgagccgaaacccagggcatgctggaaacacaggaagtactcgccattcttgttgttttgtcctcactgaccttgccccatctcccttttcttcatgctcttccttccacaataataccctctcatgaggccctttatgtattctacctccttattttaaaagggaaaaatgagaaaaaaagaaataaaatacaattcttggaaagctggcaggaggatttgcattttaatggcagagaaaatgtaaagtcaaaggaatgaatccctaattgtagaatttgtggttgctggtgaggggactacttggtgggacagaggtggcaggactgggcaagataggagagaaggacagaagatcaacctgaaatccctccacacaggcagttgcctactggacaagaaatgccagccccagctat

SEQ ID NO: 7099 - DNA, 1310 bp, artificial
  synthetic oligonucleotide
catgttcatatggtgttctccctgtgtgcatgcctctgtgtccaaatttcccctgttgtaaggacactggtcatattggattagggcccaccctaatgacctcatctgaacacgatgacatctgcaaataccctatttccaaacaacatcccattctgaggcactgggagttgggacttcagcacaccttctctgggaggacacaattcaacccataacaaatacccactaaggatcaagtattctgcagggcactgagaatacaaacattaataaaacatggtcctagccctaaggagttcacatttgaatgtggaaaacagattttcatgcattaactcattaagtattgtatcagggaaatatacaaatacaaggacaaaaggaacaggagtggtggcaccggaagaaagatttcagtatgtgtgtgctgggccttcaagggtgagctgtattgacattctccaaaggaaaacacacaatcagagatgcaggagtctgaaagcacatggcattttctgggaactcgagttcttgatatggctatagtgtcagatgagactcatgaaagataaatccagaaacattgttaagatcagattccaaaaggccttgtcttccaggttaaggaggtttcactttatcctataagtacttgtcttaggtcaagatccccagaagcagaaaaggattcctgtgaaaatgatttattaggaagtattaccttgaaatgccaagaaagaagtagggaagggtcaaaagccaagccaacagactgtactaagcaaagtctcatggagggcaacttctgctcaatcctacaagggtactctggagacactataggtcatatctcagagttgtctagattggaagaggaggtgggaggacttatagcctctcacccagtaatcactggttcagagcagcccccaggcactttgagctgcccacagtagcccacaatgcaagtggcatggctctggcagcctgagggaagtccctcaacagagagacactggcttccaggagtggaggcacactgggagccaatgtccataaaaatagcaaaaagactgcagagtgagacaagagcctctgctactgttgcagagtcattaaaatgttttaatgaaggaattaagtgatctgatctctatgtcagaaatctaactgataatggtgttaaaaatggaatggcaagaaaacaggctggttgcaaggagagcacttaggaagccatgacaatggtccaagcctactggggaccctaaaaaaggtgaggggaaggaggagaggggcatcagaga

SEQ ID NO: 7100 - DNA, 1225 bp, artificial
  synthetic oligonucleotide
gaaagggtcactctggccagatccactgagggggaccggaaagtggagccagacctttctcatgctcccagctcccaggggaactgatccattagacccccttctcagctacatctagggagacagcaattcattttaccaaatgctttgtaaagacagaagccacaactccagtcccaagtgaggtcacatgtggtccctgcccatgagaagctggacagtaggttggaccaccaggcattctgtaaacacagtaaatgtaaggagacaccccaaggtttagagagaaactcagattccaagccaggctctgtcaaccaccagctatgtggtctcagcaccttgcaccacctctctgggcctctgcctccctatctgtgacacagggtggtaataacaacccctacctttttcaaaccctatggggcttctttcttattgtgtgcacggagaagccacagtggagatgccagaagcgggaaaggaccccctaaccaaatggggaaaatgcaggggattaagtgagtcagagatcctaggaaaatgaaacgagctaatggaaaatgtttttatttggtggtaaggagagtggcttgagagagtggagcctaatgggagaagatgctgaagaattaaaatgataactgatgggccagggtggacagtgcaggcctggagcaagaagcagcaaaaacacatgtcatcaggccatgcagacctgagtccaagtgtttgctagctgtgtgaccttgggcaagttgcttgatctctgtgaacctcatccagcaaatctacttccagtcctcacctcatagggtggctgtgggggtttcacaaggcttggcatgcagtgcacatctagtgagttaggcccttggtctgcttggagaaaggggacaaaatcaagtaatctcacaagggcaaaggcagtcagtgccaaaggcacaggaacaggtgcatgggggctccagtggggaacaagtatctgggactggggcagccgggggccatgtgttaatcaggattcttgtggttgcaagtgacagaaacagacttggaatgagcagcaaagcaaatgtaatggtgcaggtgggatgaggatgggggtattgaaacagaggtgtcagtgccccatccacatgcactggaaggtggctggtgaacaccaggacttttcttctggccactggagcacttttggcccatgcacaggaccagccagaag

SEQ ID NO: 7101 - DNA, 857 bp, artificial
  synthetic oligonucleotide
ccactgagccatgaaggaatgacaaattgcctaggggactgcaataggggactgcatgcatttacatgaaccaaactaactagatgacatgcatctaccccagatgcaatgattaaacaaatgaaatgtatgcaaagatgtcttacgatttcacagtcacataacgtgtgcaaaagaccttatttggcaaagatctcccaatccttttgttccttttccctagtcacagaaaatttatttgaagcatcaatgtgcccagctttctctgagccgcctttttgggtaagtgtgccctgtactagggagtacaggtaacttctggccactgagacgtgagcagaagtgagtgagaccactggaagatctcctttaagaaagatacacccttctttctttcctccatattgctgtcctgcagttgtgatgactggagctctagcagccttcttagatcatgaggacaaggaagttgtctgtgggtggtgaatcagtgagctggaagaagtctttggtccctagtgattttatcaaggctcctaggctggctgttcagcccgagagaaaactttctaccttgtttaaaccctgttatttcagatgattttcacagccaagtctaacccagagagggtccctttgcctgtgtgtcatggtgccctgagtctctcatagggtagtgcacattgatcccctactggctgtgtgccctagatggtggtatggggaaagaggacatcttggagaccatctaccagagaagtgacacggaaaggatgggatttgggagagtcagatcgcacaaatgactacaagctagtaccacccacctccttatcgtcacctttacaatgtgactt

SEQ ID NO: 7102 - DNA, 1022 bp, artificial
  synthetic oligonucleotide
taacccccccattagggacaaggactttgctgtaccactccccaagcactgactgcccatttgtccctgaaaaagaaaaaggcagaaggggagtgtggtgggctcacttaacacccattccaacacctttagcttgattttttctattatggggcccaaaagctaaaaactacaattcccaggaatctgcaccatcaagggtcaggcacatgatcgttccacctatcagtcacacgcataagatctgaatgcagatgcgagcaacatgaggcatcagacccatgccaggacatcagatcttctggcaagaattgtggcagaggcatttggtttgggcctgctgaagcagagcttctgacacccagtgctgagggtcaaaggtgctgtaggcagaggggtcagggatgttccagctacaacattcacttggtgtggttaggtgtttcctgctgctacattgtcttggctgccttgtcctgcctctgaaccacccaaggccaggtctttggccctcctggggactcattagctacttaattaatatattttaataaatctctttctgcttaaactatttcgagcagatgctgttgtttgcaagcgagaaccttgtgctgttggggaggcaatttaaataaccctccaaatgaaaaagagataaaactaatacttttttttaaatataagtattaagatacagcgtctccagcagcccagaaaactcccttgcacccatgcccaatcaattatcctctaaaagcagccattgttttgattcttatcactgtagattagttttgcctgtttttcgaacttgctataaatagaataaatcatatgttatattattattttgtgactagcttccttgctcaacatttccttatgagattcatccatggtccttcctcttttgttgctgtttagatttccacagcttatttctccatcctcatattgatggacatttgggctgtttttagtttggaactatcatgaatcaagctgctgacatgaacatt

SEQ ID NO: 7103 - DNA, 789 bp, artificial
  synthetic oligonucleotide
cctaccactaagcagccatgggccaggcagctgagcctcagattcagtctgagaataaaggctgggttgcgtgctttccaagggacctgccagcacgtaggttctgctgttcctcaggccccgagtgtccctgaggctgcctctctcaagctctccaccgcagctattctccaagccctgcccacaaagggccgattgctctgaggcagtttggggattacttatagcctgaggccggattggaaagtctctctccagaggagtggggttaatctctgcctccatgggttttgtgctttcctgaggcccacggttttctctagcaaacagtggaacccgctggcattctcttctccatcgccgctctgtccccttctttccttgaatgggtggattctgcctaccatgctgctcaccacctagccaacatacagtgtcttggagcaggcagggccctcaatgggggcccaagcagaggcggcatgtcctagcacattagatgcatcacatgtttacccctttggctcgctgcagcctgctaaaggcatttataatggggcagcttaccaagctctcaaaagtgagaaattgtccagcacctctgatcacactgccctcacctggatggggccaatcatgccctctcctgggggatgcagatcacccagggcagagcctgcctccaagggccttctgagcagcaagtcagtgtctgcagggagtatttctctaaaatggcagcaactcagggctgtgtcaggatatatttatttcatagactcactggtg

SEQ ID NO: 7104 - DNA, 1097 bp, artificial
  synthetic oligonucleotide
ccgtactttacaatcctctagggagcattaaacaaaaaaatgatgcctgggccccaccccagacctattaaatcagaatctctgggggtaacacctgagaataggtatatttttaaactccccaatcattctataggacaacctgagttagtgtattagtcagctattgtcgtgacactcccatgtaacaaacaaactcccaatcaccagtagcttacaaccacagacatttgtttttctcactcacagatttgcagatcagctgcaattcagctgatttcagctagcaccatcggactcctctccagattgtaaactgggtttagatctgctgtactttggtcatccagacaaatggctatgcaggagaagttctctccagggtgatgggtggagcataagaggccaagccaaaccatgcaagcacatggaaagcctcagtgtacatcacagccattaactttccactagccaaagcgagtctcatggtcaagtctagcatcaaggaggtaggaaatatagctgactccagtaggaagaaccacaaagttacatggcaaaagctatggaagtatcatttcctaacagggagggggtcagaattggaaatagtaagctgatctatcacagttgggaaccattagcctacaggctaaggattcattcttctcccaagtgatttctgtaaagggatcctgctgtttatggggttcaggttccccacttattacctgtgtaccacgagcaagtcacttaacctccctcattctcagtctttcagtgtgtaaaatggggatggtaattcctaacctgcctctatcaaagggccggagaaaggggaaagtaaatgagtgcatgtgagaacacactgctttctctctgcctagcctcagtgagaaagaccattgcaacatataaaagagttgaatcaaaagtcagggacacagtgaacaatctgtgtacatgtctatgtgtgtaatttagagttcctaaaggtgcctggaggtgagtcaagagcctgaggcagggccctgagccagcatctctcagcctggcatggcctggaaggccagtgaaggtctgccctccccgacttg

SEQ ID NO: 7105 - DNA, 4341 bp, artificial
  synthetic oligonucleotide
aatcctctcttaaaaccgcagctgaggcagccaaacgtgcctgccctctgaagggcctttcagacagtagcgtgtgtttgggaaaccttattttttaaaccacctccccagttctctctccccctaaaaatgaaagaaccatcaactcctagcctgggtttcaccgtgcactgtactagggaaacccccccgggaagacaggctccctgctggagaaatgttcctcctgcacaaagctctgcagcagaccccagatgggggctcgggcccccatccttctggggcctgcgttcctcaggggagaaataattggcctgtctatagagcatcaggattcaaataaagcttaaaaatgcacgcagccctgagaattctacaaatgtggaattacaaatgatggcccaccaccatatacacacacgtgcacacacagccctgaaggccacctctgcttttctctctgattgtttcccagatccacctgactcaaataaacccactctcatttgaactggaggtaatcagggtggaaaataccccgttccgttggtgcaggtccaaactgtcaccatttggcatcctgacacaccgatgtccccatcagctgttaacgtcagccaaaggggccctcccccagtcaacaaatcagagatttcattaaccagcaaagcctcccggaaggatgagcgacctcacgtgggcctccccccatctccctcactgccccgctcccttctgctacacaaacaggctcacagcaactagattggattcagatcttgtagatgaagaaattcagatacgacagcagcgcctcgccagacccggagcgagggccaagccccacatggcagctgggctgcctcggtaataaccactcgtaatatctgacagaaagaacccacgctggtcatatccgatcctgccacatgaaaagaagcattacaccagcctctcgggggccggggctaggggagagcctccgcacaaatcagaaacattttccacgaagctgctattcaagggctgcaaaatcaacaggggctgctttcctaacatcctgagagatgctattattctccgggcggtgcagctcacagaacgcagcaaggccagcttaacccgaattcactgagcatttggcatttctgagctcagaggccttgaacgggtgggaacaaaaacccattctggttgtgggagtgggctgtggggctccacaggggtgacattctaaatatttaacaacggagacagcctgggcctctgccattcagaatgagccccagcctcagccctggggcaggaacatgggtgcctcaggctatggcaagcagcccaggtggaagggacacttgggacaatgacagagaagcatttcaatactatagcaactggtagggctattgggatgaaccctggtccagaagcccctcctgagccatgctagggggtgcctgctcatagcatctcattctttgggcccacgacagccctgagccacccctcctcagccaaaagcttccagacacagggccatgcccttgtagagccaggactacatgattgagtctttcaaggcccatgcccacctgaagcagaaacttacaactcaaggctcccagcatgtttcaccatggctggattttaaatgctgagcgtccctagacacacccaaccacctgtgataaatacacaagtaatggccctgtcaatactccccaccacctcaaattcttgtccttcacatcttttcattgcggcagcattgtcctagccaggaagaaagggctagattcccccagccctgtctctgtctctgcaaccccaagctcccagccccgtcctcctcctggcttagccttgtacacctatgggggtcttagaggccaaagtcactcagggacattgagtctccaaatctttacctttttggtgtaaggcagctttgtcatggtggaccttgagacattcaacaagataaagtgatctccacccagcagtcaccttgtttgagtgtttttgtttttttttggtcttttttttttttttttttttttggagatggagttttgctcttgttgcccagactggagtgcaatggcatgatctcggctcactgcaacctccgcctcctggattcaagtgactttcctgcctcaacctcccgagtagctgggattacaggtgcgcaccaccatgcctggcaaatttttgtattattagtagagacgggttttagccatgttggccaggctggtctcgaactcctcagctcaggtgatccacccacctcggcttcccaaagtgctaggattacaggcatgagccaccgagcccggcctcacattgtttttaaagcaacagatattgaactcataaatagctgtctacaatgacaggtagtgtatgctgaaatctcatgggttgggatgaaaacaaattaagtgtatataattcacttcactcttactcaatttccctgcctgtaaaatcaggccagtatagcttctctgtgcctcagcttactcatccagaaaatgggatgaataggcaccctgccaatatcacagggctactataaggaccaaatgatatgtgtgaaagtgagccttgtaagctataaaaataacaccccaaacgagcctctaaataggcgaaacccctgcacagctaaaatgctctctctaccaagtctgccctaagccagcccactgtgcctgcgttttcttggccagtattgctctagtgcaattgtctgaggacaaaacagccccagcactcgggcaaggacccaaggcaagacagcctcgtcacctcagcatttctataaaaagattgctcagactctggagcctggctgacaggcagggctgaaagggtgtgtgcatgtgtgcatgagtgtgtgtgtgtgcacgcatgcacacgcacacatgcacgcaatgaaatgttctcgtaacagctggcgtgggccaagaatccatgctcaccctaaatccccgagccccactggcaggaggggaatggattcaaggaagggtagagaggctgagagagagagagagagcgctgtgcatcgaagaataggtctgggcaaagagatgtctgcggtgctggtctgtcgctccgagcagccaacacaatggacctctgggtgggctcagagagaccccccaaccccccgacctcctgcccgtgacacagataaggacctggaggactgctctgagcttctgtgtgtgccctgggccagccggcagcgaggccagtctggtgtgagtggcagcaaagataaacggcggccgcgcgggcattgaatgccccgacacaaaaggccgcctctccccgagtccctctgaggcccagatggtcagggaagccctttcccgcctcacaaagaggatcgctgcgtgtctttttcttttaaaatggaataaaaaaaaaaagccattgctcacaaaggacctggatgaaaaataaacccttaaaaaaacccagcctctcctcgctcagcagcccggcatttcttccgactgtcagacttagcagattgctttctggaaaggatccaattggcaagacctgccgctgtgcaaatgaaattttaaaaccccattccttgttgcactcaaagagcttttctctctctgcttgttctacacggcctcgtagaattattctcttgtctctcgttgtatcagaaactaatattcccccactttccctccccacgtgaggggtcctcaccccagctggggatttgggtaatcagggacgtctggagcaccactccagacccccaagttgattccccacctgggcttcatctcacagaatcacctactaattaggagagagacttgctcctgaagagaataaacacttccacgctgcctccctccctccccggctccctgcccccgcctcggtaatgagataagtgtttgggggatgagggagagaggatgacggggacgttcttcacacacaaggtttgacacccgtcaggcccgtgacactagctctgtttggctggcatccccgtggtgaaaagtcagcagaaaaaaatagccacaggacttgtctgggtttgacaggctgcctcacagagtgatgaacttggagagaagaagccacgtgatgtgtcggaaagtgtcccaggcctgggagccaggagacctgggttccaattccaagtctgcccctaataacagtgtaccaggcacagtgctcggctccatacatgtgttctgttctgctttccttggagctagtgtcattctcaggttagataccggcactatgagacaggcaaatgttgctcaaaacattgcctcatgg

SEQ ID NO: 7106 - DNA, 892 bp, artificial
  synthetic oligonucleotide
agaacctgggtctgcctggctccgggaccctagtttgccctgtgaaggaggggaggggagagataggagaggacagagtatggccgtgtgcatcacgctctcccagaagtggtgctgagtcaagggtttgggggcaggtgagttagtaaggaagcactcccaggaggaaccagtaagggattggcgagtagaacagaaaaatggagaaaggcaagcaagggtgccaactcaaagtcccacccccatcctcatctggcagggggcctctggagggtaaatttcatcccagagtttgtcctgcctccaggcaatggagccgggtttttaactccacatcagtcactggctatgggtaccctggggtggggtgcaggggtgggaagggggatagcaaattcctagacacctccagctctccataccttcgaggaggttgcagctattggcagcagagccccctgatgttgggaatgggcccacagacctggtacaaggaatccagcaatatgtgcaacacttggcgacctcaccaacaaagatccacctgcatagccgagatatggataaggctcccattcttcagcatgtgaccctcctcttaccccatatttacggtggattgaaaaaccctgggactgggccattctgttctggacataactgtcaatagcctgcccctaacgactggagcccgagatacagaccaacctggccagggctgagggaatgaagcatgggctcttgacccaatttagccaacaaccaagcagatggtctcactaagaactgtgcctcagaggtggggcaggtcctgccaggtcctctagactcgcagccaccgcttagctgacagcatgtgcaagcaaaggcagccaggagcctgggggcagag

SEQ ID NO: 7107 - DNA, 902 bp, artificial
  synthetic oligonucleotide
cacaattggcatgctatttaaggggagggcagtcatttttttctatagaagcagcgttctctctctctctccaccaccttcctcactccctcccttgttgccccaggcaaatagcctgtcagagaaaaaaggcatgccacatcccagtccacagagcccagataactgcaggagtcaagtatcctcaggttttccaagtgaagtgcttacgtcattccttctggctttcagtgagcaccctccctccacccccacatatatcttagccctcttttctatgtgccaggccaggggctcccagcaagtgatcagttgtctccaaagaaatctactttcagaaaatccagtgtcttctctcttcaaccttttatgtcctcctctggatttaaagtcctttaactggttcttggatatttcctttgaaaaaatctgcattttggtctcatgttggaatttattagctattatctttggtgacccaggtgaaatgtgcagtttcaggtcctggcccagaggctcaactctggaggcaggtgacagagcactgtctgctccccactcccatcctcacactgagctcggcaaaggggaggagttgtgccttccttctcacccaggacccacttctgaccaggcaccagagaagcctattggtgtcctgcaatggtggaatggaatctttcaggagaccagccagcaacctctccataagcctcagtccaagttcaaaggattgggcctggggccaacatcaaaaactgtagcaggttgaatggtggtcccaaaagatatgtccacctggaacctgtgaatgtagtaaccttatttggaaaaacggtctttgtagagttaattaagttaaggatctcaagatgagatcatcctggatcaaggtgagccct

SEQ ID NO: 7108 - DNA, 1529 bp, artificial
  synthetic oligonucleotide
gttaaaacagataaattctgtagtatgtaaatcatatttcaataaagctgtttaataaaaaagatccttcagcatacatatctccatctcaaagtccatttccagggaacccaatcaaagacaacatatattgcattttaacagaaatgtctattaccttttatctctagccaaatttgagaaaattgcagtttcaagatgaagagccccaaagtctgcccaagcatacagagctcatccccacccccccaccccaacacacacacacacctttcaagctttctctggctttatgtcacagccaccatcactgtcacccttctctgacacagttctggaacccaacactggaattccttcccacaaagaaaataactcaacccttgctcccatgaagcagggttacagggcacatcctaccacttcccatcatttttaattatgaattcttatttttaatagatgtttctattcggtactatctgtcataattctttggcctgaaaagcccagataccttgaggtgtaaacacggatgatatagattacctgtgtttgctggggagtgagggtcaacgggttggcaggaatgagcccatgagacagactaggaaacagagaagggaaggggaaaaaaaaaagacgagttgataaacaagagctccgagttcatccccacaaggctggctgctcattgctcgatgttgcgagacactgacttcttagaggtttgcagtaacagctcgctcgagctggaaattgccgtgaatgtgcatgctacccgaggctgagcttgtaaaaagagttctccggcatcctcgcttcactgacaggtctggaacatcatgtgttcctttgggggccactgagtctgagccccagcaaccctgccccaaacatttactgagcatctatcatgtgccaacagaactacctctgggctaagttctggtacaaacaagccatgaatgacacagttcccacacacaagaagctcgcagatacaaaatctaggtgttctttgtgctgtgtgattgtgtgaaggaaaaatatcagggacagagaggtggatgcagacaagttcacccagaaggaaatgtctccaaaggcttcaagtaaaggggatgcttaaacagtctcttaaaaggacggttgctcaaagtccaggtgttagatttcatccaaaggagagcagcagtttaagcaaaaccgcaaagcagtgctgtccactagaactttctacgatgatgaaaatgtactatatctttaccatccaaaatggtactagtaagcacttaaaatgtggctagggtatctgagaagtgaaatttttaattttagttaatttctattcattttaatttaaaccaaactatgcacatttggctagcagttaccagagcggactgcacagcccagaggcataaaacagcagggcccattcccataagtgcaagtcgttgtatgagacagaagcttagggtggccaggagctgctactggaaacacagtcagaaaaaaagagacca

SEQ ID NO: 7109 - DNA, 665 bp, artificial
  synthetic oligonucleotide
gctcgtagctgatgagaactctgagcaaccacccaattggtggtgccctcatcagtaggtctctcacctctgggctagttgtgtggttgtagtaaagaaccatcatcagtttcccccatctggtccagcagcctgaaatatgcttctgcaacaatatgacttctgttccctttgcttttgatctccacccacatgattcccaacacagccctgccctcaggactgtgaatttccatgtgggtgtgaatctttttatcatgtgcagatgcttcacctcccttctaatttttttttttttttaacaaggtcaaccttcctatgtctactccacccacagcccctttctgaagatggcccttctgctcaagtgactttggcgataactaattggactagtatttcagtttgggttcccccagaagcagactgtgaggcaaggattcacatgcaagtagtttatttaggaggtgattctgagatggaccagtagtggagtgaagaaatgtgagaaggaaggcaaccaatacagggtgcgttgtcaagcaagttaccactctggataactggagctcagtgttgctggagaatagtgtagaagacaagccttgggcaaagaggcaaaacaattggggtaaaggggtaaaaggattgggtgtttagacact

SEQ ID NO: 7110 - DNA, 180 bp, artificial
  synthetic oligonucleotide
cagctgatccagagacccgtgagctaaataaacgcttactattgcattcccctgggatttttgtggttggttgttacacagcaccagctaactggaacaagaactgtgtgcagttctgagagtcacatttgatgaaggacattgacaaactagagggcagtgggaaccatgaagggtcac

SEQ ID NO: 7111 - DNA, 537 bp, artificial
  synthetic oligonucleotide
aatagaagaggggaggggaagaaaagaaggggaattgggggcagaggaggagcaatgaccagcaaaggacagccacaaaagcacttagtgcctaaggtatgcccatccatagacacgactgattcttttcaacggaaaaaagcaaaacaaaacaaaaccctccaacctagtctggtgtgttgttgaaacataataaatttttggcacttttagagcagatgtatgaagaaattaagttcagatttaaattccagatcgtttttttaaatgtagtatgttcagatccgtacgtagaaaatcgaagccaaaaaagaaaaaaataagatctttttgtgtgagaaccagtggttctcaattgggtggtgggggagagggttgcttctccaggcgacatttgacaatgttcacagacactttgggttataacaacatgggaggggggaatgggtgctactggcatctagtaggtagaggccaggatggtgctaaacagcctgtaaggcacaggacagcccccacaatgaaaaatgatctgac

SEQ ID NO: 7112 - DNA, 1610 bp, artificial
  synthetic oligonucleotide
ggggcccttcttccagcagagagctggagagacgaaacaccagcttggggggaatactttaagggtgtttccaagactggaggtctcagctttaataccaaagccactcctgccccacttccacgccagccaccacttttcacccctcccctcccccaccctgggaaaacctagaaaagtttcgggacttcaggcctggtgcagcccacctccctcggtcattcaaatcagggcctggcaggcccccaggagggaggtaacaaaattaaaaatagcctctcctccaagaaaaaaaattaaaaatagattccaacccacatgaaaatttgggtggaaagaaaggaaaggaaaacaaaatgaatcatctttatgtgttttgctgagcgagagcccgttgccatggctacggggccctgtgtgcaggcctggtcttttccagcaagttcaaggcccgccaaagagccagtgggggcggccctatcaccaatatgttatagccatcggatccacgatcccccaacgcagtcgctgccactgagcaggtcgtattaatgactgtcacaattaatttagtgtttccttccgttgtgatctatcgctgtaattgagcaaacgagaggacttgtttgggtctcctgggagtttagggaaatcttgcctggttttgcaatctagacagtcaggggaggttatgcgaacttgtggagaagcccggtcttaaatcatagagtgggaaagccagctctccagcctgcatcagccagccgctgtctgccttcctggtgggctcgctggtgctgcacgtgaaaggccccatgaagacaaggaagggtaagaggatcagcaagtccgcatggcctcactggctggtgaaacaaagctgggacagtggcccaatccccccagtaggtgatgtgcttgggagacactcccccagattaagaaaagctggattcatgaggtccccttctcagaactggagttttaggccttaacctaaactggaaagggcagcctagggctttggagaaggctcttgtctcacatacacttttctaaaacagtagtgttctgccttaagaaaaccaaatacattgaaaattcaaacttacaaaataaataagagggacaggggaggaagagaaaactcacttcataaagaattttttactttaaaataattggcctggaaatgttccacataagaaacaaaagagacatgtcaactaaattcaatatctgatcttagactagatcttatgctatcgaaagcattattaggacaattgacaaaattgaaatatgaatggtagaacagattaaaatattacacttatgataaatttactgaagtggataactatactgttgctaactgtactgtggttctataaaagaatattcttattcttagaaaatatgaaagtatttaagaatgaagggccatgatgtatgtaactgctgtggtctgaatgtttgtgtccctccaaaacccatatgttaaaaccctatcaatgtgatggttttagcaagtggggcccttgggaggtggttaggtcatgagagtggagccctcataaatgggattagtgcccttataaaagaggcct

SEQ ID NO: 7113 - DNA, 1668 bp, artificial
  synthetic oligonucleotide
tggggggaaggggtagcagtggctgcgcttggtgcctccccctctcgggagattactgcagccctgccggcgctcagtggtaaaagtttgaacgtgtctgcagagcttaatcaaatgctaattccgtgtggtgaaagaatttgctggaatctgcaagggagctcctggcagcaagaaaatgcgttgattcactcccaaatctgctttgcccaagccgggtgcgatttagactgtaaagctgcattaaatcacaaagtgctgtgtggatcacacagccatcctttgtgtcgttaatgaagggaaaaacagggctttattctgaagctttgtgtataatcagatgccatgttgtaaagctctggaaaacacaccagaaatcataattgggaggaaataaaagggttagtccaaaacagcatatgatttaaataagaaggaaaaagaaactgcccccaagatttgtgcgtttcaagaatcaacttttaattcattcgcagggagattacagaaggggaggagcagcctttaaaatagtatgaaaagctagtttagatgtaaatgagagataatgggctttcaccagaaaataagcaatggggccaagtttgtgcccagggctgggggatgggggtgacatcttggcctgcagggctccggagccctctagatccaggtgccgcagacagcgtggggtttgcggcctgttaggagcaacgggaggatttggggcacagggtctggtaaccagcattcggaggaagaaaaaatggtgttgcctgcccgtgttggttcccaagggtcctggggcttggcggagttggggctgggggaggtcttgattgttgctttaacacagaaaatctccttggtgtgaacattttgaggtcggtaaggaaaggggttggggcttttaggcttgtcttacagctggagttaaggagcgctgcgcggagccctccccagccctaattcactaatgatttgcttattagttcagatcagggagccagcttctggagagatgtgaattggcattgatttaatcctcttcccagcacgcgttcccggccctgggtgaggctgggaagggagaggggggctgccagccctttcaagagcaagttgctgcttctcctgtctggctttgtctgctttccttaccatctgctctcaggcagagaggagccatggatggagggggcgagccccagagtccaagcccaggctctagatctggttgaccctagtaatgctgagctcagtggcctcctggcaggtacagcatatagatgagatgctgtgaaggtccctcagctctggcatctatcattagagggactggagcctctggaacatcttagtggggaggaattctgcccataatgtatttggtgtcctgtgagccaggtgctgtttcatgtatgatgtcacctgcctctccggtagataccatgattattcacactttacaagggaggaagccgagcctcagaaaggttaagtaacctgtctaaggtcacacgggtaaaacattggaacccaagctgtataactcaaatctttgatcttcaccacacattatgtggtttaatctgagctgcttctgcttgaacataccttcttgtttgattatctctttataaactgccattgagaacatttttctcc

SEQ ID NO: 7114 - DNA, 1381 bp, artificial
  synthetic oligonucleotide
tacattactttcaaatggttcaggaaaaagatagacagccacatgtgtaaatatggcacaataataattcatgaatcaaggcatggggcatatggatgcttgtattattttttctactgtctgaaggtttaaaacttttcaaaataaaaattgaaagaggagataattatgcagaaatggccctgaaaatgttacccacatccaccagaaaggtctggaatggagactgggggtcacagtaagtagatagctgctgagaaaatgggtacattagctgatgtccattcttacaagaacactctcaagaagcttttgtggaaacagaccgttttttatagggtttttaaatgcgaaagcaaattaactactacgtgccattaaatacagagctatacctgtgaaaacccttgagtggtaacccaggaggaggcagaagcaggtttgaggtatcccacctccacttcagagactaaaacctgggccacttattacctaaggtaacacctaaatgtcaaaaggcaaggacggagccagagagcaaagcttgcctgtgaatacaaatgggaacaggctttcaaaataaagctgaggttcaggttccaatactccaaatgccaatcaaaagactcatttattttttaaatatgtgggtgagagttgagaattacatctgaaaggccactatcctggaataagcatagaatcatcctgtagatttctgaatatgcttgtctgcctcagctttggcttagtgagttgggctgtgtgtgtgtgtgtgtgtgtgtgtgtgtgtgtgtgtgtgtgtgtgtgttttagaataacatgaggaggaggcattgctaattgaagttttcataaacgagcatctatttgtgattttttttttccaaaataaaaattcgggtgaaagaaaaaagaaatgctcagacctggccctgaaaatatctatcaaaagtggatctagggagtggagatagaatatttgtaattaaacccttgagtggtaattacaaggtggttgggcgcgctggctcactactgtaatcccagcactttgggaggccaaggcgggtggatcatgaggtcaggagatggagaccatcctggccaacatggtgaaaccctgtctctactaaaaatacaaaaacttagctgggcctggtggcgcgtgcctggaatcccagctactcaggaggctgaggcatgagaatcacttgaacccaggaggtggaggttgcattgagtcgagatcgtgccactgcactccagcctggcgatagagggaaagtccgtctcaaaaagaacaacaaaaaaaagaggttggggggatgaattttaggtctaaaattttgccataagtggaacaatcattgatgacagt

SEQ ID NO: 7115 - DNA, 1743 bp, artificial
  synthetic oligonucleotide
acagccctctttgctgggtggatctgggtcacacagtcccttcatgtggtcagagctaatttgtgtcttctagtcttccctgccttgtccctagctcccagccttctctgccaccacaagttccatctttcctaaaccagagcaaactgagccacactcagctttttgtccctaggcatggatggggaatgaaaggcgttttttgtcccctgctgtacaatgccatttgttcggacgcagctctggggctgtgcaggggatgggggttggggggagtgaggcgaacacaaccccctttctccagagctgggtaacagacagccactgcgcacccagcgggagggcaggcttaggctggaacggccatcgcctgtgggctactcaagaggaaaagaggttgctgctctggtgagcgtcctgagcttcacagtcaagtgtctgtgtcaccagcactggccatcctctcccaactccctgtttccccagcacccctcctccacaccgtcctgcagtttaggatgagaaaaccctcttgtttgaggtctttgcaacaaccgatgaaagccttttttttttttcttttaaagaattcatctctgcattccagtggggacatttatcacccggtgcccaggctgcagacatctccctccttaagatcctcctgcccagaaaggcagccttgtcaaagacatgaaaccatcccctctggacatctggacaaggcgcagccctttggccaagcacgaggccgtcccgaatgcctcagacagtcaaaggagagcccttgttcctgatccaaatggcccggctacatggatgcagctgggtagagtgggggcggcgggggtgaagaaaggagccagcccccttggctagcagcctcaggcacctccacagggcaatctgaaaggccagcctgcattcggaagaagcttctgaagccgccttagtaacttagtaactccgccaatagttaagaaagctcaattggtaaccggtagtagataactactgcaattgtctgcctagcaccccatcttctagtgaaagaatctttcttccttctgggcaaccaatttcattaaatgatctgagccttccacgacccccccacccgccccatacactggactccaggactcagccctggttggccaatcagcgtattccaatacccgggcacagtcattgggcacttaacactaggtcagccaatcagagccctccttgggatttttctcccagagataagaactgtttccaccagggtaggatgaggcctgcagctgccagcagctatcttttccaccatgtggcttgaggctggctgggaaatgaagtgacagagccctaaaattagtgtttgagcacctaaatccagctatgtctgaagctatttgttggacatttcaggtctctccaccaataaattctactttttgctgtagctggtttgagttgggtttctgtcacttgcaccccaaagagactgactcatagttcctccttgaacaaatataaagtcctcatattggcatttgaggctgtctgtgatgtagccacagcacagacaacccaggccccatggggcagctaggccagccttgtccctgctccagaagtatcaattccagcccaaccctccaaaaacatggatgcccctgacaaagtgaccctgggagcaactgtaacttcaggatttctgatcatctgtggcctgaagaagccccaagaggaact

SEQ ID NO: 7116 - DNA, 6830 bp, artificial
  synthetic oligonucleotide
aaattaacccagtttccaaattttcaatttccaaattaactcaacttcccagggacctttctgataagcaacgtttctaataaataagtcctgatgtaaggcagtcctgttatccatctagaatttccccacaagcaccacaaaagtatcattctatttattttcttgagatacatactcaagaagaaacgtggatggccccatatgtgaggtgtacttagaattcagtgcctctcacctgaatgtttcaagatgggtcctcagaaagctgttttaagtctttcttctccccacctctttcttctccccaccggtctcccttgggttggctccactgattttccccaagttcccaagaacagaagcaaaaagcttaagggaacaattaatgaagcagctgcacgtcttgacctggggacatacagcacgactgcagccaccttggtgacaaaggtagcatttgcatcttatgggccaggaacaaagaaagaaaagaagtaacaagggatactgaatgagcaattaccttgtttcaacacagttttaaatgtagatgcattaccttatttaatcctcacaacaatattaggaagttggtacttttattatcttcattatatggatgagaaaacaggttctgagaagttcagcaattgacccaaggggacacagctaggaagtgggggtgtggggtgcgggggtttcaacctaggaacaattcaggacaggctctaggagctaagccccctaacccatcagatgctccaggccctctaagaaccctagagtggcagagggcattctgagctgacttctgaaaagggtgtattcttgccgggcatggtgacttatgcctataatcccagctactggggaggctgagacaggaggatcgcttgagcccaggagtttgaatccagcctgggcaacatagcaaacctcgtcaagaaacaaagaaaaaaaagaaggaaggagggagggagagaggaaagaagggaggcagggagggaggaagggaggcaatgaggaaggaaaagggaaggaaggaaagaaggaaggaaggaaggaaggaaggaaggaaggaaggaaggaaggaaggaaggaaagtatacattctgggcctgaactgaccatgtggctttgcctgctccaacaggacattctctgaaggaggatggggccagcttcatgttccccagctcaggaaccttcagcagtgatgagtcgagggtccctctgcctcccttttgcagtctaggcatgtgggaaggtgtcgagagccacctgctgctctcaacacagccaaagctggccatgaccaaaccctggaaaggggtgtggaagctgcttcagattcaccaaagcacctaggctagggtgctgaggaccaggttggcctattctgtaccgttgtgacactccaacctcagacctgaagttccccattccccccctccacaaagcccctcccagtcagacggcagcatccatgtcttccagctgggcaggccggtgagggcaggtgggtataccgcccctccctcttggcacccactcttccctggctgcctcatccccaaggcacaagatttacaaagactaagatgtaaagaacaattgaaaacaggaccataagggaggccaaagattaatacacaaacaatggaatcatgggagagatatttggagcctccgtggaaggaatatttgagggtgaggtctctcaagttcaccaatagatcaccaattggccattgaatacttttggtaaaaaccaggtccagggacagcctgtcatccccactgacccatcaggagggaagtagactgagacgggggtcctgaagctcccctgctgtacctgctgttaaccttttcattgttggatggaggggcaggcggagggggcagtgggggcagagcggcagggcctgggagaggggtacttggggagttgaggctgtttaccaaggagcacagcggattttgatattttaacagctgctacggcctggcttgagcaggccagcttgagtatgacccaggacagggtctcctggtggctgggaacccccaggtacacatgactgctctgtaaggcaggttctcccaggcccccagaaaggagtcctcatgaaagagggccccttctcaagcacacacactctctgccactaccactgcagatgcatggcgtcctgtagggctagctcatggagatatcatccccacagggaggacagaatgatttgcactgagcctgagcctctcaggcttgctctctctctctctctctctctctctctctctctctctctggcccaatgcctggtctttgaggctgcctttgtgagaaagaggaggccaaggcccccactggctattctctgtgcagagctaagtagcctggggggctgggaggaagcccttgacctcaggggccctaaactgcggctgacagcaggcagcaagggggggcccttgggaatggcgctttattgaggaacatttgtcttcatttggggcagtctacatctcatcccacaggcgtgccctgaggcccgagtctccctgacccctaccctgactgtctctgcactgcaacccctgtcccctgcactggattgaaggggaagttgtctcttaaagctccttggagccaaggtgacagacgtcagggaagaataacaggaaattccctcacaccctagaatgctcccagaccctgcccaggaaaagaggcttaagatagggatgggcacctcacagactcagccccaaagacctgggtcctccctggctaagtgattctgctaattcccactcaaattcagcataatagtcataggtttggataatgaaaaaatatgtacctatggttttcagtatgcaaactaaagaattaaatctcctcaaaataattgtggttggtcaggaggcccccagacactgtcttctctctcatagaaagagactctggtggaaaggactctgcgaaggggctttagaacctgaaaatatcagagtgcaagattgtggtgtgtttttcttttcctgaaaaagtcaggatatttaaaatgttagaagaccacgaactatgccctagatgctgccacaaatctgaggagctgttaataaatcatctcacctctctgtgcctcattttccaatttttaaaaaattgcctaatcatcaaagaggcccggaagctaggctaccaaggcgcgacgctgtttacaccccagacccaggttctcagctcggctttgcttgggaaaggctcggaacctgtctgggcctgggggtttagcacagaaggctttggttagctgcactgtgctgagcgcagctctgcagcgaggtttagggagctgcggtgcgttaggcacaaggcacgtggcgcgcctcgctccagcactttgcaaacgcacagcagcgcagggccagagcggctggcccccaggggtgggggcgaccagggacaggaggtcccatatggtgtcgtcgcgttaaaaacgtaggtcctaaggggcgagccgcgtccgacctccgcgcccctgcccgacgcggcgcctcgctcgccggccccgctcgctggattcatttccatctggagcgcggcgcgtcccaaccgcccttatctcgccgccgccgcggctctgcaggcgcgggcgccccgggctccctcccttcctctcccctcccccgcccgcgcctttgtctggcccggcggcgcgctcggagccagcagggcgggtaattggcggccggaggaggcgaacggcccggcccggcctccgctaatgagcgggcggagccgcggggagggcgcggcagggctccggcgcggagccggggagggagcttccgtggccgcgcggaccccgggatggctctccgagtcccggccgccccctcccgggctgtggcggggaccggcgccctgaggggcatcccttcctcctcccctctccctcccctatcccgtccccggcgcgctccaattaccctgcggccgtgccaaggcctgcggctgcccccgggccgcccccgcgtccccggagaaatgccagggacagaacgcgcgggcaggagggcagaaggaggcggctccctgggggcttcgctgcgctgcaggggacccaggcgaccctggggcacggccaccgttgttgtggtgggggggcacccccggggtccgatgccagagagctctcttagggaagccctcaggcagctgcgaaacctgctccagcatagatggtgataaaacccaccctggtttctaaattaattatactcaatccgcctcgctctgccggccccgagctacacttgtgtatcgaagggcgcggtagcccctcggtgggggtggaggggatgctctgttgttggctccgagaaaccccctttccaggactgtgtgcgggaagtgacagaggccagcggagctttaaggaaaataggggcaggaataggggacagagggaagcctttctccagccagtacccccgtcgactccccctcctggaagcccgccctgctgccatcactggcccgaggaccccggctccaggagcgggtcccgcttcctgcggtgcagtactcaattgtcaggatttctacaacaaactggcccttgtgcctccatgctcaactttcgcttatctccattgagcccggctccgtctccattcccgccggtgctttgttccctagctgcgttctgggttcttgaagtcactaatgcttagcattaacaggatccttcgtggccgccctttcaatcgtggcttctcagacttgggagctgaggttctgcctgtggaaggaagggcccacacctcagggacttgggggtccatgggggagccccacactggccccagcacagccttagggtatcacaagcagcctaggacagccccagagagggagtgtcccagtggcttccagggtcacttgacttaatagggactaccacatcttaagggaaaaaaggtcatttttctttcaaagagtccccagctagaacctttccctttcctgcccagctcccaccacagtggccacctgggagcagcccacccacagagagcttttccccctttttatttacttttttattgaggtatatacttacatattaagtgtaactgcacatattaagtgcactgcttgattcatttgcgcatatgtatatatctgcatcatcatcacccaggttaaatatggaacattgccagcagcccaaaaggtttctgcgtatctcaatcagtcaacatctcccaactcttctgatctccgtcaccataaatcagttttgcctatttttataaacgaaatgatgcagcctgcgctcgtcggtgtttggcttctttcactcaatgtcagttgcatccatgctattgcataaaacagtagttcatcctttttaattaccgagtggtattccattgtagaattatacggcaatttatgtatccacttgacttttgatggacatctggattgcctccaacttggggctgttatgaatgaagtggttatgagcgttgttctttattatatgtcttttggtggatacaagggcctattcttgttgggtatacacacccaggagtggaatcgctaggtcataaggtaggtatatgtttaactttattgccaaagagttttccaaagtagttgtacccagttagcctttaaagctgcaatcagggcataagtgctattcagagaaataaattgcaggcatagcataataatgacggcagacatatgttgagcacttagaatgtgctaggcactggtctaaaggatttgcatgtaattaacacttacgtgcgtttctatgcaaactttctcacagtgcctagttttgtcttagaatgtgcacaagatctcaggggctgatcagcactgatctttgtattgcctgccccaattaggacccatatacaatactctgttgaatgaatcggctccattttacagatgagaaaaccaaggcacaggaaagtggtgacttgctggagatttgggggctagtaatgggcagggccaagtctgcaactcaggtctccaggctcatgacattgctggcattcttattaatgtaagcctgactccacttgaagcctcctttgatttcttccctcttatacccccggttggcactctcagcactccagagctccaatcttttgaggcccttggctttcattatctcttcttgtgtaataaaccatccgaagacttaatgacttaaaacaattcttattatctcttgggttctgtgaatttagtggactcagctggatggttcttacttggggtctctcaggcagctgcagctgcagtcatctgcaggctggactgggctgggtgtccaagacggtgcatgcacgtggctggtggatgattctggctgttgaccggtagctcagctggggctgaaaactggagcaccttcatgtggcttgggcttctcacagcatggtggtggattctgagaggatgtgtccctgtcccaaaatcaagagtttcgagaggcaggaagaggaagccaccaggccaattaagggctacaccaggaacaagtatagattcatttccatcatactccattggtcaaaagagtcacagggcctcaccagattcaaaggagtgaagacagacttgatggatgagtggcaggtcacattgcagaagaccatgtgagaaggcagctatatttatagccatctttgtaaagtatacaccttccttgcccacatttcttgctcccagttgtaggtccaagagggccaaaaacatccctccacgt

SEQ ID NO: 7117 - DNA, 1205 bp, artificial
  synthetic oligonucleotide
cccacctttgcccaagcacaggaaggaggaattgtcttgaataaaaaccttctttagaactggcctgactctggtgccaggtgcggtggctcacgcctataatcccagcactttgggaggccaaggcgggtggatcacctgaggtcaggagttcgagaccagcctggccaacatggtgaaaccccatctctactaaaaaaaaaaatacaaaacattacccaggcatggtggcacaggcctgtaatcccagctacttggaaggctgaggcaggagaattgcttgaacccagaaggcggaggttgcagtgagccaagatcgcgacattgcactccagcctgggtgacagagcaagactctgtctcaaaaaaaaaaaaaaaagaactggcctggtctgattctgaaagccatggtgccctcagcagaatgttcctagaaaatttgtttatcccaagcgagagaagccaattctactaaggaaatggctcttgaaccataaaattcaagtcatttcttttatgcctcttagcagtgccatattgccaagtgtgataggccgaataatagcctcaaagatgtccgtgacctaatctctggaacctgtgaatatgttaccttatatggaagaagaaactttgcagatgtggttaggttaaggaccttgagatggggagagtctcctggcattttggaggtgtcctcaatgtaatcacatggctcttagctaaggaaaaaggggaagcagaggaggaggtcagtgtggtgccatctgggagggatttgactggccattgctggctgcaaagatggagaaaagggaccacgagccaaggaatgtgggcatcctctagaaagttgaaaaggcaaggaaacagagtcttctgtggagcttccagaagggaacacagtcttgctggccccttgattttgacccattgagaacatttcagacttctcacctccagaaccataagatcataagtttgtgctgttttaagccattacatctgtggtgactttttaccacggcaaaacaaaaccaacacgccaagataccctaggagtccccaagccagcaggctgctcacgtccaccgtgagcactgtcgggatagagtgacatcacaattacccctttgagaagttccagggaaaactgcagaggatcctgcttggaagacggacaacagtagttcccaggaaatgtc

SEQ ID NO: 7118 - DNA, 1351 bp, artificial
  synthetic oligonucleotide
gggtggggggtgggggtgccatatataaaagttacaggacagttcatctacctcaagtgtcttacaagagcacacctcttgaattttaacgactggagttacgactgggcaattaaccccatgcacagtcgccctccacccaagacagccagagacaaaaggcagagatgctaacaggctctctggggtcaatagagtcaggctttcaccctcttcctgggcagaaggaaacggcttttcttttcataccagggtctccaaaaaagaaagcacacactcaaaagaactgctgtataacttattgttttataaaaacccattctctttctttcaaatgtactgtaattttaaatgtttagagaacaagtggtaaaaatccttttaaaaatctgaaagacctgaagcaagctttaagctgctaggagcattggctatttacccaataataattagccattcaaggcaaaaatcacttttctacccaggccaggaaacagtgggggaatgagttactgaatgaagtttagagcatagtttccgaggaactgctgtctcgagtttatgcaacaccttggaaatgagtagtattttgctatttggcccccactccaatccagccccgttcctttctgaccaaggcagaaaaaaatacagtggggacagcctgtacctgagaaagcccataggcgctgggggcagctattgctctttgtaaaaaaaaaagggtgacaaaggtgtgagtggatcactaggatggaattaagatgccctaatttcaaatagagtggcttccgatgtccaagctgccaggaaagcagttgcagagacagaagggataagagcatgtataatcccaaagctctagggagagagagagagagaaaaaaaaagaaaaaatttattaagttaagttgtgaccctaaagctctcaagtcatgtggcacaaggtatgggctctctagtcccttttcaaaggcttacttgagcttgtctctcttggttatatacaaccatagatggctatgtggggtttagttaaataatttatgtgattgtttttaatagaaagttcactccttataggaaaatcaataatggctacatcgtgtcctacttttgtgcaggcgtgagttgaatctattcccttggacccccgctgcccatgatgggtgttcagctaggagggttggcactccaagctggaggacaaatactgaggagaaataggcagaggagagagacttgttcccagccaggagcaagtcttgcaaaactaaaccttttgagcattagccatatgaccatgcaggaccagctctgtgggcaagccaatagtgcagtcacagggctc

SEQ ID NO: 7119 - DNA, 1597 bp, artificial
  synthetic oligonucleotide
aattagtgactcctcatgagatggaagtaattctccggcatcgtcctcatttgatttcagaaaatccagcagttctggacttcacagttgcaccacacggtattgggctgtggtctgcttcctggcaaccaaagggcaggacataggtagctgataaggaaggagtgaaggatgtctgcgtgggggcaaatttcatgcaaaattcattactgaatatttctgtaatatgacaatttctgctttcctagccaaccatacaactgcagagatccacagagctaccgtttgaggaataaggaaccctgtacatagccaggggcattctaaaatccccaaacttgaatcctacttccgactttgctaggacaccgcaggaattaccatcaaagaaggaaaaagatgcacagaagtttcccattcgacagctacgattctacaaccccatagtctttctaaaccacaggctgcattttccattttgttttgctgtgttttccttcatgcgcctaactccggaggcagagttctgcccctacaaagccacattcatgtcatcattccaaaactcacaactcctgaaaactttgaggaatgttattaggccctgtaggccagaagggccgtttccagggtaacagcaactccacactaaggaagaaaggcatttcccttcctatgctcctctcagagttcaggccactacagagaaacccatgccctgagcctgagggacacttcctgtggcccttatgcaaccagcccagcacccaccccaaggacacacagccagcccctgcgcactggaaggccacacttcctgcccccgatatctcatgttgatctcctgccataaatctacccatgcctgtccgtcagcacgtcccaatctgtggtctggaaaagtcagcatagatgtgagaagaactcctgcacaggcatttgtttttccagccgcctggcttttgttttgagcaaggtggaaatgaaaactgtctctaagggagagaacgctccctccaggtgcttgagtgactccaggcccagagagcttaaccgtgcccctttcaccttggcctgggtccttcttgactgaataagacacatttccgccatctaataaggaaacttggaaatgaggaaggaggcccgcaggggatatctgggatgccctgtccatgtaagtctttctccccagtgttcgtcggctttcctgattgcctaatccagacaggctctggcagggacccctgaaggcgaaccacattgagctgggtgagagattccccctgtgaaactcaagacatatcgagttcaagaacagggctcaaaagcttgtggggctaaggcaggtcatggccacagggtctctctaccagatccccctcccccatctctgtgcgccccaccactcctgcacccatccacatacaactaagccttgcatttacttgcaagtttcttgagacatggctgaaaaaaaaaaaaaaaaaagctgtttttgccaatgacactgatcttccctgattcataatggagtcagaccttcgaattcctcctggggacagaaggagaagtgactaacaggaagcccttggga

SEQ ID NO: 7120 - DNA, 1953 bp, artificial
  synthetic oligonucleotide
gtagggacctgagccacactgtggagaactcgaatgccaggcaacagctttaatcttcattccacaggcaatgaggagccattgaaggtggttgagcaggagtggcatggagaagtgttgtaggaacactaatctagccaaaaagcaagaggataacttggaggtagggagactaggttaaaaaaaaaaattccccaaatgaatgttagccacagtggagattatttcggaagggagagaaatgaagggggctccctgcagctctggccccaagagaaaggcccctgaaaagaattgcgtgggagctgctaaaagggggaccagctcctcgcctgcatggcctgattgttccttctggcaaagatgtgggcccactcatttctctcctattttctttcctccaaaaatgcttttggcctctggtttccgaaagctttgctcagtgagtttaaacagcatctcacagcatggccgagcaataacaaatggcgcctggtggctcgcctgctggtggcttaaaaaacaattgatgacttttaatcagctgaatgagcatgggacaaatgacagcatggcctgaatgcagcccagacgtcatcggctgacatcagtggggaggagggaggtgcccttctggtgagcttgggaacaaacaggagcagaggctggcgcttgaggctccaggaggcagctctgctctcaccccaaagcggttgccttcttctctcccttctggggagaccaggtgagccaagggctggggcactggaagaccggggttcagggtctccagatgtcacttggtaactgtaggcatcagttcccctccagacctcagtttccccctctgataaatggaggagatgaaggcaagtttgtgtcttctgttaagccgccccatatgtgggatagctttagactgaatctctaaaggactcaagtgaaggtctgtttatatatcctgctcctatcaaaactatcaaaaccatcaacactccccactgcacggccactttcccccacctccccctacccacacaccaaatggatactcaccaagcattcctttttttttttttttttttttttgagacggactcttgctctgttgcccaggctggagtgcagcagcgtgatctcactgcaacctccgcctcccgggttcaagctattctcctgccttgtaatcctagctgggattacaggtgcgtgccaccacacccagctaatttttgtatttttcatagagatggggttttgccatgttggccaggttggtctccaactcctaagctcaagtgatccacctgcctcagccccccaaagtcctgggattacaggtgtgagccactgcacccggcctcaccaagcatctctgataaaggagtgcaaatttgagcaaaggaagcaaaaatggcaggaatgaaaataaaggtatttgttgagtgcttactacatgcctggccccgtgctatgtgtttataggcattatctcattatccccatctcacatgaggtgaggtggggaggaaacaggctcggaagggtaaaggaatctgcccatagttctaccaccagtaagtgagggacacgaacacatgcctacctgcttccaaagcgcttgcccttcctcacttttccagcccaaactgggacacaggagcaacttaagaaagtaggctgggggaaaacttgacctgatgcaggaacatataaattatattaagaaatgccacaggtcacacctcagtcacaatcacaggaacgcaagacctttatgccatgaatcttccctgaccaccaaaatttaggaattaagaatctgcttcttaggatttttttttttaatcctgtgcttggtccacaggaatggacactccctcctggccagcttgcccaccctccaggccacagtttgcacactgtttgtctccccgagaagagctacccctc

SEQ ID NO: 7121 - DNA, 8422 bp, artificial
  synthetic oligonucleotide
aataaaaattaaaagaagtaaaataaaaaatagaattataattaaaataattaaaatttaaaatggagtaagtcatattaaaaacaaaggtaataaatactgaaaactcacaccttcctgactgctttgctacagtttactattatttactctcatgaggttatttaccctttcatgactgtgtggtagaaatactatgtaaaaggcagggcatggtggctcacacctgtaatcacagcactttggaaagctgaggcaggtggatcacgaggtcaggagttcgagaccagcctggccaacataatgaaaccccctctctactaaaaatacaaaaattagccaggtgtggtggcgggcacctgtagtcccagctactctggaggctgaggcaggcgaatcgcttgaacccgggaggcggaggttgtagtgagctgagaccacaccattgcactccagcctgggtgagagggtgagactctgtgtcaaaaaaaaaaagaaaaaagaaagaaatactatgtaatgctgtgtccgtgtcttttcaactccatggtcagcaccatcacgtgggcagcttgagactggctgtggtgggagtatttgcatcatggaaatcagcagatactacaagtcagggcttggggggcagggagccagttgttaaacatttactagcacatcaccagaatcatcatttaagttcaataatttatgtggctgatttcatgtactctgggcagttctatcacattccccaaaattataatgtccgctctcacccaaaacaacacagaaagttgggggaggaaggggttatgttcttcccataacctaatctgaacactgaggaaggaggagcccacacagtttagtgctaagtgccacagtgcagataggtgaatcagggagtccaccgccagggtctagactgctgtggaaagcttacccccagggacagatgcctaacatttgcatattcaaattgaccagtggggaactcaggatatcttgtctgtgattggtgggatgacttagggactgcccatgggtaccacttgtgctgtgagtcagggccccagtagcaatggatggcagactcagcaagagggttaactgacaagagtttgtaaagggactatttacagagttgtgggcagattacagaaaccacaagggatagggaagtaccctgggactagcaacaatgggaagctgccaccactccctggactgagggagccaggagtgggggctgttagcagaacctggaaagagctgtaggtgagggctgctatgggacgaggaacgcagccaccaccaaaagggcagcccagctgtggaaataaatacccaacctctgactcctcctacctgcctcccattggccaagccaaccagaagccagtggtcaaggcagcccaagggatccagtccccaaggatcaaggatcagcctcctgggcacagaaagtggatggggtgaggggagggcaaatagatctgcccggccaatatggtgctgcccctaccagtctgctggcttgaagaggatgtgccagagaccactcacctgcatggctggcccagtagaacaaaccacaggctggctgtgggcctagaggcaggcaggccagccggagcctggcagagatataccagagtcaaaggagggccatccaagaccgtccagttgacctaaacgtgatgtggagagggatgtgtcttagctacacctatgtccagaattaagcctctgcacaggtgtggattttacctcgaggctaataaagcttaaagttcagggccttgactcgcacagtccccttccaaggccctggtagggtcctagcagttatcatttgtacctctgcactgtttttcttcaagaaggccccaaaattcacgtaacttttaggcccccaaacttggatctgaccctgcagctgcattaagaagagattgggctgctattctggtttctccttccagggggtaagtttatccgcagggtacaggagggcagaagggactgtacctccccacaagaggggttttgcctccgctctgcttctcttggaggagcatttcccaagctcctcctcctcacctcgttctgggagagggttaatagacgtgggggtaggaggcctcttggggccaaatacttctggaaagattggcggcctctccactgccccccacccaccaacctccggaagattcacaatgtacattagcatagtaaaggctccagataaagaaaacgtttggctttgtttactgtgggggttgcccatacttcctggagcttaagctgaaagcgaaaggatgagtaggagtcagatagttgtaggagtcagatagttttaggagtcagagggttttaggcttgagggtacagccccagcaaaagcctcgcaaagcccggagaactggaagaaattgctgctggaaggcagagtttgaggtggtggagccgggagggatggactagaggagccccccaagcaggcctttcatcctgaggacaccgggcgacaacgcgctcagagctctgaatcagagcttccctgaatcacaggcagagctcccagctctctgaaggcttggcatgctgctgtttgcatccttccatctgttagcgatgtttcaggctgggcaggcattgtcctcatagagtttctcccccattgtctctgcctctgctcaccccaaagctggcagaaccacagcgcccagtggcctctggctgcagagggcatgaggacttcaggctggtttcccagaaacaggagggtttgtagataaccctgataccctatgaccaaaggcaccgttcccaaaacccctgcccatggagctatagcctagtgctgccaagtaaagtttggttctggaaaaaacaattagcctacaggggtagcactagctgtttctgaagttctacagcccaggccaccactgggtgctggcctcagtcccatgaaccttcagccctgccaatgagaagaattcacagatttattgtcttctagaaaggttgggggacacattcctccatgccactctctgctagttgagggcctgtcctttttccccagggaatagtatctccctggccagagagcgagcggaccaggctttgctttccagcctcacataaccaccctcccgatgccaaatatgacacattcttcaagctaatgacctctgcccccaccttaaaaataacagccctccacttcatccatctttgggctgatgactgctttttctcgagcaggcacggactctagcagttcctttgttttccagtgatgctttttatcctccatctgatttcatgtcatctgtgtctgtgactgagcagggctcccccgtctcctggctcgccccgcccatgcacctttggacgtgagtctggagagcctctgattccatgtacagatttgcagggctggcatttgcctctcacattggtgctcagagtggccgtgtgaaaagagggcggtctggccgtgggactgacttcccagagcaacagggcaagctggtgagtaagaaccagcctttttgctggcaagggacctgggcagagatgggccctaatatacccaggagcaacttgaagaataaatacaagtcatgagcagcattactgccagagtgtgacagctggccacctagccctagatgggtacaggggagtgtgtagagcctggaaccttctggaatggggtaaaggagtagctgagggctcctagctccacccttggctctttacatgctcctgaacacacaagggtcccgcctaaaataccggagggcatgggagtctacgtgttagtccctgtggcaatttgagtcctccaggtagaggacaccaagagagagtaagtgtgagagatgtattgggggagatttttaagaaggataaaggggggggggggacttcagaccgggaggcagctctgacccctgcagaaggagaggggaaggaaggaggggtgggtagggagagcctcagccggcagcgcagctctgagaaagcctcagccaggccgatggggagccccagagcacagactgcccatcagaaacttcctgtgtcaggcagtaatgacccagctctagtccccctgctatgctctgtcatcgggcgggaacagcctggggagggtggcctcagcaagaatgctgcagcagatcccgaaggtgccacagccagaggctagcaaaccatgacacttcttccagaaacttttccgctgaagggaggtctgggcagtgcccttgcatggctgccactgtccttttgtgtgggggtaagggggtatcagtgaggggaactctgaaccctggtctcatgacctcagtcaagcttttctctgttgtagcttcttagtgtgtggatgaggggaatgaactataccacatcagtccccatctctatggggatgcttgacaccctggattctggttatttcagtctttgagctcctagaaggtagacatggaatcaaaaaagataccgaagggcctccaccaccagagacagacacattgcagttggaaagggtccagagtccttttccacttgcaagtacagaagggatgtgggcctggcccaagaccactgagctatccagtcattgattccattattccacaaagatgtggtagccacctactccgtgcagatggctactgtgtgcccaagggggccatgggtctcctgaggaccagacgggcttcagcaggaagaccttgctgcccatctctcccacccagccttggtgattctcaaaaccgaggggcaatattccagatcaaccccacttggtcctgaggaagagagaaatggtcaggggcggagggtgggggaggtctcaggacaaataatataatcccagtgactcccccgacacttcccctgcactatcacctcacaaatacgtgcattcacacgtgcacacacgcacaaccacacagccatctttggcatcattaataatttatctttgaagaagcctgtacagtttacaaatattaaagcattatctcactattttaatcacaacgactgctttggggtattctcgttctttctgataatgaagctaggctccgagatcaaacttcaacaaggtcaaagggatggcaggtggttcttaacctttgggactgtctcagatccctttaagaactctcccctcggaaaaatgcatctacccagaattttgcccactctttcaggggtttgcagtccctacttcaagcccttgcagggctccgcctccccaccccagtcccggtgcggctgagttggacccggcggccgcaggataaaatccagagaggagtccgtgtgacggcgcagcaggattaagaaatctcccagaccaggatgggcacagaaatggttaagggggtggagggttttgtttttcacctctgaggactctgttatgggtcattaagaacacaagaccgaacgagcattccatttgctgggcctgcctctagcgcacagctctgcttcccgacaagataagttctgtgcaggaaggaaatcctgggcccagggaggcagatgggaaatcaccccagataaggcggctgctccgagtgctggagtcacacagggcctttctgctgcaagaatggcactgccgagagtctgcgtttcttgccagctgaggaggaggaggctcttcggaggcgtctcctaacacattgctgttctaggcagctctgcaaggggaaccccccaacgggggtgcagcaccgtgcctccaagtgaaggagaggccctcgggttcccggagtctggagaggtggcctccagcggtgccccggccgcctccggctaggcccgcacacagtttacccccacccaggcctcctggcacccccgccccgcatccaccacccaggtggtacctgtgcccgcgcaggtgaggaaaaaggcctgtggaaaacatcattactgataaataacagttcctttcaggtttaatgacacgttgcatccatcctaaatctctcaaaaaaaaaaaaaaagaagaagaaaagaaaaaaaagaaagaaaaagaaaaaagccctctcgagggactgcgcctcgcgcctgtaaataggaacgacaggccggggcgcgcgccgaggcgggcgcacggcttggagcgggcgtataaattaaccgggggccgcagagtgaatacattgcacgcggtatttattatgcggccggacctccgaggggttctccggctcccggacgtggcaaatcttgtccggagcgccgctggccgcgctgccaagggctaggacgagaggacccgtggcggggggcggggggcttctcctccagtcctcgggagccccggggcagcccgcttacagcggcggcagcggggagggtttaggcgaggagagacgcggccccgggcgccgctcgggctaggggccgggcggggagggcggggcggtgggagcgggcggcgcgcccggccccttagcattccgccggcgcgcccgccatcgccgcgtgcgcccccgcgccccgctgtaattaccccgattaccaaatgaatctcgcgcttttgtgctcgccgggcggtgggtgcggggaggcagttctaatagttgtcattagggccgggggaggcggggcgccgggggctgagggtgggagcgcgggggtgggggaggcccgccattccctcgctggctcgcttgttcgctggcggtcccaggcggcgcgcaggccgctgctggctgctgagtaatgattttttttctaattggaggcgaacagcggccctaatggatggagccgctctcggcgcgttcgctgcgcccgcccttcgatcaatacggctcgctgagaccgccgggccgcgctccccggccctttgtggtcagagatgcctcgggggccccaatccccgccaccaccaccggccccccatgctgcctcagcctcgcccggggagttcccagccccgccactccgagacaccacccctcctccggcctacccccaccccggacactccaaccccaggctccttcccgcacccccgcgcccgagttcccctctcggaacactcttactccagctcccccaacactgcccccgcgtgtccccgccgtcccgagccctccatcccttcttgtcctcacactatgcccagtagcctggtccccgtggcctctcagacagggtgggttagcagggaggtgtacgggagggcagacccgggattgccaccctcaccccttttccgtgaccgcgtttctgccaagcgccccaggccgggaggagagccgggcacaggcgacagcctccgagagtttacgccggctggtccgggaagggttcgctgagtccaattaaatccccacgttctttccttcttgagcccactccatctcggactggctccaactgggaccctccggctttctgaaggtacagaaacttgcgagcacagacacactccctgggggcaccagtttccaagaagccctctggaatgtttagctcagaaaccggacagcatgcacaagtcctcctaggtcaggggtcaaatgtgccctctgttttgcaggcccttcgtgcactgcttctaactagctggtgaccttgggcaacgactcagtgcctgagggactctttttcttacaccttacagaagtttatccagctctacaagctaggcggctgggatacaacattaaaaggaatggtcaaaccttcccactccttcctgcagtttagagactttcctccttccaccctgcggagagcggctcctgggaggcccaagctgctccacctaccctccttccttcatctgcttactttctgttgctggctgtgattcctgcataacatttagcatcacctaacataataaacacttgcttggtttttttgtttgttttttgagacggagttttgctcttgtcgctcaggctgcagtgcaatggcgcgatttcagctcactgcaacctccttctcccagattcaagcaattctcctgccttggctgggattacaggagcgcccccccaccgccccaccaccaccacgccaggctaatttttgtatttgtagtagagatagggtttctccatgttgtccaggctggtctcaaactcctgacctcaggtgatccacccaccttggcctcccaaagtgctgagattacaggcgtgagccaccgcacccagccaacacttgcttgtttgtttattgtgattcttcccccactactatgtcatctccacaaggactgggatttttatccattttgtatcctcagcacctaaaacagagcttggaacataataggtattcagtaaatattagctgcatgaacaaattgaaacaatttgaacctggtgaaacctcttcctct

SEQ ID NO: 7122 - DNA, 1010 bp, artificial
  synthetic oligonucleotide
agttggtgagcagagcagcctacattaaacccagctccaaagccagccctgggtctttgatgccccacagaaaatacatgggaggagccctgcagctcctgaaaggagctaacatctcccaagccccacttccaggggcaatctggggccagccaggtacttagatggacagatgaccaaggagagaccactcaagccctcagtttgagaatgcattcctctgcgttcacaggcttacctggagccagttccccaaagccccactggactttttaagcccccagaggccttcagacaggaacccactgagtcttcaaacccccaatctccatggggttaaaacaatccccaaaaggcaggacttactaggagtcgttcagaaactggcaaaagcaccctctgaataaatgttcagggttccatccggagacgcccacggtgactgatgagtcatcagatagccagctgtcgccacagagtgctatatatagaagctggaggggtgcctggtacctaaagaaaggggaggagcacacacctagtaggtggggtctcagctgggaggcaggcctagagcacctggaaactgcaccctcagctccctctgcccccccagcaaaacagaatctgggtcagcaattccccggcacagaatgccgcgtgaactggaagcaagcagcaacagggccggacgtgggccatgccagtgcattcatgatgattactgctaatgatggtaatgggagaataatggctcagtgaacttcccgcacatcacctcgtcgtcttcccatcagacatacacactgaggacgcgcttgtattgctgccatttagacagccgaaacagaacttccagacctcaggcttggtaggctgggcctgtgctgtccaggacaggggccactagccacatgtttctactgaacacttgaaatgtggcccggccaaattgagatcctctgtcagcatagaatgcacaccagactttgaagatttagtttcaagaa

SEQ ID NO: 7123 - DNA, 1396 bp, artificial
  synthetic oligonucleotide
tatgacttcagccccaggtatagtctggaggcaactgcatgagacagagaaagagagagagagagagagacaaagatacagacagacaaaaacagagacagagagaaaaaaaaactagctaagagcagtcaacccccagaagagtgagagataataataacatggtagtcgtgttttttgtcactacgttttggagtgattcattatgcagcaatagataactggaacacaggccaaaacacaattgcgtgggcacacgcacacacacaaggtacacaaaaatcctccttcacaggacctgttttgaggctcctggcagccagcctaggtgctggtgctcacgccacagactctggggccagcctgccaggattcacacccctttcccaccacttcttagctgtccagccttggatggggaaaccaacacctctgcctcagtttcctcatctctgaactggaaaccatactggagccctccatctgggatggctgggaggattaaatatgctaacccacatcaaatgcatggggccatgccaggcatgcagtcggcacttgataactgtttgctggaatgatatgactcaacatctgcctttctgcttcctaacaggtgggctgagaaacacgccatttccggcagacacgccgctgaccatctttttccatcacactgaggtcaccagcacagcctcacacttatttgttttgtaaaaatgtcagcagctgggccaggtcccctcccccagcccctgtggaaagtcagctccctctccctctgcaggcgcttcagatctgtccctgccactgtcatctcccgcctttgccttgcaaaccacagattagcagaagacaaaacgctggctaagggctgacctcaatacctgcttttaaagtcccttggcctggcccagccacagagctgtgggacacaggatgagcaggaagcagacaataacagttggctgggcttgcaacatcctcttgcctctccttttgtgggatggctaaatggtgcagcttttgggatgccctggtgcctcctacgcatggaggacccactttccagaggcaactcccacagccaggaggggacaggatcatgacaaggtgcttgcggctttgccaagtcctcctcactgccctgggctcccccagggtaccagcggagccagaggccaggttcttcccatgaggaagcagggggtggaagagaataaagtcagcagaagaccccttttctgtctagtcaaggcccgcctggcctccagaaaggtctcctctgccttttcctctggggcaaccccttgattgtgccccatactaaatcccctgtcatgggcattcacgctcctctgactttccagctgtgtcacttttgggggggctattg

SEQ ID NO: 7124 - DNA, 3304 bp, artificial
  synthetic oligonucleotide
cctgtagcatttaaaagagtggggaggggtatggtgtatcgagagcccagtctttgacatcagatagactgagattcaaattccacctctgacacctaccggcttcttgctcttaggcaaaatatatcatctctctaagcctcagtgttcttatctacaaactgaggataataataatatttaccttgtacagctattatgagtattgaaagactagagattatgtttgtaaattgacagtggaagtggtgatgatggtggaggtggtggtggtggtggtggtggtggtggtggtggtggtggtagtggtagtagtagtgctggtagtagagatggtggcggagatgatgtgggtggtagtagtgatggtgaatcataaaaggactgaggttaaggctttgggcagggaaagtacctacaatgaggaggcaaaatgaagaggctccccgtatacaaaatgtagaagtagtagtcagaagacagaaagtcagctatacaatccaaggtcctagaaaccaaagggaaaacgagtttcagtaaaaaactctaaactcaaagtggacaaggaagatatgaacaacagccattgggttttaaaaaaataaagtgactatgacctggtgaaggagtaggttggtggcaagggattaagagggactagacatctgaaaagcagggcccagcttgtgtggccctctctcagaaggagtttggtagtggaaggatggaagatcaaagaacctgtatcagtgagaaatgcctttggctgcaagtaacagagtatatatatatatatattcaatcaaagatgtaacaaaagaaggcaatggagagaaagagaggggaaatatgtacaaatgctttgcattcagagttgaaagaatcagccataggcaaaaaaaaaaaaatcaatagctaaaattaaaaataaggctctttaatttttagttcttttctttgcctaagagctctttacagagcatttacattgaagaacccccatagttgggtaagactgagctatttgtctttgctacctgtccctgaatatcttccctagtggccaccaggaaaaagactaatttcccagctacctgttgtcatgtgactaagttctggccaatgggacatatggaagcatggcgtgtcagtttccaaaaatcttccttaaaagacagcctgtctctataaagtactaagaggagtcaaaatcatagaggcagaaagtagactggcagttgccagggaatgggggcaggggatgggggaatcgggagttagtgtttaacaggcacacagtttcagttttacaagatgaaaagagttctggagatgaatggtggtgatggctgtgttactggtggagggtgtccacgttcttggtgttttgaacaaagaattggacaaaacacacaaacaaagcaaggatagaatgaagcaacaaaagcagagatttattgaaaacgaaagaacaccccacaaagtgggagcaggccgaccacaggggctcaagagcccctttacagaattttctgggatttaaataccctctagaggtttctcattggttacttgttgtgcaccctatgtaaatgaagtagtggcctgtaatcacaagctgaagtgaagttatacaggttacaccctatgcaagcatctgattggttgtggaaagcaaccaatcagaggctaaagtgaagttacaaagttacacttctatgcaaaagaagacttcacttggagtccatctgattggttgtggaaagcaactgatcagaggctaaagtgaagttacaaagttacactcctattggttgcagaaagcaaccaatcagagatactttcaactttccatctgcaacacagaaaaaggggatgggggttgcaaagggagtagcctcccgtccttttgtgtttgttgttgttgttgttgttgttgttgttattgttgttatggagtttcactcttgttgcccaagctggagtgcaatggtgcgatctcagctcagtgcaacctccgcctcccagattcaagcaattctcctgcctcagcctcccgagtagctgggattacaggcacgtgccaccatgcctggcttattttttgtatttttagtagaaatggggtttcaccattttagccaggctggtctcgaactcctgaactcaggtgatctgcccacctcggtctcccaaagtgctgggattacaggcatgagccaccacgcctggccacctcccgtccttttgttactcaggtgtggaaatttggggttttccttttgatttagttctaggaagtcagtgcgaattggccttaagttccctgcctccagaccctattctcccacctcagctgcacgccattatgagtacatttaaaaatgtctcagatggtaaattttacatcatatgtattttaccacaataaaaaaatattgaggaaggggtaaagacagctagtctgtgcctcatcatccctttctttttagttgctttctctatcctgctgcctgctgccttaaacatgggtatcatggctgccatcttggaccagggggctaaagtttccatcctttgaaaggtggagcagtgaacttggaggatcctggatccctgaggatttcatggagcagagcagtcattccagctctggactgcagccaaagcttgtcttcccagatacagtccccagggaggggacgaccggcctggatacccaccaagggcagtctctgagattgagattcacccacagataccagccctttctctaggggcaggactttgacatagggccgtccccagtcttcctaagcaccactttgtggaagggaggaaggaggcccacattgccctcagtctcctcagtctggagaaatcttagaagaaaggtgcccagagtggcccttcagggctgcttgtgagacacccagcctctgtgttggctggctggctggcaggaggacaggttctgatctcagctgtgcatagctaataagcagtgacctcacattggccagccaagccgatttgagtgctttcaaggacaaaatgtgtcctgatatctggaggcgaaaatcagaaccaagtagcactgccttgctatttctagaggcaaaggaaaagcttttagaggtcagttccatccctgttctgccagggtggcctcccctcagcaacacgagtcccccactcccaccccaaaagagtttctgcatcatttctccttgtgaactcattcagcacatcccacccactgcctggttctgtggtcgtctttggggtaggtgtgctatctccc

SEQ ID NO: 7125 - DNA, 1517 bp, artificial
  synthetic oligonucleotide
aggggaggtggctgccaagcaggtcagagaagttcctaactgatgagccaaggatctaagctatgagctaggcctccctggggccctcaggaggtgacatctggggttcctaggctggccctgtctgtgccaggggaagaaggcagagaatacggtgaggactgagagctggagagggaagatcaaggcagcggcgatggccacagtgatgagacagtgactaagggccagtgtgcggtttgccaagcaatttggcttgtccccatgccaacaataaaggcccagtgtctggcaggagatggggattttgtgtgcagagggacaccttacgactgaccctggcagagagccacagtcatcaggaacaagagaggagaacagatataaggggggaaaggtctcctttagaggggcaggactggcctcaggctgcaggaagggtgtctggggaggatgcaatggagttgaagaaatttcatgtgtggttgggggcaggggttgccctactgaaggagtctattatgtttggaataatctctcaaagcaaggggaaataaagtacaatcagtggaggaaacctctggaacaatttaagggaaactggacaaaaccccccagactgtaataaaatggcatctggagtcctgctggttcccaaggactctctaccacaggctggggtctctggaagcagacgctgagatggatattgggggttaagaggaatttgtgagggatcagatcctgtgaaaggaagtggggggcaagcaggacttggcagagcgggtagtcaagctgggatacaggtccaacagagtcttgactaacctggaggagagagttctggagttctggagagttcccggccaaaatggcaagccctttatttatttatttatttatttatttatttatttatttatttactttgagatggagtctcactctgtcgcccaggctggagtgcagtggcgtgatctcggctcactgcaagctccgcctcccgggttcatgccattctcctgcctcagcctccagagtagctgggactacaggcgcccggcaccacatccagctaattttttgtattttcagtagagacggggtttcacagtgttagccaggatggtctccatctcctgactttgtgatccgcccgcctcggccccccaaagcgctgggattacagcgtgagccaccgtgcccagcaaaggcaagccctttataacaggccccccaccccacttcagcaccagatatgggccaccccaggagagtgtggccttggccgaggcattcttaaacgcccaaggcttgacagctggaggctgtctggagactacacagcctgcagctgggcagccaggccttccacaaagagagatctgggcggtgcccctccatgtcagccactccctctcccctccctcaatgtctaggcttctagcacatctggacagatcaatctctttctttacctcggggcctggtcgccccctcactgttcctccggaggc

SEQ ID NO: 7126 - DNA, 1322 bp, artificial
  synthetic oligonucleotide
aaatgtttgttgttttaagctgctaagttttgggggtaatatgttacatagcaacagacaattaacatagcttataactaatctcctaacactactacactaataactagtattcccttcacctccaagtcttctcaggccagagcatgtaaccctgactttcttggccttacacacaagcacacccatacacatacacacacacacacacacacacacacacacacacacacacctgctgctttgatattggtgcatttgcattatttaacttggtttctttttccctaaaaagcatgtgaaagttggtcctcctacacagaaaacatttgaaattgcagttatgtcatcctgggagaaagcgaaccttgaggttccgtgcactgtaccacttaccttgactgcctggaatacatccccgtgccttttgcgtgactgcctttgttttgagcacatcctaaattgcctctaagccaaatgctgaatgtgaccagaaatgacacaggatgaataatgtggcatataattatcaccacatttcagatgagggcaatgtgcatttttctcagagctaaagggatgcaattttattttgtaatacaaaatgctccatttgggggtcagttttcgagcagcccttcattctgaagcaatttcacgtgaataaaggcatttgtattcctgtaccgcgtaacacacattatcccagccccgactcctggtgtacatttctccacgtgattccacctcctctcaatgaaccagcttcagatccgaatgagaaggtgaatatgacgatgtttttgactttttcacgtctctgagtatttgtctccttttctgccaactgaggatgagctggtttctctacaaactgctctcagaccccaccctggggactggatctttaacgccccaaagaaggccctgcagaccttagcatagcactaaccttttgtccttgattgatgatgtcctaattttctttctccccaaaagcagactctgggtcaacgatttgggactgggcagcttatttgggaggtatatgagtttgttcaggctgccataacaaaatattacaggctgggtgggttaagcaacagatactagttttctcatagtgctggaggctggaagcacaacatcaaggtgccaatagagtcagattcctctgaggcctctctccttagcttgcagatagctgccttctcactgtcccttcacacaattgtccctctgtgcacactctcctggtgtctctttttgtgtccaaatttcctcttctcgtaaggacaccaggcatatttccattagggctc

SEQ ID NO: 7127 - DNA, 1228 bp, artificial
  synthetic oligonucleotide
ccatggaccccaagagtggatggaccccaagatctaggagaccaagcctaaaggagaaaacaacaggtcagacgcctctgcttgcagggaagtgcctgcactgctaggaaatgaggcacagccctcactcttggcaaccaggacaccttatgcccgggacactgggggtggggggtggggtatggaatctgtgggtgtgccaggcaaacaaagagcagggtgcagaggcatgggcggggcccctgacgcaaaggacccctctccagttctcgattagctgggttcaagcaaggcctgagggctaaggcaagctattccaggctgattcagagctgtaattgccagttatatatttctctgattgactgaaaaacaatcaaatgaatgaattcatgactaaacaatttatagacagactcgggaggtgacactcaagctgcctcctgacagtaggctgcgagcgagtcaggaggggctggagaacattattattctagaaaaaaagaaagtcattgggggcagccatgtggggtgcgctgggcgcaccggtagcttggtgtttctgcagcagagggcgaggagcattgagcctggagaggtagctcagagaggggattataaaccaccgcaaggaacttggccttcatctccagacactggaaaccccacaaacggttttcaggagggaataacagagtccaatgtgcattttaaagagaccattcaggctgttctgcggagagcaaatttgaatagcatggggcaggcagtcgagaggcctgggagtggagatgggctagggagatgctcccactgcgtcaatgacttcccccaccccccagccccggtggaatccaataggccaggaatctctggccttccccacatagccactgtcaacctgggagtcctgggagagatttcataaaaggggtccctaggggagaagggtggggacccactgctagggaagcctcatctgtcagtcttcctggaagccaatgacagcagggccccttgggaatgcagatgacaaggcgtctccaggcagagcaggaggctgagaggtgaggcaggaggggccacgattctccattccgcccttgccagcccagaaaacaatcacaggaaccaaggcgtattcattcccagcaagagtgggtcactgggaagagagaggcaccccgattccagatgaaagttttgatccccccaaaaagagaaggcc

SEQ ID NO: 7128 - DNA, 5323 bp, artificial
  synthetic oligonucleotide
gacagaagacaacattattcctttctccttaggagattgccaacaccatgccaaaggatcgacaggggtggcagcagcaccagcaggaactgctgaaggcctttgtgtgggccaggcaggggaccgggaggtagaaaacccaggccctacccttagatcacgtaggtgaggccgcaagccacagccaggcaaggctgcgcaagctggggcccagggatccatggaggcatggtacctggcacagacccaaaaatatttactgaatgaaaacacaaaagaaaaggaacggagtcatccgaggctccttccaccctcacttgctcactcattcattcattcacttattcattcagtaaacatttctcgggctcttactgtgtgtcggcaaaaccctaaacaatcctgactcgagataaaggggtgtgagccaacagagccctctcacatggccaatgtttaattccacccaattcattctggggccttccaatgctgggtagatttatagccttttcaggtgatggatgacgaacatgtgctcaatagaaaaggatggctatgggtggcccctacagatctggccacttcttcctattcttccccagacaagtctacctctgtccagggcagccaatcagcctcaaatgggacttggctaaatttaaaaataaactgttgctgggcacaaggactcatgcctataatcccaacactttgggaagctgaggatggagaatcacttgagcccaggagttcgagaccagcctgagtaacatagcaagactccatctctagaaaaaaatgaaaaatgagccagacatggtgatgcgtgcctgtggtcctagctactcagaaggctgaggcaggaggatcacttgagcccaagagatccaggctgcagtgagctgtgatctgccccactgcactccagcctgggtgacagagcaagaccctatctctaaataaataaataaaaagtgtttgaaggcttcctttttgtatcaagagctggacaaacctgggatagtgggacttcttcattcacacacacacacacacacacacacacacacacacacacaaccttggttctcccatatccatctcttcaccccatccacctccatctcacaaactttcactttgcctttgcaaggaggacagcagacttctgagaaaccttaagaaagactcttctaaggtttcaaggccatggacttttccctcagcagcagtaatgtgctggtaaatattaaacaaccgaatctcccgggggtgggggggaaaaccccgattgtagcatttgctgatttctgtggtgtaaatactcccaccagggccaattccaagctaccaacatcacatcactgactgcaggggttgggaagagacatgtgtcatcagctctcatcgtctggcaagtgccagctcccacttgagagcttcagaaacaagcctggcatttcccagatgcagcacgaaagcaaaggggagtgagggagcgtgctcgtcggtggtcagagggccaggtctctctttccctgggactctgagatgcagtacggtcatctcaggggctgccttgctcccccctggaatctgttcccatgagaaagagaaaggaaaacctgcgatcactccagcagaacctcagctactccccccagtttagacaagattcctggcttctctcttcttgctctcgaaggacccaaatggtaaacacctgggagagaagactccacactccagaaagtgaattgtgatttcctttaaaagcctatgcattcccacagtgcaatatttcataataagaaaatgggaatcaaaattcttccccactaagaaggaacagtggaatgagagacggagaagtcactgaggtggaaaaattgatttgcaatatccacagcagattcggcggctttaacagcacctggataaacccagcacttctgccaaagcctggatgtttttagagcagtgtgcagcttcactacgagcgatttgcatccaagccataaaggatatgtggcgggttccaatgccagcctccagctcctcttcattgcggaactgctgataatctttaccgggcccctcttccttttgcaattccttatgtggtcccaagcaggttgggaccacccctctggcttccagccctcataactggaaccttggtttttgctcatgcactctggcagactgtatggttgctcagcaaactttacttccctatccccactccaacccctccgtggaagaagtatacttcccagccccatagatgttagattcagttctatgacttaatttggccaatggaatacaagtaaatgtgatccggctgtgcacagtggctcatgtctgtaatcccagcactttgggaggctgaagtgggaggatggcttgagctcagaagtttgagaccagcctggccaacgtggcaaaaccccgtctctacaaacaatacaaaaattagccgggcatggtggttcacacctatagtctcagctacttgggagactgaagtgggagaatcacttgagcctgggggggcggaggttgcagtgagccaagattgtgccactgcactccagcctgggcgacagaagtagaccctgtctggggaaaaaaaaaaaacagtaaatgtgatccaattagaggtttttgatgtgcttgttttgttgggcctggcctcctacactctcacggtctgccatgagaagaacattcccccgaggtactgctgctacttgaacctgggaccgaccctggaatgagagatggatggtgctaacctaaatccaacccaaagcctgaaggagagaagccacagccatccgtgagtgagaaatgagtgtctgtggtaagccacggggatttgaggtcatttgttatgcagctggtttgcagtgatagttattacatccactccaggttatgtttctttttttttctttttttttttcttttttttgagacggagtctcgctctgtcccacaggctggagtgcagtggcatgatctcggctcactgcaagctccgcctcccaggttcacaccattctcctgcctcagcctcccgagtagctgggactacaggcgcccgccaccacgcccagctaaattttttttgtattttttagtagagacggggtttcaccatgttagtcaggatggtctcgatctcctgacctcgtgatccgctcgcctcagcctcccaaagtgctgggattacaggcttgagccaccgcgcccggcctaggttatgtttaaatatagaggctttaccaacttgtttctgcagaagacttggccactcaccaacatggtgttggagaccttgcaaatcaacttccaaatataccagtacttcaaggatgtatgcatgcctttggctacagcaattacacacatatatgcttgcctgaattagcaatggtgtttggtttatgctttatctctgacaatgaatcatttgttaagtacctactgtataccaaacactatgtgtcatgtacctggaccctataatcaagaactcacagctacagttgggaactcgagttcataaaaaggagaatattttaaggcccaagtgaatgatacagaatgctgagaattcaacaggggaaaaaaatcacttttaggattagggagagtggtgggcaccaagaaagttttcacagaaaaggaagaaattgagataacccttaaagaaagagttggtctcagatgtaggctcagggccaacattccaggcaatgagtccaggtgtgctcatgtaagatttaaggggtgattcatggaacagaccagttaaggaaatggtaaactgagccaattcacagaggttttcaatgtcaaaagactcacaactctgttctgtgggcaagaagaactattagcaattttcgagcatgacaaagcagtcctcttatactttggtttaatctggtggtaacgtgtaaaatgtggaaggtagagcagacctggacatcaggagaccagatggcagcctcagacaataaggcctaaacacaaagtagagacaatggagaaagctatgcttataaaatcagaataggccaggcatggtggctcacacctgtaatcccaacactttgaaaggttaaggtgggaggatcgcttgagcccaggagtttgagatcagcctgggcaacatagggagacttcgtctctacaaacaatttaaaattaaccaggcatggtggtatgcacctgtagtcccaacaactcaggaggctgaggtgggaagatcacttcagctcaggaactcgaggttacagtgaactctgattgcatcactgcactccagcctgggcaacagagtgagacactgtcttaaaaaaaaaaaaagatcagcatatattagagtcaaaaaatcttctaaaacaagtactcacaaatattcattttacaaatgaagaaacagaggcccatagaggtgaagtcactttcccaagaccacataatgagttaaagctgaactgggaacagagtccaggaatatcagttaagaatgctagggcctgggcacagtaactcatgcctgtaatcccagcactttgggaggccgaggcgggcagatcacttgagctcaggagttcgagaccagctgggcaacatggcaaaaccccatctctacaaaaaaaatacaaaaattagctgggcgtggtgacaggcgcctgtaatcccagctactcaggaggctgaggctggagaatctcttgaaccctggaagtggaggttgcagtgagccgagaggcagccactgcactctggcctgggcaacagagtgagaccctatctcaaaaaaaatcttctggccaggtgcagcggctcacacctgtaatcccagcactttgagaggcattggcaggcagatcacttgagttcaagagtgcaagaccagcctggccaacatggtgaaaccccatctctactaaagaatacaaaaattagccgggcgtggtcgtgggtacctgtaatcccagttactcaagaggctgaggcaggagaatcacttgaacctgggatgcagagactgcagtgggccaagatggcaccactgcactccagcctgggcaacggagcaagactccgtctcaaaaaaaaaaaaaaaaaagtcttctccattgaaggttttgccttatttgggaagggaaccccttcccaaaaatctctgcttacctctaattgaccagcactgaatcacatggctaccactagctctaaaggagcctggggacttgagaatttcacttatgtagcctctgtggtagaggatgagaag

SEQ ID NO: 7129 - DNA, 16238 bp, artificial
  synthetic oligonucleotide
ggcctcagaccctaaggaatttgaaaggattatcatgattacttaagcaggggttttctgaaactcccagccaagtgggaaagagaatgaaacttctaaagttatatcccttcagcgattggttagataagtgtggggcctgagcaaacagacaaaccaggagcagcatttctccaattaactctttcaaggcctagaaaacacacactggaagcctttgaaagtccctcggggcactggtactctataatttaccaagacaagccttcattccttaaataaaagttcatgaaccgatcctttcttcatctgtttttatgcctgcccgatcccccaaagcgctacaactccatccatcccaagccatctcattcttccaagcagaaagcagtccctgagggaggaaggcagctgctgcagggctggccagagactgtccaagaagtctcagatctcgtggccatgagaggaatcccatctgcaagtcaccctagtagcggaaccagatggaaggcctggcctggtggcaattctggtctggcctcccaagatggcatcacaggcctcccctgggtctgagaagcacctgtgagaaagcctcaaggcacatacagcgacaggagcctttgctgcagaaagaaaactgcaggagacaaatctccctagttccagagatatcatcccggatcaacatgacaaaggtggaggtggttgctggcttgtgcccaggcacgcaggcatagatagggcagggagccccaatgtcagagcataagagcagggaatctctgctttcaaattcccatcgagtttgcaaaaaaggaagaaaatatcccacaaaaagtgacgcaaatttgtgtaaacccaaggattcaggatccagagtcctggcctgtctgtatctgggggaacccaggttagctcacgggacaggttttatcttaatgagggcagacccaacccctgcagcttgggtttgggcaactaaagagaaatgggtaaaagacaataatataataactgtataaaaagaggtgcttttgaattctggaaacaacccctacaaagtacgaagggcatcaagacaggttggagcaataacttttccaagaattgacgacccccccaccccgagtcttgccaatcctggacccaggaaagaggatggggcgggaggggtcttaatctgccgctctacaggcttcctgcataggcaaccacccaaagtcagtcccagcccgcgcgcagggctccctcctaccctacaacagccccgaggggcctcaagtcccactgcctggaaccccacaagccacccccgcccccgcgccatttccagtcctctgggcgaggggggtcaatgtcgttcaagtaatttctctgcgaacacaagatggcagccttaaataaatgcaaccctgcgcagcttttaatcttacacatcattaaattcctaatttacacattatgttttcgtgggccaacccataactcattagtgttgaactcacgaggtataaagaccaacgcacgacgggcgccggggcgccgtcacctgcctgggttaacagttcctgccgcgggggcagggagaaaggcgctagaggggcgcggggtgccggcggggccgagcccggggcgcgggcgagccctgggtgccaggccctgcgccgcacgccactctcgcagcgctgccgccgggaaagtgccggcgctggctctccctcccctcccgggaatagcgggcgcaggcacgcacatccacacacatccacacacacacacacaccgcacactcacacacccgggtggccgcgcggggctccgagccgcgcaggcctccttggcagacatcttcctgtgggaggatttcaaacgagccgtgaaagccagaaactacacgggttacaaactccggaatccctggccggcctcggcctccctccccacctccggcccggccccctccgttcggcccgtggccaggagccccaccaaaggacaaagctcacacgccgaaagcgcggggagatccgggggcgcagagactgccccgacggcccttctaccttctgaccctgggacccacggccaagtgccgcgcagccgaggtcggccttgctgatctgtggtggcccagggcgacccgaagcgcaccggcttcagggtgcgccctggccagggcgtggggtggagggtcacataagccacctggcatccgagggtggccgcctcgccccctcaacgccgctctccagggaaggaggcggcggggtcaccagggcgcagctgacagccccaggccccggccagggcgcaccctaaagaagagggaggctgctgcctgaactggcctgggggcagagggaagtgggccccgcgctgtggaaggccccaggctggagcgccggggacagctgtccaagcggcgagggctaggagtggcctcgcctagcgctgagccggccaggccctggaggtgctccgcgccttctcggccaaaagccagctccgcgccgctggcggagtgggagggaggcggccaggcgagcgccccgccttcgtcgcccgcggtcacaggggcaattacactcctcgctgcagacggttaccagctcgcccgcgcatccctctctcggctcccctctcctcccctctcctctcctcccctcccctcctccgcggaactgctggctccatattagcgagggtgccctggcagcgcgaccgaggccaactacccctggggaccctcccgaggctccccgcaccctgcacaccctcaagatcgccaaggcgagcccaccgcaccccacagcgcgtcccaagggcaccacagccgaggaagcgacttttgcggtagcgaaagggtggcagtacccagctccacgcgctgcaagactctagcagccgcgcttcaccccaaaactctgcccctagccagcacagctcccctagcgccccaaatcccaggtgtgcctgtttccctggagtcccgccggcgtgctttgctattcgcagctcgacgcctagacctcctgactgcaacctccgaggcctttgcgctcccaggcgtcctttgctgcaagcaaacaggcccccaaccgccccctatggtttgtactcttctggaaggtgtctttggcgctgtgaatgcaaactcaggctttggattaagggcttcattttcaactaactgtgtgatttgaggccagtttcttaacctcagtttctttatctacaaaatgggagggatattcgtataagtgtggctacgaggtttaaagaagatatagttatatgtcaaatgcttagcacaaagtcctggtggttagcattattattaccatatggccagaactgtgaggacattaaaagtgaagtaggctttttcccaccaggggtaagcctcgcggagtcctaggacacatcccacaaaccgaggtgaacctaagccaccggctacgtctgaagggaggacagacgagacgaggggcagccaactgagcgaatcactctgccttccgcctttgcaaatgaatagggctctgtctacagcttccgccattcctacgccagatctgcaacgcctaaggcttaaacttggcgcggcggtaaatttagcccgaaggcagcggctcctaaggggcggggatgtctccttggaagaaggaaagggaacagggtaagaaaatggagttgcctctaggaagaagaatcaggcagaggaaacattcagggccgctggcggaccactgacaaaaagaaatcggacgcaaaagaaacctccccagaagaaactgggccaccgtgggagccgtgcgagacagacttcccatctgggaagggctgcctacgggtaattgggtttgctcgagttgcctctataattaataagtgatttgacttggagattggaaatagtcatgaaaggaagccgcgggcgtaggggtgtgaggcccaggagcctccatccgaaatccaaagaccgcggaggaggacggtttaaggaacaggacgaatgtgataatattggcatctaaccttctagtgtttgagtaattcgttgcttagctactttggataggccattattttgcaaactggaaacatttgcaagtggtgatattttgctcttgcctgacgcaggggctgcaaacctacgccggctctgctgaactcttcgaaatatatatgcataaattgttcctaatgagaccatctgttttttatggcccctctggaagcaggaggaacccgaagcctgctccgtcttgcagaaatctgtggccaggcaggcctgggaaataaataggggagattagaacggtgtgcgtgatttaacaatacgcagaacggcaagttcggtggtcgagatgtgtgcctcgattcccaggggtgcgggtcatttagggtgactccagacatgggggttcctcctaggaggcccagggactttgcggagttccacggcacacacgaacctcgtttttccatatctggaacatcgccagagccacaacgcgaaaccacgagcctgtagctgctctggggacccaaaacaagcacccaggttgtaggtggtccccgacgtcgcccactatctagggcctccttctacggtggtgaagggagctgaacctgggccacagaggcagagaacgagcatcactccaccccatacccgggtcagagcacagagctcattccgggcctatcccaaagactgagctgctccgcgagcgtctggcaggcccagcgccccggcctgagaccgcactgagggtggcagggcaaacacttttcacattaccgcgtggctgttaattggggcagtgcaaaagacgccgcgactacccctttgcggcggcgggggaggggggagcgggtcaggagtgggcagtgggggctgcttataatagaaggactgccctggggagcctcagatatcggtaacccccatgattaattcataactctccactgcgcctggcaccgtctcgggtctttaatcggttctgaatgtcagcgaggcttccccgacagcctgagcactgctttttcaatgtgttgaaagtcgctgcgcgcacaccaggagacaaagttgccatctgctccggggaccaaggcaactgggcgctgggaggggccttcctcccgcggctcccgctgccccgggcggcctcctcttcccggcctgccccaaagccaacactgtcacccggaacgtccccgccccccgccccgggtgcatgcatggtggaaactccggcttgcagcgaaacagagcgctgcgcgcgggcgcgcagggagcctcgcggtcacccagaccgagacctatgctaatgagattataggcccgggttgtttgtgtgcgcggacgtcaaagggggggcgcagataaagtgtggaaaccgggatgacttggaggggggaggggcaggaagccccaggagaacaaagctcctggccgtcggcctccaaagagtcgcagaagtgaccgccactggctcgtgcacaggcggaagcgggggagggcgggggacgccaggcctaaagcgcctcgtgggtttagagaactcagagagggcaccgggtgggggtgggaagaagactcaacccgtagctaaatgtttggcctttggctattttttaaggaaacgaatctcagggaggtcggggcgcgggggatgggggcatcatcgcgcctcggagatgggaagcgagttcccctccgctttctgggaaaagccttgtctcccttctttcccctccccccatcctgctgagggtttgcgttgacccatctctccgctcgggaccggcaggaggacggagccgcaggggctgaccgcggcccagaggctgcccaggggtcgcgctgctgccggcctgcgcttccgcactcccgggttcggtgcgtcgcctctcgcggcagcgcctcgcttcttccagactgtaattccacactcccgcaagcgctggggctgcggaatcgtttgagggagttggaactgcatcagatgagcacgccgggaggtgagatcgggtaggaaatagccgaaactttgagttgtgcgccaccccaccgcccccaacacacacacacaggcacacacacacacacacacacacacacacacacatttaccctcccccttcccagccgcaacctccgccaccctctcgattcttcaaggtttgcagcccagtcctgtcatatggttttgtttctgtgctgctgttttttttcagacacgaaaattggacacgtggagaattagccctgctggagaagcgctgggtgcagactcaaacaatggtttccagcgccgaagctgaggcatcaccttccccacctccaccctcaaatggcagctgcctctatatacagcgggcacaccccttcactacccaccccctcccccaaagcctggttagggacctatgtgggctgcacgctctggagccccttgcccggacacaaaccctaggtgggcctgggctgcccgctgagtagctcattgcgcctgggatcccctgggatttagaagtatagggctctctatttttccctaggaaggtcctgtctcaaagatgccacccccaaaaattaatgtgtaaaaacccaaccaagctccagtctctgtgtcctttggcaaatctatctttcctagggcatactttcctaagctgctgggaccttgccccccatctgatgagccatacgcaggtggtctggcctcttcagagcagcttcctttagttattgtcttctccagaggccccatcctccacggcagccctaatcttagccccccagcctctctgagcccccatcccacccccacactgcgctgagctggcagcagccacagctcccccaggcagttcctctctcactgcgcggcctgtgcatctcgctggggcacacactccgcacagaagctccctcgcctcctggagctggtttcctcttacaggctccccttagagctgctggtgctgtgacaacgcctgcatctctgtgtctccctgcagcgctgcgagctgtgaatctgccttctcttcccttcctgcaaaggtcaagctgcctccttctctcgcagggccgcagttcagttctggcctgcagagcttctacactgcaacttgaatatgggaatggggtgggcatcgtgcaagggagcagtcacactcaagccaggaggcagggacaaaagggtgtgcgattcagggagggaaacactgaggacaaccctcagaaagcagtgcaggatttgcagctaaagactcaaaagagggagagaaaacgaggaaaaggctgttactaggtcgtgagtcctgaagtgtaggcctttctcctcccaccccgtgggttgccctaggggaaggccagaagaggcctcaggtgtctgcactgtgtcctgtgcagttcctagggccatgcacttccggtgaggctgcactttactccaagcaggagtcagaagcatggaattcagtggccgcaggagctcaagtcggctgcagccctttcaaagagggaccccgaagaggcctttctgccaccccagccccagagaggctatgaggctctacaagcagcagagagaatgatacggagaaaaatgagaggaaacgctattaaacttgcttcctctaaagagcgctacccaccgttttctctgaactgtacctaaaaagtcaggagagaactcgttaacttttgtttggtttaacattgccagcttcaagtcaaccgtaggccccccgaaggttttgtaaaatatttaatctagctcagacaatttcctgcagtccctaaccagaccaccccacttactgagccgctgccaaaaaggatgcttgactgcagactggcaaccagaggccttccagtcgcctggctggccttgacctccactcgaggcgccaggaaagacccttcccggaatcccgagagaccaagacctgggtaatcctggaggtctaaacccgtgaggaagcccaagaaatggagttaaagacccttttcgcacaaccgattgttgtctgtgtgaccttctgcggcccttgccctctctgaaccctctaaaatgggcatgaggatgtctcaccttcctctgggtgttatgcattttgaagcgtgggcactatgggagaggctgacgctctgtgttccccagcgccctccactcccaccccttcactgttttcttcgacattatctccctagagaacacagcaagcaggagcgggatccttcgactcggctgactctcaactccttccaaacgtgaggctgacggggagaactcctgctctgcccagtttccattcccgcctccagaataacgagccgaaaacatgtgtactgtaaataaagcctgtctaaataaagcactcgggtaaaggctaccgagaaaacactccgcatcgctctgtgctcagagcgtgagtcagcttcccagccccgggggaacaatggggaccttgccaagggtccccttctgtcgacccctgacggcccccaggcccgtttgggtggcgggagtgccggcaccctgggaccttcgggcccgaggttcgggagggctaagggcgctccaggcgaccagggttggggtccagccccaggattagcgcggccaggaatccctctgcccgcagctgccgcggaggggttgagggttaaacagacaccgggcagaggagcgagcctgccggctgcggccggcgcggcgcggcgcggggagaggacgggagggaagagggcgcacgctacctagcctcccgacgagaagacgtctcctccccacgtcaggccgggctctcgcccactcggctggccgcctctgctccctggcctctcaagtctcagcggaaagaaacgtagcggctgccaaaagcaccccactccttttattgtccccataagcctatacacgtacactagccacccccccaacacacacacacaacacgcacacgtgtgcgggagactcgaggatgccctgcctccatcgctcacagagtgagtaccaaggccgagcgaaacggcacccctttggtggaagacacagtgttgggaccagtggtggcctccgcgctacgtcttctatcgcaacctctgggtttcctttgcagaactgcataccccagagcagaggccatgtggagacctgcggcttggtcccgactggtgcagtggcctctgctctggtgtgggctggcggtttccccgcgcccggtgaccttaagggggtttccggagtcgcgcagccagcccttcctcccagcttctccggccaaggccgctctcggccgcccagcctggtcgggctcggctagtcggctcctcgccccgggcaggagtgcggttggtgaaagcactcggggcctcacccacgctctgtgcacacgcgccccgccggggcgggagccggagccgcgctccaacagcccgaaattgccaaatggtcgctgggcagggttggggatagactttgggaaccgggtttgagctggagaagacgaggaaaacgagtgaaacgggagaggcggggtggggtgacggctcataaatcatccagccccaccctcgggcctcagtgcagaggcgccctagccccacgaggaagaggaggttcacccagccactcctggccgacctctgagctctccgggagccagcgccccaccctaggctcaggccgcgctaggaccagctcccggcccagatcgtaaaccacccgccggaatcggcggaaagccgcccttggacacagcgcgcatccgcccaaggggaagtttatttatagcttgtaaacgtaaaggaaaccagaccgcgctacctcgccgcgctccggctgcttcgctccccacctgcccaccaggagggcgcgacgggtggagggaggtggggtttggttctgtgccccccctcccccgctcccgctccgctgccaggggagaacagggtcctaagaggctggcaagccttacattcctctcgggacgcctatccagtgccatgaaagccggagggggcggaggacagggcccgggcaccggagtggttagggtgggggtggccgagctggcccacttggcacggaagggcaggcaggccaggcgacgcggcgcgagattccacagctcccgctccggaccgggggaaatcctggagtgccagagagcccggggagggggcgctccgggagcctctccttgaaaggcgggatgctttccccgttcctcccgcgcacgtgtcctcagcagagcaggcaagcgctgcgcgcctggggctgcgatcctcgggtgacagcgactgagagcgcgccctctccacccccacccccgccgtcgccgcctctcctggggagctccagtctccagggtgcgctcggggcaggccccaagagccagagaaacggaaaagtgccggggaggcgattaggaagagaagacattaaaaagcccagccctgaaagacaggcagccgagctgaaaaagacgcctgcgaacccccaccccgccgcccctcgcctactgcgcccagacggcccctccttgtcccggctgagcgcacccacccccggcctcggccggggcgaattcgtgtgtgtgtgtgtgtgtgtgtgtgtgtgtgtgtgtgtgtgcgcgcgcgcgcgcgcgctcgagtgccgggagggcagttgcgaaacgggctcttggctgcagcgcggcataatggaggtggctggaacaatgcgcgctttgtgcgcgcggggagttgttttccacccgcctcgccccccttgctcgggccgtatggcactttaatctccgccacgactcggcacaaatgcacttgtgtcctgcgggtcactgggggccgtgcggctggagccgcccccaccccgacccccgcggaacccaccgccggctgccccatcttccttcctgagcaccccccaccaccacctcaattcccggcgtgggccggtgagctggcgtggaagcttccgggcccgccggccacttttattttccgtgaagacggcccctcccccgctccacgagcgcgcgcgcgcacacacacacacacacacacacacacgccgcccgcaggccccacactcaccgccctctctcgcctagcctctcctcggcccgcctccgcccccgcccccgcccccgccccgcgctccggactcctgcgaacaatagtaaatgtcaacagattccgcgcggcgagtgtctgactcggccgagataagggtgcgcggttggccccgcgctcctcgtcgccgcggggggagcccaccctgaccccggctggaaggaaccggctgtgactaaacccgtgccgggagaggggggcgggagggcagggcaccagtcccagctcggtggggcagcctcgccaggagaccaggccctgccccgcccccaccccacttaacccgttgccgatgggggaacctatgggcaccgtaaaagccgcggggtcgacgtggcggtcgggcctgcttttggcccacagctgcaatctccagaggatatcggcaaaacgctgatccacgtgaggactcgcagttttcgacctactgggagccagcacctgaagcaaaggattcgagtcctgatgtccggagactcattaaaatattttcctaagcgcgcacacactcgcaggtcctcctccttggtcgtcggtaacccaccacccaaccgaattaaaattcgcaaattgattcccacgcgttggtattaatgggttgttcctcttaaattgttgccaactttgctaatggattattatttaaatgatttctttttcataaagtacgtgttgttttatagatgcgtatttacttaaagaaatcaactgcatgtattaacatattaaagagagaataaagcatcggggccggtgtaatgtactgttcagccttactttgggtgctctcgaagataggaaaatcttatttgtttaataataagtcactcatgaatatgcaaatggcatcggtgcagtacctcacttctgtcactattaatgagttgcaaattaatgtgacaacaaaaggaaaatctatttagtggaggaactcaggttcctacctggggagatcacaagcaagcctggaacttgagtctccaggcaggagaggactggggatggacacgtacctcctcacgtagtgttttcctggagcctccactattgtttggtttcagggacctgctttgtcaggaaccccttaaaattcctgctccagaccagaggaagaaaggctgctccagggtaattagggccaagtgtgattaatggaaatcaacccacagtttgaagtaaagcagttggccaagcagattttggggggtctcctcccccgagcttaaagattccccaaagcctttttgacctctgttgctttggacagggttgaggacgtaaatagcgaattagccctcacaggcctgatcacaggtattaagacagcaccctatgcacttgaattttacgaggtgactttgctgatgggagatttaagagcagatcagctcattttcctgccgacctacttcccagaggttacagactgaagtctggttgtcttccatttgagccttcattcttttctggcctacacaccagagcctatttttatttcatcgatgatgctgaagagagtgtttctaattcagttaagtttggaaacatcgctgagaaaaaataaatgttgagctgtccagaactgtgaacgaatagttcaggtgcctggatagcatttcaaagaagctgtttgactagggaaccttctggaaagatgcacgtattcgatatctaacctggttaatggttacatggttttatacatatgtaaaaattcatcaggctgagcatttaagatctgtgcacttcactatgtctaatctatgactatgtaaagccaccccaaagcttagtggtctaaaacaacaataatttattttgctcaaaaatctgcaatctgggcagggcttggcaggacaactcacctgtgctccatgctgtcagctggggcagctcaactggaactccactttcaagatagctcacacacattgttgttgctggctgtggttctccacgtgggcctctccacagggtggcttgggcttccttacagcatggtggctgtgtaccaagcatcccaagagagaggaaatgaaagctgtcagttacttaaggcctgagcctggaagcagatttttggggggatttcccccacccagcttaggtattccccaaagtttttttggcctctgttgctttggacagggttttggactataaatccggaattagtcctaacatgcctgatcacatgcactaagacaacaccctatgcaccctatgcaccctatggcagtaccatatctgccaagttcttcttttcttcctttctttttttttttttttttttgaggcagagtctcgctttgttgcccaggctggagtgcagtggcgcaatccgggctcactgcaacctctacttcccaggttcaaatgattctcctgtctcagcctcctgcataactgggattataggtgcacgtcaccatgcctggctaatttttatatttttagtagagatggggtttcaccacattggccaggctggtctcaaactcccgacctcaggtgatccgcctgcctcagctcccaaagtgctcagattacaggcgtaagccgccttgcttggtttttttgtttggttttttgtttttttgtgttttgtttttttttgccaatctcactctgtcactcaggctggagtgcagtggcaaaatggtggctcacttacagcctcaacctcccaggctcaagcaatcctcccacctcaggctcctgcgtagctaggactataggcgtgtgtgactgcgcccagctattttttaaaattttttttgtagcgatagagtctcagtatgttgcccaggctggtcttgaactcctggcctcaagtgatcctcctgctttggtctcccaaagtgctgggatcaggcatgagccactgtacccagcctacatctgccatattctattgcacaagtagtcacagagcccaaactcaaggaggagaggacatagaaccctccctcccgcttctcaatataaagtgtatcagagatttgggggggggggctattgtttttaaaactactatatatctcattttaaaagaaaatagaatatgtgacatcagccgggcatggtgctcacacctgtaatctcagcattttgggaggttgaggcaggcggatcccttgagaccaggagttagagaccagcccgggccacatctcgaaaacccatctctacaaaaaaaaacaaacaaaaaattagccgggcatggtggtgcctgcatatactcccagcttctcaggagctgaggtgggaggatcctttgagcccaagaggttaaggcagtgagccatgatggcaccactgcattccagcacctggacgacagagaaagagcctgcctcaaaacaaacaaacaaaaaagaatatgtgacttcatttgttgcttcatgtcccagcccactttgactttcttccacatctcttttctcccagtcatcaatgggttgctatcccactaaattcatgtgggtgtgtatagaaaaagaccatttacatttgagttttaagttgttattaatttatcaaagttccaaattttaaaatctagacttttacaagccttaaaatttagtttattttattattatttatgtatttatttatttgagataggagttgcactctgctgcccagaccagagtgcagtggtacaatcacagctcactgcagcctccaccacccaggcttaggtgatcctcccccctcagcctcacaggtaggtgggactacaggcttgcaccaccatgtccggcgaatttttgtactttttgtagagacagggttttttagagacagagccatgttgcccaggctggtctggaatgcctggggtcaagcaatccactcgcctcgaactcccaaagtgttggggttatagacatgagccaccaggcctggccaaattcaatttattaactttgttatttttacataaaattagagcagtcatttttcaggatggctttctttttgtttttggagacagggccttgctctgtcacccaggctggagtgcattggcacagtcatagttcactgcagcctcgaactcttgggatcaagcagtaacatttacaaatcaagtaaattaaatacttaaatattctgaatatctagttgtcttaaataatgcaactctgctatccaagtcaaattgcaattcattttaccttaaaatcacaaattttatacaattttatgctggaaccataaggataatgtatcaaagtctttttttttttttttttgagatggagtctcactctgttgcccaggctggagtgcagtggcacactctcggctcactgcaagctccacctcccgtgttcacaccattctcctgcctcagcctcccgagtagctgggactacaggcgcccgccaccacgcccggctaattttttatattttcagtagagacggggtttcatcctgttagccaggacggtcttgatctcctgacctcgtgatccacccgcctcggcctcccaaagtgctgggattacaggcgtgagccacctcgcccagccctcaaagtgtttaatacacccaaattgtcgtaaacactggaaattaaatcacagacatagcttgttcctgaacttaacaccaaaatatcactacagtatatttgattcatttcatcttctccatattcaattctcaaccttcccaaggttaaaaggacaccctctgaagaatgtgttttgccatctcaagggagttgaggttacttgatgtaaggaaaaatttaaggctttggaataagcaaaagagattaccggctattttttcaatggaatgcttcgtgggggtagaggggtagattgtctgagcctacagggatataagtctttgtctttgactaggctattttacgactctggaagtgtagataactaatagcaatgtgaatacttcttgcctctagacaagcaaataacttctatctagggagcggagaatccccacccccaccccaaaagccagttttgcatccatatgcaaatttatttcaatattcttgatgtataaatatgtcttctttgaattca

SEQ ID NO: 7130 - DNA, 2179 bp, artificial
  synthetic oligonucleotide
aaggcctaagaaggaagtcaagcccaaaatgaaaacattttcaacaaatttaagtagtcatggaccatatgaaggtaacttacaggggataaaagaggtcccatcatcatggaagccaatacaacaagcaactgtcacacattaaaaaaaaaaaaaaaaaaaagccacctctgtttttaaaagaaactagatgcaaagagattagcagagactctcctgaaagcctgatcccaggacctcacacagatcagtgattaacctctggcccagaagccaagggaacggtggggagaagaaacaggcctggtggggtgtgttctcagcaggatacagaggcctcctacctgtgtccatggagctgggggttggggttggcagggagaagatgggtctctgcccaatctgagggaatgctatttgcaaagtgtgaaacaccaaatacatttccgtttggctatttctgtcactgtcaggaaacccccagtgcccagcctcatggcagcatcccactcacacaaccaggaagatgttcaggctgactcagacctgggtctctgaccaataaaccagggtcaaggacagggtgagggccacggctggggatgtgggtggcaatggcaggtcctgctgaaccagcggaggggcagctggcactctgtgtgtactcctgggactttcagctcaaatatattttaaatacagtgacttcatagatggtgatgaagagtccagggtcttaaaaggcaacacccccaattattcatgcaggcctcaacattttcagaagctttggttcacaggaacattataggactgatcaaaattgggagctttacatctacatttgccagaaaggtctgctggattcaattccagagaacccagtggtcagtgtgcttacagtcaccctctgtctttcctcctggaatttcccgtatacactgagaaccaccaccgcacagatagggaagcttggtctcagcagagccaggctgagaacaagacacatcactgacctggttccatcctgggcactacagttgacatcagcgccatattcaaggaggtgtcgcacaatgttgagccagcccctagcacaagcttcatgcagggcgcagtaacctgcgttgtcccgatgatttacatcacaaatcttgttctctaagcagtacaggaccacttcctgtggggaggggagggaagaatgccatcagatcactgcacaatgaccttgtaaggtggacctctctgtagctttcaaagacatacaccctcaggcctgagaacctgagaacctctcgggcgggctgtggatgtcttggtgagggggaaacacatgtgcgaagcgcctgatgacagggacagcatcatttaggggtctgctgcccagctgcctggccctgggcgagttatgctcctaattctccaaagcttcctttcctacctctggaggagagtaacagcgcctaccagaggctgctaagaaactgtaattagagacccacacaagcccttagctcagtgcctggcacagtgagtacagagggatttggttgctaatgtttcaaacaacgcatgaataagtacaaggacatcctcctcactcaatcgattcatccaataggtagtagtggatgacgacacaagtttagataaaagcaaggccaatcaaggcataatgaacaattaaatgagctggagaacgtttctcaacttcacagagaggaggatgcccaggagtttaggctggtcctcacgccccttggaaagacccggagttggagcctgggcggcagtgcctctgttggtatcatactcatcaacaaatgacatcaacgcttccaataaccctaccttctttttgcttcactctccgccccacttggggctgaatcaatatattttcatatttacttaagttaatgacaggaatctaatacaccacataccacaacctacgcatttcaagaactaagtaagacaatccttcccttccccctttgcagaatgtgttccgcatcaacagtttgcatgagaatcactgttattaatctcacttctttggcgtgttaaaacattaaaatgaaccgctcccagtaagcagagcagtaatttagtccatgttttattaccttgattaagaaagttttcaaacacatggaacagtatctgccaccag

SEQ ID NO: 7131 - DNA, 31321 bp, artificial
  synthetic oligonucleotide
gaacacccagggccaagtggagagacctggcttgtgagaagcaggcgtgcacactgcatactgcatggtctccagctcttagcaccaaggaagtggaacacataggagagcttgggtcaccctggacagactctgagtagtcattcgctcttcagccaagggttatgatgagagcacctgagcttggcccggacacgggggagaaggcctgattggcagaaggggggcgtcgagggaccaagatcataagccatcactccaaccttggcatccctgagtagggacacacccaccctctgtgaaaagatgtgagggcagaccacaggtcccaagccttggcccctttccttccccacccccaaccctggccccctcttgcactagggccactttccactgcccccacccttgaggcgccgatcagttaaaagtctgcacattacacttgtcaagtggcactgacaatttggaaagcatggccaccaaactaactctgctcacgcctccctgctgtccacacaggcattgagggtggcccatctcggggtcttttcttgggatctctctcactaggttccccttgcccccaccggcagctatccagcagttaacagccagaagaactggagaggttcgcaagggcttccagctcaggtggccaggcaggcattcccagccagtgtgctggggtcctctggcagaggactcttcaggggaggggtctcgctactgcatggctggttctctgtggagaacatggtcaccacagcctcccggctcccaccctcactcaccgcgtgtctctgggcaggtggctgaacctctccaaccttggtcccctctgtaaatatttggcactgtgttttccaaaggattaagctgcactatggacttgagttttgcctggcaatagctggcgctggccacgtttaaccccgctaaatagtacccgactccaataaacacactgtgtaataagccccagaatcacaacacagtttctttggggcactaccacctcatcctgcgggggaggctgaggcagcaacagagaggggatcagagcagggagggaacttcagcagaactgtgtagattttacagaagcccaaagctcaccacccgccagcccttcctggggttgctccaaacagagactgcgtcacagcagcagcgctgtgctccgggtgtcaaggaagggaggggtgaagaagttcctattttaggatgtgaggggtgggggtggggtgtgtgggagtgggagatgagaagaaaaagctcttccggatgtgcagtgtgggatgggtcctccgggtctgctggagagtaagataccccaaggctgccccccaggtccctgggaggcaaaaccgcaggcttccaggggtgtggtcgagggaggtggctggcccggtcccacccctcccgaccccctcccccgagagagttgggggtgagggaagtgatccagccggcccaggtgctgcctcttggcacactccaagccacagccttagccgtagccagcacgggcgtccccgcccacacctccaagttttgcattagtaagggggagggggaaggggaaactcgccggcccagaccattccagcacccagaaccttcccggcctcctcccggggcgtcggggtctgagcggagagccacctgggctgggagtgaacttggccccggcgaagaagaaagggggaggggcgccccctccccgggctgaggcgcttcagcccggagcgcgatcggtcggcaacaaagggattttctctcccaccacacacacccgtgctgctcggggctcgcccgctcctcctccccgctcctcggcggaggtcccagcgcgcggggccgcaccacggcacacactcacgccctcgcggcgcgcccccgccaggccttccaggaactccagcagcctccccggaggcggcccgaccttcccagttcccgaccctaggtaacccctcggaccctgcggcctggcacgctctccatggtgccccttcccgaggccccgccgcaccttctctccccatcaacgaatctgacgaaaagaaactttgggtgggcgcagggagaatccgagacctcccgggaaacgccgccgagcccacccggggaatgggcacggcagacccctcctcgccatcgttctgggttcccttccgatcatactagagcgctgctcctctggacgcttccccttacaaagatgtgagccaagcgtcgcctactgtaacgtgggaggggtgcgaatctcgggcgttggggtccggggtggaatctgcaggggttgaccctgagggtcgctgccgaacctggattgtccgctacactcccctcctccaggcagagcccatggcccggggtcaggtgcccccaacctctctctcacaggccaacgggggacacttgcccgtctccccggataatctgtccaggccaccccaccggctttttgttcttttcactttccttcatggttttgccacacggggagtcaggaaaccacgtgtgtattcaagagagggcaaatttagaaacaggtgtcccttcacaggaggccacccggcaacagaaacccaagtcaaaagccaggaatccctccttactatcttccctccacgcaaaaagaaaccacttgccccctttgatctagtccctgcagaactgggtccccacttgggaatctacacaacctgggggcaaatccagaataaatgttccacaccatgcctccaaaggctgtgtcaatgcacttttgtttccaccagggctttgtaggagtaaaacacaaacgccgtcgccgccacccccccccaccaccaccaccaccgaagggaacaagctataccgtaaggctaataacaacagctatcattagtatacacaggaagcacaaaggaacttttaatgcataaaagatgtgtaaaatgcaggggtcctgcaatctgcaagcgagtctctcactgattgtgcagagcctgggagtcccagaaaggctgggatgagggtcagagaaggagaggggcacccaccttctttacaaggaacaataggaatcccatgtctgctactcagtcatggaactcagagcacccaaaacaaagccatggaacaactatggtatagatgggggcccacgaatttttgtagctgttcagggcttaattactcctccttgatccatgggactagacacgacaccgccaaggttaaaatgccccgaacagcgctgagcagatgtgagcgagctggcagacgcgcaaatgaggcctgcctcggagcacgataacaagtgactaatacattgcatatcgttgaaagaaaattatttttctctaatttgcatttgcttgggggaaaaaaagccaacgcgagtccctcctcacatgcacaagtctaatcctggaaatacagcccggctgctttaagagagctggaaggagggaaagactgccagtgttttggcgttgcaggcttgtttatctttccgcctttcctccaaggcgaaactcgttttgcaagcaacattcctacagaaaatggcacacgtcataaaaagagaccaatttatagaactggcaccgaagttcatgtctcactccagaagcatctcccagctccccatcggaaacccaactagatgtagaagtccatgttaaaacttagagagtagacttagggaggggaggtgctgagggtgggggggacaggagagaatgaagtagatttgcagatatcctgtaggctgtacacccagagaccaaagtcagccctaaatgatcttccaaaacccaaggaggaccaggcaggtgccagggcttggaaggcttcaaccttgggactcatgggggagaggagtgaatttttacacccagcttgccccaggacggtccagaggcaggtccacattcttggccatcctaagtccacctgcttgggccagccatgaacctccaggactggcctagtgggtaactgccaccaccaactgctctccctcccaccctggcgcctctctgcagggcctggcggggtaccaggaactcaaagaaagcctgttgctgtgggcatctagttgatgaagtcagagtaggtggtgctgtgggcaggcttcaggacggcacctttgcgtgctgcagttgaaggcaaatgtgctcttgaaaacgggaaggcttggaagaaaaggttaagggatgtgggtaatcaaaagccaatctgtcctcccttccccccaaaatacaccccccttagggtactgaacctgcacacttgcatttccaagctggaaacagtgtcgagtgcacagaacacagcacccgcctgtctctaacttgtctgaataacagggccatttcagaggggaacaacggccttcagagcctctgcaatttccagaaagctttcagttaataacacattctttccaacaagcttacttagggctgaaagttattttcacaaatcttaaaaactcagccataaacagctgaggacccagttcaacggatcctggccaaaccccaccaacacggtgacactcacggccccgtgggccttctcccgccacctctgcctcaccacaagttccctaaaccacaacatacaaaccatcctgcaccccaccccaatcctgggaagtcataaagatgtgtgttggggatggagggcgggtgtgccgtggagctttctctcatctggggatgcgctggccagaaactggccgccacctctgcagctcgtccatgggcctgcatagtgcgcgctttgtgtaagtgctgaggaggcgcagcgctgctcgcgcgccaacagctgtcacattatttgcactcgctgtaaacagccttcacattccccccttaccacatagttaaagccagactaacaatccacagttagagatcaaaccaacaacagcagcattgtgtctgcctttgctgccttcacaccaagcccagcagctggcaggtttctccggaacaagggaccccttctccccctacccctccgggatccagccaaggctagccaaggaagcatgcgtttgtcagcgctgtttgttaaagcaaaagagcaccgccatttcgcagagatttccgtgtggctcatcagccctctccgagagtttactccttctggaagctcgaggaagcatcacgagaataaaggttgtggagactcgcagggttggtttccatgctcagcaaagtggggtctggccgggctggggccggggccgggacagggaggtctgcccctctccatgccatgtcacagaggccagacaggtctgtgctttctgcagccctcagcggaatgcctcctgtctttcggaaattgcccaactcactaaatacttactggccgccccactgatcaaaatgtctcctttatgatttttggttaagttgaacatttccataatcgtcattattagtgcaaattacacgcctaatcggtccttaaatagattttaattaaataagcatacaaggctcattttatgacttaagaaaggcattacttttcgttataaactttccaccaggatatagaataacgatagcagacaaatacttattctttgaaaatcaccaataaccgatgggcagagtatcatgaaacataccctgttttaccctctggaatcaaagctgagaccagacatatcacagctgtacaactttcctcctgggatgggagagaggatttcttcctccaaagcactatgtctgtcttccttgtggccagtagaaataaacccccggtgctgctttccctacccatctgatgagatttctctagttgatgtcctctagcaaccactcctcccccacctccatccattttccaccctttcgcctgcttagagtcctggtgcaaagcaggcacgctgtgcttgttaaatgctgtgtaaaatgctgttaataaaataataaatacaaaggatggaggctgctgcttccatgggtgttttgactggaaatgccttggcacttgtcatgtgtttatgggagggcagacaacgctaggatttacatagtttggacatttctgtacttcatttattctttcctaaatgacgtaggcctcgagctatttcaagtttgcatttgtacagaactgttaaatgcctaggagtttctccaattaaaccaagtttaaaatcagacccaaagctggaacatacactcagacttgcccaactccaccttcagcctcggtggctggacaaaacaaacagatcctcgaaaacaatcagtcctcgagctccccaccttcaccccccactccaggagggcccctagggcaaaggttaaggcgtctctagattccaagccccagcccaggctacacactgaggcaatcactgcagtaaggcgcatcttgtccatacactacctttaaaatcgtgcgctaaaatcggggggaaactgctggcctggtaaaacccactgttcacaaaacaatgtcagcaaaggctgtaaggcattctttagagagggaccagggattcgtgcctactgaagctctttcagcacaaaggcttttaggggaagaagggaaaaagagggaggaggagggggagaggaggagagaaagggagggagggctcctgtttcagagcaggcatcccctgagagtcaagaaccaagtgtagcttcaatcaaacactgacttcccctctgggagtcgagtaggaaacctgatcacagtagcttactaccagcctggatccatacaggtctggttttcttctcatgctagtaatttttttaaatacatattgatataaaagaagcaatccctggcagactttattgaaaaccacattgagccctcataacatccggacttaatccctatcaaacaaaccacagcacctctggcctctgcaccaggccaccccctctcacctcttccaaccaggtcttgcccctctaggcaccgtggttcccccctgaaataatgccaggaagccttgccgaagggtacctagatgacggttctgaaatgagttcctaaccatataatgatcccacttgggggtggaggggagaagcaagtcttttcatatggaatcctttaaaaggcagaatgcaaactacggtaacaaagggaaaggggaacccaggaaggtggacctagaataccctcgtaggggagatttaatctgcatccttgggtcccaggacacaggcctagcaagtctcagggggtctcaggggcagcagggaatggaggagcaacctataggaacatgacaagtcattcaaagcaattattcatccttggggcctactatgtgccaagcattctatttagatcctaaaggtggataattattcccagtcttacaaatgaaaaaacttactggggctcaaaggccataaataacttgcccccaaggtcacacagctagtaaaaaatgggccacggtcaaactcagtcctggagttgcggagaggagccaattattggtctaattgtgccatttgaaatcctgattttcacatactgtctcctctgaaaagcttccttaggccttatgtacccaagaacgaggcaaagagtgtttaacacctatgttacttggtctacagtgagccgtgaacccagtttctcctgtatctaagtcatctcctggtccactcaaagtctttcaccatttccccctacatcctacaaatctccctacactgttataccctggtgtaaggccaatgctctcaacaagcctcccctttcccttcctccagtaccccagaatagtcaggggtaaggtgggtcgactcctttcaggtctctgggaaaagtgctgactactggtactaggagctaggcttgccaccccagtttcgccacataaagcaataaatcaaattatctagatagagcaaaagccctttggagggagctcctccatctacctttcctaggatttaaaggaaaaaccccagggaacaaagtagtgtgggagagggaattaagatggaagacgccagcaagatgttctattgggccacccagagtcccccacaaaagcgcaagccgggggataggctatcttgtcctttccccaacgtttctttacagaagcggccggcagcaaacctcagggcccaacatcccctccccaccctatccccaatttccgggtctgccccaggctttcagatgttccgggaactacctacacccgcagagcctgccaaagccacctccggctcggctcgatgggtacaggcaggggtaccggacactcgggcttcccggccctggactggttactcctccagacgctgaagctccggatgtgcgaaatggctccgcagtgcgaccgagtgtgcaggggcctcggcggcgggagggacggaggggagacggcggcgccggggcgctcaccccgctagccagccgagcacgcccccgcaggccggccacccctggctgcaggccagccctctgcaagtggcgttctttctcttttttaaactttccggccttggcgaacgggcagggtttccagtcctccccggcccccacccagttcggggaggggcggggcggggcggggctggccctcctaacccctccggggaggcgattccccccaagtcccgggcaccgctagacggcggccagggcagacgccttgctccaccccaccccacccccgcctactgtggccacctggagagggcggcttcccgaagcgatcgccgtccagccaagcctgggaccgcagcgtccggggaggaactccctacagcgccaacggtcctggcctgcccgcggtgcgctctctccgaaaagtctaatgctccgggaagggggaggggagagagagcaaggcgggaagggggggacgggctgcttttatttattttttaactcttcaaatgcaagaggtttttggtgtccctagcacgactgcgagcgtctggccaggcagaacaatagaaatggaggggggacgccggaaatggtgctggaagacccctataaccctataaacctctcctctccctctaagttcctattagcattgaaagatcctagtgacttcaatgcaaaattgtctttttataacttttttccttaaacacattccccctccccacatgaaatcacaagggcaaagatcgcttcccaagttgtgaccttccgaagctccagggcttctcacctgctctgcccctggcaccctgacctgagtcaatcccatcccccaacagttcccctggtttgcacctagacaataaatttagtttaatttagcttccggtctttaattttagcaggtctcctttttgcatgcaaatcaatatggcaattaccatctaaaagctcgcccagccccgggtcaatgtaaattgatcattgtccgccttccacaaaataacatcgggagtctgtggtgcataatgagattatactggaaactgtcttttagatcacaaattattttttatgctgtcaggatcttctccgagtggacttccccgcttctctaatcatggagagccgagcccgtgggtgccggctgtgggagacacagctctaaaacaatgacggagtgaggacccccgtttctgagaccctcgattgtaaacacatggaggtgagcttgcgccccaaaagggagccttctacagaaatatcgcagaaaggcatcgttaatgaactccacccaacaaaaagtaagatatcccttcctgatgaacacgttgagggcaaccagagaaagccgtcgggcagggctggagaccagtggacgcccccggccaagtgcgcgcgacgaacgcggctcggctaccaccagggcggctggggggagaccatttactcccgccccggcggcttctcctggctctaccacctaggcctcagcagcgcgtccggttttgcaaacagacggaatcccgtcggccataaacactggcaaagaagccggggcgggtcagggccggcccaggcctccccacccagctttgggcgaggcccccaccgggcccgatccagaagatgggctggggcaccgaggcaataaggaggctcctcttgacccgcagcactgctttctcccacccatcggcggcccccggggcacgagtgtgacctcggggcctaacaaagggccttgtgagctcctttcggcctcgggccggagggagaagggtggggcggggcggccgagatggacccaggaagttccccgccccgccgcgcctctccgggtccgccgggcccggtgtcctcgaggaaaccaccggggtggcattgccagggctgcccgcagctccggggaacgtcctgcgggctccaagcctcccgcccagcgcgaccggaccctgccccactccgcccggcgcgggccccacccaagtgcggtcttcccaataaaagctggaattcccggctgggcttagacaaagagggaccgcagcaaatcgacgccgcgggcaagccataccctagccggagtttacgtgcgcgtctggggtcaccgaggcgcctgctaatccacccaacacaggctgtccccgccacggtctcctccagaggaaaaaaaaaaaagaaaagaaagaaagcatacctcccttttattcctcccagaggccgcacttcttcctgttctccttcccagcccactgaggccctgctccaccttagcaaattggaccccagcagtgcaacagccattcctactgaccacaaagtggaaagctacccctcttgtggctacacgatccagccactcaaggtcaggaactcaaaatctcttcagaaaggctcctacctgctcgtcaccaacccgctgcccactccacctcacccctagaagggaaagaaactataaccagagataatcctagttcactgcacaccatccatcctttaggctgctagcgtggccctcagtttccttcaagccaaagacacattatttccctgtgaataagtgtgtgaatgtggttgtgtggcccactcttctgtacccaagtcggtctcactcactcggcaggaaagtcttcgtcaggcattgaggagtgtttgtcattcagcctgtgtatctaagcatggatgtatgcatatgaatgctttttgtgtttccaagtgaccctcttcacacctttaaatgggctattgtctctggaacgcacttacagaaattctgccccagtttccagctcaacaaagtctgggatttttctctcagaatatcgctatacatctctgtatttgcatacccatgtttacattccccttggccagttctttatctcttatgtatctcttgttccatttgggcaacggagcccaagtgtcttgatttgtctcagcacatgtcattcaagcgcacatcttaatctgagcattcgtactacttccattctttttgctttgcctataatgtggctctttcccaggccagaccaatatgggtttgcagtttaaatgtaaacagaggatcccttaagatcacaaactcttaaagaaaggaagaggagggaggaggagactggaatgttagtaatgagttatttatgtatagggtaacccatccgcccatttcaagctgaagaaagaactagataaatgtctgcagaggtgtattaaaattttagaccaatttaatattagccatatatatacacacacaaacgatggatctcacaacacatcagtgtccagctcctctttggaggctgtctccttgcacatatctaactcctcacaagttcctggttaaaagtatgtctatttatatagagacaactcaaagaccgctttgctctcttcagtgcatacctgtacatgctggcggggcatttcaggctcaggtccttggtctgcagcagtcatagtcagaggccccacccgactacagctatgtgcagaccttcccgtccttgaacacccgcatgaattctctttgggaacattgagtctacgtctgtcttccaaactcagtttttaaagtgagggtgttcattgtgtgtgttcacagctccccgactgagaaatacctggtcaaactagatcatctagcagctgcgtttggtttgtggaagaatcgagcccgatgcaccaagatgtgaccgtgcacacataagagaaaggaaaaccctaggcccagactcacagctcctccccactgcgagctactctgcctccaggaatttccactaggctctttgcccccctttccctattacactaccccaccacggcctttaaagggttaagagaaacccccacggccttccctccacccagctcgctgggcccggaggctagctcgctcactcgcagctcacagagtctgctgccatctccgcgcctcccccccctccagtccttcagccgggagggagcctgcatgcctgtctagaccgatctatcaccggcacaccaacaacacccgcgagagcgcggagaccctgcccaggtcccccggcccgcacggttcacggcggacagaacccggggagcgtgacggtgcctgcggggtgggggtagggggcccacaggcactggccgctccgagcgcaccacgggtcctctccagctccggccccccgcgctcccaccagcccggctgccggggcacagtcacagctccgcgcgctgggcagtcctatttttatcttgtctaatcctaaactgggcggggagcacaggcgtcgtgcttagagaacaagagataggcgcgggaggcggggaggagcagccaggcagcgacgcgagcgggagcgagttaaagacacagtggaggcgaccgcgggcaggaagaaagagcgggctgcgcgggcctcgaggcgccgcacgcaacgcgccgccccgcgaagttacactcgcttccccgccgtccctcgctaccggcccctccccacttcccagcggcgctccccgcagcctggacagcgaggccccggcctgtgtgggaggcggaggccaggacggccctgcaaagggctggagagaatcgctaatgagctgtgcagcccattgatccggagaacacttcctaattaactctcagtcacctactggtgacagcgcctcaaaggacagcgctggggccagccgagccccagccgcgacttgccggccgggcgcctgctgcccaaaacccgcgcgctcccctaaacaccccaaggcaattggtgtgcgtggcggtgtatacccgcacactgaaggccagcctcggattaaacctggatggcatattaatcatcgccttccccccccactccgctctacgcgctgaaaccctgcccaaaataaacacgaaaaccaacactgcaaaacccacaccagataacaggtcgagagaggagtgggcagggtcaaggaacgagcgtattccctaagtgtccacgtacaggaatctttgaggctgacaattaaaatgccttccacgcaagcaattctgttggcaaaaccgaacccaacacttcgtaaggattgatttcggcccgcggtgtccgtttccagtgccacaggaagtgtcagatggccagaaatacccaagtctgtctgcactcaccacccaccaccttctggggtgggccatttcctcctagtctttactcccaggccattttaaggatctttctccaaaagactacccctagaaccaaataccacactacccctcctctagcgtcttctcaaaacgaaaaaagggggggaaaacacagctaaaaccccgagctgtctagtctagacgcagcgaggctgtgcgaatacctatttgaagcgcgttggtttctttttaaggtttgtttctaaatacacataaccctcctccttccttcttcgctcttccattccccccacccccaccctccagacgccggcggcgcgcgccctggcgcgcgggcactcacagcctctagctggagatcgcggactttctggaaaagattcattaacagcaaattacgcctcgcccggccacggcctacacgctgccagactcgtccgtctccgggaccccgggaagggcccactcgagcgtgcgagcggcgggaagcccgccgggaccacgcgtgacttcggccgccctactccacacacggtgccccaaggctctctccgtaaacagcaggcgctcgtcaccgccgccgcgagcccccgagttggcggaggctctgcggcgcagccgcccgccggctccgagcgcgggccccgcggcgcctcgccctccccgccttggccgaggatcttgccccggtgcgcaagttcctcttcgcctacagcctccttgccacacgccctccgagtgggaccaacttcctccggccgcagactttcacacgcccatcagggctacccaccagactccccattgcccagcggagggcccaggtctcgcccgcccccgccctccctccacgacgctgcccccgcacaagcacattctacacccacccctgggggctcataacttaaaacctacgctgaacatcggggagggagaggagggggaaagcgggagggggatcgcagattataatcttaaaagaacatttacaaaacaaagcgtctgacctggctggcgggcgggccaagtcggaaccccttgctctgctcgatttcttagtagtttttttttttaatccacgtgattcgtgctttggggcaagccaagaaaaaacgggactcccctcccgagttgcgcggcagcggcggcaggtcgagctcggctcggcccgaggcactcgccacacaccctcgcgcacgcacacgccgacgttccacttggaggaacgaccggcccccggagaggcgagacgaggcggcggtggcggcggctgggggtttttacagttctttcccgagtcgaaaaagaaagcagacggcaacccgctgccctccccttcctgctcgcgagctaacgccgaacccagcttcccagcttccagcccacctcccccccctccgcccgactcgcggcgctcagcggcgaccgcgctcccgcgcacagacacacacaggctgcaaacttccactctgcgaactccctgctctcctcctggcccaccgggaggcgccaggcccccagccgcgccccctccctccctggtgcccacgcggggccgcttaggttggctgcattttaaataacatagctatgaaataaaaacgaaagcgagccaagcagccaaagggaagcgcgaggcaaaagcttcgcggggtacgctgcgggagggggccccgggagagggggccgactgcagccctcagcgcgcccgcccgcccacccgtccgcggtctcccgggggaaaggtgttccgggcactgacctgaaatccccggtgggggagtaggcagggagcctgcgatccggctctttgaagttttcccccaagcggactcgaggcggcgagaaggagcggggggcggttgggtgggtggagagagatatgaggggtggggggggttggcgacgttaacgagcggagaaggagccgggccggagaagcgcggcgagcagcaaagtttgcggtccccggctgcccgcagcccgctcgcggcgccgcgctcactcgactccctcgccgtctgctggcagccggctgccctcggggtcggccccgccgaggggtgggctctgggccgggtgggggcggggcggggcgggctcggggcctccgggcaggtggcgacagccccgtgcgatcctccgggctcccgcagctggactgggcttggccgagctcagcagctcccgcgctgccgccgccgcccgcgctcgggcaggagccccagcgccatgttgacggttcgccgcgagcgcccgctcgggctgggtgtgtgtgagtgtgtgtgagtgttggccaagtcgtccctgcgcggcgacagcgcggcttgggctctccgcccggcggctcgcgggctccccctccgccgccgccgcccgcctagctcccgctctcggtcgcggtctgggctcctgcgcgtctcccccgcagccgccgagctcggcccgcgttcagcgaggagcgcagctctgcctcaccttgccgctgggagcccaggctccgtctgccgccgcacgccgcgatcccaacgcgtcccccctccctggttccctcctcttcctcctccccctccctccgcccgtcctccctcccgcccgccctacctccctccctcccaacagccgcctcccctccccccgcaggcgcagcgctcgggcgacagccgcccgcccgccgccgcctccagctctcgcaagtttgagctccgccagtctccgctcaccctccgctgcggcgcctccgcggcggggtttcgggaggggtgattccccaggaaaggtttgcccgagtttccccggccgtcatcgatgcacggcccggcacgttttggcctctctggatccgaaccccggaccacttgggtggcgccccccctcctcgtcccccggcctcccctccccagctcgggccgagttggctgcgcacgcccgacccgggcgcacgtcctgggcgagccggagaccgacttgggcggcggcggcggcgagggctgccggcagagccagagccgaagggatgggggcggcgggggcggctctcccagccgcgcgccgagactcccctcgctacccagaaggccagtggaggaccgcaattaccataaagcgcctcgcactccgctcagccaaagctgtcaaaccccagcggcagcagccgctgccgccgcctcttgccaccagcgctgcgctctcccggcctcgtcccctccgagacccagcggagcgtggcctgtgtgctcccgtgctcacccccaccccagtttgccccttcctcccagaggagccctttcccatttcggtgttaaaagctacctgaaaacaccaccccaggcaacggtggccgttccgcctgaactccgcgcccgagttccccggacgtttcaattgtgtgggaattgtttggaggtgggggaaggggggagcagcccgtggaggcaccgggaggcgtgtggggggcggtcggcgagcggagatccgcctgtatttctcccggttctcgagcattttcacggtctgtacctctgatggttggaggggctgcccaggcccctcgccccggcgttgggagattatctcccgcgttttattttccttgacagggagcaacttttggcttacaccgttcgccccataaatttccactcggtaacgtcgtgctgatcggtgcttggcggcggcgtacagcctgcgcccgcagcagttcaattcaattgacacgtattgagcttctccagcgcacccggcgcggctctgggcgcggggggagggcgggggcaggcgggagggagggggaagcggagaagcgaggttccggcctccccggagcgcaaagcctcaagggcgagccgagaagccctagttggtgaagctggcgggaaggggtaggagtgggggagggggtattccggactaaccgcgcccagactgcgggcccggacttcgcggccaatggtgaccccattcggctgcccactagggtctttttatactgggaagggggtggggtgtctctttctgcctaaggacaagatggtgcaggctccatgaaacataaatctgaaatggaggtggcttgtaaatccacacggaaagtttttaaaatatcctggagtgtccccatgccaaaaataatcaaaagcatctcaagttgattactaagtcaaggtcaaggccaaaatcagctctagctagcagatattttcccttttaaaaattagactcactactgactgtgggactggtattaggtgcgattttattcattctgttttagttctcagcacatagttataaaaacagcccttctcaaagcagaagtgaaacatctctaccgtttgaaacccgaaacttcggcagaattaaatcttcatgctccagagctgcttataacaactgatgcaaaagacaggcgagcaagtgcccccgcgagcagtgcccagccaggctgggccgcgaacgcttccaggaccagcgcctgcagaatggaatgcacgcttttttcttcctggtctttctgggggtggatatctctgcaagccaacccacacatttttttaatctccggtaacaagcagaaagacacctggactattatgctgtaaaactattttttataaagacattttaggaccagacattaaaagttattagattgaacgcatgcgagttacagacacagctggagaaaaggcctctggttgtgtgttgtggcaacatttctttttgaagcgactccttttattcaaaacaagtcaaaaataaccgggaaggctgaagctgggtatttgtggggaaactctgaacgtggttccaggcgaggaggccgctctgctgctgcaggctggacgggagaactggcctgggccagtgtggagccgtgccaggctcttccggctcggttaggccgaaccgcagaggccctggcccggcgcccagccaccttctatcccctcccctcgtctccccaactctgcccccaggcacaggcttttctcggagttcgaagtcgcatgtaaacgtccagaacttttagaaaatccaggaaccgagctcggggcctgcagcctctcagagtcttacggcctcccggggctgctgacaaagaggcctgtttgtctaactttaaaagtcctagaattcgggaggctgagccaggagaatcgcttgaacccgggaggcggaggttgcggtgagccgagatcgcgccgttgcactccagcctgggcaacaagagcgaaactccgtctcaaaaaaaaaaaaagaaaagaaaaagaaaaaaaaaagtcctagagttaaaatgaacaggggtggtgggggtgctgtaaatgcgaaggggccgaggggagggctgactgggggagaaatttgatgctggagacaaacaggccagtaaattcgcctttgacgtaatttgcaacatcctcccccaccttttctagggatcttgcctccacggtaggctggtaggattaaagggtttctcctccatctcctagggatacatttttcaactccgtgggatttcaaaaatatcttattaagggagtcctaagaggcatgagtggtgggggggattcgtgactcactgggaattaaaatgtgggattttcccgaggcgctataaggcagagggggggaggggagattacacctattggcccggttagttccaattgttctggggaaaacaagcagaaagctgtcgaagggcaatcccatcttgtgtcctcacttaagaaggggctcagggagctggggatgccgcggggcctgcaatgggtgccggcggtttggcccttctcctgccccctcctctcctgccctcccacaagcccttcgggagctgacccgggggtcaggctgctatacccagcactcagcaaggggaggatttcaatgaaaacagaggaggaggagagagtgagcaaaggagtgcatgggaggggaggccgtgcagcccacggagaaataaagaaataggtgccgaaatgagaggtgctgcggatggagcagcgggggctgcccctccgccaccaatctcccttcccatggaagtgtctcctgattataacaaaccactcgacctcaggctaaccaggccctgcaactgggcaatcgagctggcccttctaggagcaggccttgagcctggctgcccttctcaaggcaggttgactctgcaagacccgctagggcctctcccacacacctccagctccaccctggcctaggggaaaggccaggcatcctgtgtttggggggaccctggccttctaaccttgtgtgcaagatttatttataacgtatactaggatccacatcataaagcttataacgtatgtgtaggcttccgatggtcctcctcggaggctgttctcagggcgatgacacttggtactggaacaggtgggactcggatgagtacagataatgtatttttacataatgtgaggtagcctttctttaaaaacacacccacacttatagtcttctggtcactttgtacaagaactctgggcttatccaatggcactttaaaaaacatccgctgccccatcctccaagcacaaggcacagctggcttcccctctgaaactcaaacgaggtaacaaacaggaggcgcatcctcctcccaggatttcactcatctggaaacatctaaaggtagctgcctcccagggcagaagactgctggacttaagggtcgccaggctgaacatgactgttctttcttcttcctagcctttggagggttattgggtgtttggggaaggaaggccctaagggcagcctctccgtggttcctagcaaccatcttggaatttctggtctgggctcgatttgggtcaggccctgagctccccgaacacaggcacgtgtgggtgaactggcatctacactacgggggcccgcagggtggttgggtgtcgaccaaatgggcataatacaggaggcttctgggaggctggccgcctcttgcgctcggcaagggcttaagagccctcgacgccgccgcgctgggccgggtgctcctgcagataaacccggacgccacgtcccgcctcggctgcttatttagcaaggcgccttctgcgcatattttacccggctgggggcagtgagtgggaaccgccgggagagggggcggggaaccaccaactactcgccttcggacccagtgtgccggcctccggccccagccattttgtatccagcttccctcctccactcccaccgggtccctgcgaagacgcaccaccccgaaccccttcgcggtaccactcccgaactggaggggtagagaaggctctgccagcccctcgcctgcagcaggaaggtgggtacggaccagcagaagggaaagcggtgctgatctgtctctaaatacctctgccctcccgcccccaacaaagtcggtcacagaggtgagtggcgcgggatggttgcctcgagaaggtcgcagccaggagcaaagctttggggctcacaacggactgggcattccaaacggtgtaatcttcggcacatttcacccgctcccattccaccttccgaaccactctgctctcggtgctcatcctcctctccatacctgcgttcccagcgcgttagcagccgcgcagcccccggccctgagtgcggggggtggggtgggggggctcagggtggtttgtgtggtgcggcctgacagaaccttctgtgtgcggcggagggaggaggctaatgcataatgcacagcgcctggaagcccggccattagcggcctgtcggtgacacagacaaacgactgagagggaggagatccagctcgctctggagtttaaatagaccagcgtggaggggaaacgccatgatttaaaagtgtgtgtttgcagacactcgcatatattttaatgatttccagcaggctatgtgtcctagccttgcatccccccctccccaaaaggaggatgtgtctagaggagggaggatgaaggcagagtgagaggcctcaacccagacccaccagcagcttttgagagatgaaggaggggagaagttcagaaagcgaggcctggggaagccacacgacccaaggccaagcccagattttgttcttaaaataataatttaaaaaaagagccacccagccttccaccctggactacaccctgtgttgtaccagaaaggcctgggggaaagaataaattctgccacccttgcttcccccgggagcccacatttttgaatcttccttttccactgacactccagagacctccttcctcccggtttaacacactagtgttttttagcaattaaggcgagaagggggtggggataaagataagccaatttttttttccgccatgcaagtgtgagagataagataacgctaagctggggcaaagcggctgcttacaacctccccttagcgattttgatcggtcacttcttatctcgcaaaaatgctcttttcgaaaactggatcaaaaaagaaaaagagaaaaagaaaagaaagaaagattttcatttggaagtgacatttaaaacccacctcccctccactgacaacccaccccccattggcggggctccccaggaaaagtcgcacctcgactgcaggatttcaggctttctcgcggggggcaggattactagtgcaattaggctgaataaaaccagggatgcgtgatgaggatttatcctgtatccaacccaagctcgcggctgggttttccttctcttagttactggtcgatgtttgtgtttcgccatcgcactcagtgccttcaaactaaacaggtagttatacttgggagggtcatataactatgtcaacatgaagtggttgttaatgcgaaataagaagaaactcttctgatatttataggcccctataaagggagagaaaggaaatcacactccctagaacccgaaagctcccagccgaaccggaccctcggggagttttagaaatccttctttccgcacaggaatttcgcgaaggggtttccggaagactttgtcgaggaaggttttggtatcagactccacgacctcagagcgccctgcaaattccccccggcccagtggctagccccagaatgcaaacctcaaggcgggcgccccagaccaagctgacctagcctctgcccacccccagctcacaaccccgaggctcccaccccctgcccccgaccgggtcggcaccgtggcgtccggcacatgccaagtctaccgtctccaagccaggctgcaagatccaaaggttggggcctgccgcggacggattgtccctggggagctgaaaccgcccagcggggaaacccctcctctcgcccttccccgaaaagcttggccgcggtctaagctccgagcaagcgggtatccgctgacagccgggcctcacgtaaggcccacacgcgtcccattagtcagcccgagttcccctcgggcgagccgcctggcgcggccccaaggccgggctcaggcggggagagggtgcggggccgcagcgagctgcgggcggaggtgcgggctccgcggagcccggccaggctcggttccgcgttcctgggcccgcgggtaagctgagtcggcggggcaggccgctccctggctggcgccggggcgccaagctgcgcttcacgtgcccgccatatcagcagcagcggcggcggcggcgaggagggggtgctgggaggcgcgcggccgttcccgcggggtctccggaccccgcctccccgcccctccccgtgggggctgggccgagaccaccctgcggcccccatcccagcgcaagccgaaagcggcgctgccagacgcagagaggctcctggggcgccgttccgagagccgcgcggcggcagcagccaggggagggtgctcctcgcggccgccccgccgccgccgccgcagtcacggggaccggaagccctcgcgccgccccgagcggcctccgctggccccagggctgttccagacgagggctggccgcgcgtcacccctgatccctcctcgccccaggcgaccacccgggccctgcggtatcccggtgtaagccgagaggacccttcctgcggtccgatgagatgtccctgtccctctgctaccaccataagcacgcccccccgcaccgctcgcagctccgcagctgggaccggaggggcgcggagccgccactccggccgggcaggaacacctgctcccaggccctgcagctgggcgcgtgctgctgtgagaggctgcctactgttgtgtgcagagatcgcggaggagaaaatagggctccgaagctcagggccaggagcagccaagcctcggccacccccatctcccacccactgcaggcgacagagcgcgaagccagagggcctgctgggggcccgggtctcctttcgaaggtcgaagggccgccacccctgggatccggcttctggcctgaagaggtcgttcataaaacagatggggcaaaacctgttttgggagccttcccagtgtccgcccccgctctccaaaccagacacactcatctccccctcagccctactctagcctccggcgggggacgggagtaggtcatggcggcaccggtactccacccgcccccctccacgtagggacgtagggtcggctgcggggctcggactttgccactccacctagggaagggccaatggacgctccccgtctcctccgtgtccggaggagatccggcggcggagctgacctgcaaggcttgccctgcctcacccaccccccacctccgtcccaccctccccgactctcctggcccagggcccggcccgggaaggcgttgttttgccagcgggagccgagcgagtgcacagagaaaagcctccctactctaatgagagtgcacacagcgctgcagcgaggaggatgattacccggcgggcggggggcgcgggctcgggccgcgggcggcgtgtgcggcggccccgcgggcccggagtccccgcctgtctggctgctaatcgcacgctttctgctgttacggaggcaggcgggagccggcggccgagcccagcgccgacgactcggcgggtgacacggaaacatggcgcagcgcccctcccccgcccgcgctcccgcctcccgccctccccgcgctcccgcctcccgcctcgcacttcctcccgcccgcgcggcttttgcagttttaatgctctgctttcggcctggcaccattacgctagcagccgcttctccgcggccccgcgcgtctctttcccctttgttttcggggtctatagaaaacgtttgcttttgtcccgagctctcgttaaaccaaacttgtggtggcaacggaaggcggtgcaggcggggaggggtccggggattttggcagtagccggccagagcgtggtggaaacttctctcgctgggttctccgctccctcccactccccctccccaacacagagccgccggcctcccgacgcttctcccttcgcccccgagaggccccagtgctccaggaaggtctgggccacagagactgtgaccaggggtgaagaactcagagtgcgtgtctgtgagccccgaggttttggcactcgatgaccttgctccctgcagccccgacttacctctttccctttggtcattcggggctttgtatcagtcggtgaagaaggggagggaagagaaagtgtttctttcgtgcgtgtggtttttattttaaggatttgttggaatctgtcacccccaactgcacagccccctcccgtataggatctagggcgaaagcggggaaacgtcggatttagggggaaagggtcgggtcagaaacctagccctggaggctggatcgtactctcctggcgggctcagccacacttggtcggcacgcggggcggggcgacccagcagagtgggggacgcaagggccaggtccctcggtccaggagacgccaaacgttccaaccttggagcgagagagcaggaacccccgcccccacccaagcgcgcgcgctccctagctcgacgcgcaagccgtggctctccgcgccagagctgctcaggcggcaattttttaagcctgcaattaagcgaggcgtcgccgtgtcctctgctagtgtcggtcctgtcagtcgcacatggccttggtgctccggtccgaggccccgcgattagtcacaggctcgcttcgctccttccctaatccgcctctgcaggcagcctggggacgcggccgacttggcggcgctggcagggagccactgcccgcggggcgggcctcctgaccagtgccagccccgctgcgcccgagccggcgcgggccctggggtgcgggtttggcgcccctcccctctcacagccccctggctggggtggcggcgcccctcctcctcccgcccctctcccgggcctgcgagatctatttgtgtggtgtcatttgcataaaaataggacaagtgtttctgtgcgttcatacgcgggaggcgaaatccttattgatgtgtctgtgtggagccttcgattgtcggagcggtttgatttagggtgtttgtgttgccttctacaagaaaggagagaaagtccttctcaactccttcggcggcctgggcccccagaagcatgtccctctgcgcggccggaatggtccaccacttgggccccaagcgcgccggatccacagcgagcaggttgagggccaggcgggaggcccattatgactcataaaatcgggcggcctaatcgccagctgccaacccatttacatgtggagcttcccaatgctcccttcgcccgggcccggcttcctgagggtttgccccgacacagctagagccgccaagtgggagctaatctagtggcctctccttcccgtcggcagcgtggcttcccttccccggcgacccccgctctcttggcctactgcgctgctcgccagcaactcctcagcttggacaaatagctgggagggcgccggccgcgcggagccagtaaatcaatcattaactcccaagcgaggcctggaccaggggagggagcggcggccagagccgagtccgcgaggcgagcgcaaagcctccaccggggttaggagccacccacgcgccaacgaaccgggtgcgtgaaggcgggtcccgccatggcctcccgggcccctccagaagcctccgcccgccgggcctttcaagcccgcaccttgcctggccaggcaggtcgcgttacagcgctgcccctgggagagcttgaacattaacgagtcgcctcgggcctcagcggcctgctctccacaggagagcgtcccgcgcttgggcaagctcctcggatccggccgggctcctcctggctcaggcttgctaaaccaaactgatcgcaccctgtatcgaccaatctccctgcggcaccctcttccctcagcccacggtggagccggcacgcagggggttaaaagccccggttcgctctggctcctcggctgcgaggagaaaacgctgatcaaagtgcttaaggggaaggtaacacatgcacattcggtcccgggtcgaaggaggccgactggagacggctcccgagccacccgcctcgacccgcttcccacactcccgggaacgcggcggcggcggcggccctggcccgcacgattcgctcggcggagcgctgcgctgctgggctgggagggcggcggggaggaggagagacgagggggcgggaggcgaacccgggctgcgcgccaagaggcccggagccgcagattagtcaccgctcggctctgcgctcccgggtgcgcccgggaaccgggagggcaggcgtcggccccgctcagccgggctccccggtcctcggcgcgggtgcccccacccccacccccgcgcgctcctggcgcggctggctcgactctcggggacccgcgcagccgagatccacttgtcaggtcaagggcaggacagaaactctgcaagcggagtcttgcttgcgaacaggaaatttctccttgatgaggtgctgcccctcccccacgccgggcttcaaaacaaaactccagagcgggcggccaggtacccagcctcgctcgccatggccggcgacctccgctcctcggccccggccccgggcggcggagccaagccaacagagccggcggacggactcggcgccggccccgcggagggcgccaggctgccaccctccggggcccggacggggtcggcgggggtgcggagccccggagcccccgcgcctccccaggttctacagccaccgagcggttttgcggagctgcccgaggccgccgggtcagcggctccccggagggcgtggggggcggggaggccgcgcggcgccgccgactcggcgaatcccgctgcgggagcccgggagggctgcgagctcggcctggcaaagttcctgtggaaactccatgttttgaaactcctgcggcgtcgcagaaggagggggagaggggagcgcgggaagcgcgcgggggcggtctgcacccgcctctccccgccggggagtgggttccgcggccccccgggcctcatgggaaagctggagggcggggacggccgggtccccgggcccgttcttttgtgtgttctctctctcttccacactctaagagaaatttataaacccgtttcatttaatgaattcacccgggagaggaaggctgcctttttagggaccatgatgttcagggtaatttcgtatttgacacatgtaaatacttagtactctcaggtaaggtcaaattatttatcatcttaatttatatttcaataggcctacaatttagaggcgagaaatgcctccttatgaatcattatggtctattaggggaagtaatgtataaacagcactatttgggagggaatcacttatgttgacatttaaatagctcttcaatagttaaaaaaaagacatttgagtgtctttgattaaatatacaatttacaagaccatcagcatagccatcaggaatataaattcttcttggaatttttatttatttccaatttttgaaaccttccagggcatgcgtgtcattgaatccctatgggggaaaaaaatcttaacatttcaggcaaaatattctcctctcccctagcttcctgtcttatcaggaactcagggaacttctggaactctgagcacacttcaccagcagggaccacagtgggaagtttgtagatcctgtacctctaagacaatcaaccattttcttttcttttcttttttttcttttttcctttttcttttttttttttttttttttttttttttttttttttttttttttttttttttttttttttgagacggagtctcactcttgtcgcccaggctggagtgcaatggcatgatcttggctcactgcaacctccgcctcccgggttcaagtgattctcctgcctcagcctcccaagtagctggaattacaggctcccgccactacacccagctaatgtttttgtatttctagtagagacggggtttcaccatgttggtcaggctggtctcaaactcctgacctcaggtgatccaccagccacggcctcccaaagtgctgggattacaggcgtgagccaccacgcccggccgagaatcaaccactttctaacaatattgcagccaatttgtgaaacagcacagcttccctgctggagttgaaccttccagaaggccagtgtctgtccatccatcctgatgttcccgcagcacccaacataggatctcacactgttttaagtcatcgtttcatacctgctaaaatatcaccttcttagaggcttttccttgctgcctccaccctcaccccccataccctttcttgaaaggccccttgttatacttctttgcttgaagcatcacccatctttataatgccccttcttaacctcgcatctcctttgctggttccctatttatctgtttccctgtacacctggacttcttgaaagaggtgtctccatccatgtggaatttctgcaggcttacctcatgttcactctaaaaatcagctagtcatgaagttattttaagacactggaataagtgcagctttgtttataacagcataggattataaacaacctaaagagtcagcagtgacattgatggcacatgcatacaatggaatattctgtagctgttaaaataataaagaagatctgctctgtgtattgatatggaaagacccccaaggtctacagttaaggaaaaaaaaataaggtacagagcagtgtgtaccatctgctacagtttgtgtaaaaacaaaataggggggaatatagacacatatttgtgtgtgcattaaagatttccaacactgcaggggagtgcccccttcccccccagtttctctgtagatatgcatgtcctctggtctactttcagaaatgggaacacactgcacaatctgttctgtacctcacctatgaaacttatcaatatatcttacttttctagcaacacatggagacaggccttgtcaatttccaggctggtggaatttcactgtatagacacatggtcatttatctcactcctcaacccctccatcctccctggccattctgcagaaagtgctcaagatcactggttacttccttgttgccaggagtgggggccggggtgggggggcggcgttgtttttcagtccttgccttccttggcctcccagaagcatttaccacaccatgaccactgctcccttgagctgcttgctcacagggttttcatcctagctgagaaccgctttcaatttctttgtgggcttttctatgctctaccagttgccttgggcctggatcctccccttcctccccaccagtctcatccaggtttatggctttaaataccacctacttattgatgacttacattttttttttctagttccaaatccccatatcaaacttcaaacttggtatctcaactttgcatctacgctcagcttaataacaatagcaagcatttacatcacgcctgttaggttgaagctctcttcaaagtgctttctataaattaactattaatccttacaactgccctataaggtaggcagagttattatgtacattttttccagatgaggaaactatcagagaagttactgaacattcctagaaaatggtggtgctaggattcaaatccaggcagtcctatcttcagagtccatggtcctaatcactttgccacactgcctcgttggcatgtgtctcgaactcctgacctcaagtaatccacccgcctctgcctcctaaagtgctgggattacaagtgtagcaccgcgcccagccacaactgaattctaaaaagaggaattaatttacaaatatttgggggcatttaataaatgccaggccttgtagcgggtgctagggaaacagtggtgagcaggacaaatgtctcttagatagagaagagcttttcctttagaacctgctctttgctttaactcccttccccatcacagaaaatggctcacccactcaggtgcttaaagcagaatcctagggggccatttttgacccattttcattcatctccccctcaccttcctccagtccactggcaaagctaacccattctacttccaaatagtctatctagtaagcctacttcttcccattttcctacatccacctgaggccaggccaccatcttgggcctggattattatacaggatgattattctagcaatctctgtgctgccacttttgctatcctccagtccacccgcaacgtggcagctagaaagatcttatttatttatttattta

SEQ ID NO: 7132 - DNA, 1623 bp, artificial
  synthetic oligonucleotide
cagccattgtcctctgctctagatctgacaccgatgattaatgcgcctcgtatttgagtatttcttcttttcggcttcttccttgctttgggttttattttccagctgctgccagagtttctcctcagaagagagtaaatacagactggagcattgcccttggtgttgccctgaaagcgtcccaggtgtcagatcgcactgggccattcctggagtaggtgatgttactgtttagagttcagtgctaacccaccacctccaccaatcgagacctaagccgttaattattctgaaaataccaaaaataaagattgcagggaaggcaattaataggatcatacggtctattcctcatttgtaattacatattattatttttctccctactttgttccaataatgatttaaggctgcttccaaagatacacaaaacccagcaaagataaatagaagaagtggaatatgaattataatgtcatgcctgctcacaacatctctgccccattccacataatagaagtgaattcataacgcctttcaaaaatgaggtaattcagctattttggtggcaacactaggctctttgtaaagtgaaagggtggtacacgatcatggaaaaaccatggaggggacactcgatcccctttctaatgcttgctttcttggtgtgtgaccttgggcaagtcgctcaccctctctggacttcagcttctgaaactctcaaatgtctctgccaatccctgaggcttcctcctctttctgacgtccaagggcaccatcaagaaggcagaggccagtactactgccctctggcatgaggcttcctagaactactattcgagagatagtttcccaggaagtatactatgctcgcactctttctctctctctctctctctctccaccccccccaccccttttcctccctccctatctgtcttctctctaacacaccacaggcacagagaagtctttctggatgactgagataatagaactgaaattgtctcctcccccaaggcaaggaccccccctttcaggaaagtgactttaagggtagcactgaggggatctttttgggaggcggggagtcacaacccttctgacctttctgtcctcccctcaggtgtgagctttcactttctttcctcttcttgcagttcaagacattcttttatttattttatttatttttttctgagacagagttttgctcttatcccccaggctgttgtgcagtggcgcgatctcagctcactgcaacctccgcctcccaggttcaagtgactctcctgcctcagcctcctgagtagctgggattacaggcgcccaccgccgcacctggctaatttttttttgtatttttagtagagatggggttttgccatgttatccaggctggtctcgaactcctgacctcaggtgatccacccgtctcggcctcccaaagtgctggaattataggtgtgagccactgtgcccagcccaagacattcttacaacctggccgactctagatccagtcttatcttcccttcaccccctcttaaccgcatcttccacttttgtatccaggcagcatctaacacaatgcttagcatgtcatttgcttaaaacaccaat

SEQ ID NO: 7133 - DNA, 1301 bp, artificial
  synthetic oligonucleotide
ccaaagctttggtaggcgtatggtgggtgttaaataattatgtgcaaaatagatgtctatggtcttttttctccttggttaatatgcctcttacctaatttacgttcctgtgtgcagctcaatgactttgcactaagcaaagttgaggaagaaaaaaacattttgtagaacaaaatatgcaaacaggagacctcccaattttgtccctgatgaagaatgagttcttcttccccaaagagccagtctccatggttggggcccttagaaaccacagcagacctccagaactgtggcaaaccagcaggtggctttgccagtgccatccaatataaccaagacgcagctaaatttctggataccgtatcaggggctgtcctcaaccataggaggtttctctgtgtgtcacttcactggggggaacttcaaagggacttatgtggcttccaagagctgtcagaatgtttgactctctggcattgtgccggcatcacacgttaattaaattatatggcagatacacctcaatgtcaaagtcagatattatagccgtcaaagcctaacattaggtgcagtattttatagcacagagtatacctttaaacaaattcctggccgggcacggtgactcacgcctgtaatcccagcactttgggaggccaaggcaggtagatcacctgaggttgggagttcgagaccagcctggccaacatggtgaaaccccgtctctactaaaaaaatacaaaaattgtcacgtgtggtggcacacacctgtaatcccagctacttgggaggctgaggctggagaatcacttgaacccaggaggcggaggttgcagtgagccgatatggagctattgcactgcagcctagataatagagtgagactccatctcaaaaataaaataaaataaaataaaataaaataaaatataaaataaaataaacaaattcctttatctttccccagtcctctcttgcctctggctcttaagacatctaccattctacacttcctatgtgaagaaaattccagacaactttgtctgttggggggccccaagactctctggcttgccagacagtggaggtttctggggttgcacctacttgctctctctaacccttgactttctgatctcaggcttttgtgagcctaggcttcaccctgagagagaagatcttaccggtctgtgggtaaaacaaatgctagctctttcttcaaagatggttctattagcagggcagcaactagccaggctataaaagggaagtggacggggggcgactttccctccaaatat

SEQ ID NO: 7134 - DNA, 20218 bp, artificial
  synthetic oligonucleotide
gaggcaaactgagtgactgagaaatgcgggtgggagaggcaccaaacatccttttatagccttagaattttctgccaagtgcaggtgttacccataacatctgccatgaacttgatgtcacctgggcggaccctttggagagaaagcacggaattcccagctcccaagtcccattcagcaggtcagctgctgggagtatgagggagtctttagtttcccagctttatgtgtaaagtgggcagaaacacaccatcagacctttggcttaaaaaatatatatatacctaagcggggtgcagtggctcacggctgtaatcccagcactttgggaggccgaggcgggaggatcacttgagcccaggagttcgagaccagcctgggcaacatggtgagacccagtctctacaaaaaaaaaaaaaagaaaaatgatccagctgtggtggcacatgcctgtagtcccacctactcgggaggctgaggcaggagaagcacttgagcctgggaggtcgaggatgcagtgagctgtgatcacctcactgcactacagcctcagcaagagatagatggagaccccatttaaaacaaacaaacaaacaaacaaaaaaaccaaaaaactatgcctgaggagtaataccagggattgctctttctcctggttttagtgtaagcacaatgaagttttcagctccatggggcttatctctcttggggagactttatgttctctaaggaggggcctgggtcttgttaaccgggggtttccccgagccaccccaacagccacaagcacagtgcaggacagacaagagaggcttgaacgaatgctagttgaatcactgactatgctgtgttcaccatccacgaaggaccatgtggtccaatatccttcctattcgtatgtgtgggtaactcttggagcatggatgccacacttatgacaagtgagcagtgattctcagcacagaatgtgatatttttctgttgcacaaagttaaacagtgaccgagtgtccacaattgcccaacatggcctgaagctgccagccaaggaattgggtcacccctggttcactctgaggggctgggggatccccgtcttgacccattggcaacccactcactcttgggaagctctgggtgaagggattttggaagccattccctggctctggaactagcaacccacaactagaagggggagggggtggtctgagagggctgccaaggggcagcagggcttcctggggcttgggcttgctctggggtgtgcccaggtttttggggggcgacggggcctgagcagtgggctgaagagggcacgctgccagctctggttggcccagggccagtaagtctgactgaacttgagccagccctgttggcccacagactctggaagctgaactgctccagcgctccttggcctctttgttttcacttccccacagctctctcttagtgtttaggaatgtgctttgaaggttccagcgtgtttcgcctctgcttagggaaaccaagagcagaggctgggcccaggccagatggcttgaggaagggcacctgtgatcacactgagagcgccccaaggggcaggtggaatgcatggggcacttaagctagcccccttctctgctgggagactccgtgtgcagtgctaaaccttggagattctcaggtttgttttgttaagggaggcagtattcccttaccagctcccccagagagcctacatttgtccaggagcttttggggataagctgtgctcttctgcttgttcagggcaagagagagagctgtagcgtgtgcttttctagctagaaaagttgcctccttcgttggcattagaataagtttcctggcctgcctagggcaacaaagtcaggccctccaaggaaggggaagtgaagatggcctctctcgcactcccaccactgggaggacaatcttacaggcgcaggtgcttagccaggtagggtttggctcagggaggccatagaggggtccattgctacaggttgccctctggcctcgatgcccacctgtaaactgctatcttcaagagtggaacccagagtggttggcttcctcctcccattccccagccccttcacccactgtctttcatggcctttgtcaccaggcacatataaaggggagagtcttccctgctcagtcctttgagggctcatagtgctggtagccccctttgatgccagcatagtgctttgcacacagcaagtgcttaataaatgccaaatgactaaaataccaggcctcttcagtgaccaagagcactctggatctttctctaaccagcagtcactttcctcctctggctgttttctgaagctgggagctctgggttctggtctcttttgccacaaacatgtcaccctgagctagtgttttcaccctctcaactgatttcctccactgggttaaacagagctcaattaaagccctggtggctcttgtatgacatctgcatacattcttgtttgccggctgtcattttagcttcaggttgggtcacttcgatcctgcctgggcccaggtgctagtagggtctttagccttcagctgaaggttctcccctgctcctccaccatctgtttggctttacaacacacacctagtccttggactcttgacacatctgttcctttctgtccccacggccatttatacagctccagctcctgtgcgtgagggggccgtggcacatgagcaataactccgatgccacaagggcacctgagtcatttttctgcagccaacactgtctggagctacagcagacctccctcctgctctgtggtgacataggccctgttcaggtatgtgtgggctatggatttttttcccgatttccatttctccttgatttcagcacccaagtgaacatgcactccaaggctctgctgagggtaaacagaaagcaccatcgcaggggtccttcctcctctctctcggaagattcactttctcttcctaggtaatgactgctttttcctcccagcttcctctcagcctacgtatatttagtgcacgttgccctggatagagtttaattaggcaccaatgcacccaggggcaaaaaccaaggacccctctcgggttgagcaaatggggccagcctcccctggctggtaaatgacgagctgagctgccggcaggtagaggaggttgtccattctcagctaatgatcgccttaggcgccaagtgatggaaaatccagaaggactggcgagctgcagggggcagccagggacaattgtatggaccagtttaacatggcttccggagggatggcagcaggaatgctgtgtgtctgtgtgtgtgtgtgtgtgtctgtgtgtgtttcctggtctcctttctctcccctccctgccgcctttccctctctcttgctttcgattttctcttctgtttctagcccacacgagttgaaattagaaaggtctttgaattcatttatttgttttaataaaagcagcatttttaagcagcatatttgtagcaattgattgttaaactaaacaccaagccaactaaatgtgttagggggaaatgaaaagtcagtttacaagaaacataattaacacgtcctttgacttctcctaagcctttgtctggctagggacaagacagaggaaccataatcaactttaataaaacgaaagatggtatcaaggccaaaggggaacaaaaaactttggagtaggaaacaaaagccaaagaggggattcttaagttataacaaatatgttaaaaaacaaatcttttggccaggcgtggtggctcacgccggtaatcccagcactttgggaggccgaggcgggtggatcacgaggtcaggagtttgagaccagcctggccaatgtggtgaaaccccgtctctactaaaaatacaaaaaattagccgggcctggtggcgcgtgcctggtaatcccagctactcgggaggctgacacaggagaatcgcttgaacccaggaggcagaggttgcagtgagtcgagatcgggccattgcactccagcctgggcaaaagagcaagactccgtcctgagaaacaacaacaaatcttttgtttcctaatttttggtcatcagccattttctccttaccaataggaaggctccggtttgaactctacctgttcatggggacagatgctgagacctggaggggaagagggaaggtggtacaaggaacctgcaggagactgcagtatcaggtggcagtatcaggaggctgataaatccaggctaatggaaattactattgcacaacaccagagtcttcacgtggcctgactttcaataaactgttcccctcctcactccttggagaaagtgaaataagacattagactttcagtaatctcatatggtgatgatcaatcgaaacctggagaagaaggccaatttatagaaattgtatctgcttcactgggtggctggaaccagggagctgaaaagaaaacggtgctcgcctttgatgtgtgaagttgccccaaaatgacaaacgccaaaaaacactggctatacatgtggggtattcaaagggagagggtactcaggagaggcctttgttaggtggatcattgcggggacctgaccaaagacacatgcacatgttcaggccacataaaagcgatttatttttcttatcttttggctattttaagttggagtttccatctttcttatttgttttatcaccaatgaagtttatttactgaattaacttttaacggaccctccactttgttcttcagagttggcttccacgacttgcgcctgtttagccaggattcctcttgcctttgtgaccgccccccctccccgccaaatcccaatcctggaggtgaacggctcagtctctgttaactccttgcctgctggtgttttttctctgtagctactaatcacctccttttgatcactgccaagttctcaggttgaaggaaggagaaaggacctcttgaccactctggctggctttccacatgagcctgaaaatgtcgacaaatttgaaacatctgccgagctgctttggtctgattgctaaaatatgccgacctcaacccccctccccccgccccttttaatctgtttcatattcacaaattaagcatttagtctgggtaataaatcaaggcggtttacgaggctcacacgagacaaacaagcgagaagggcgcaacacaagcccctggaagaggactgcacggagctgccaggagtcgggagctcccagcgctcgaacgcggagagcagcctggcgcgtcctgacacgccgccagcacccacactttggcaggtcccagagccggcggggcgcaggcgaacagctccggactgggcccacacccctggaaccttccgcgcgaacccgcggcgcccggcccgccccagctctgggcaactcagcccctccgccccgctagggagtggccgctggcaaaggggacaacctcacccgacacacaccctgtggtgggcccattaagtctctcccagccaagccgagaaggctgaatccccctcccccacctctaccatccggcagggcttggccttaaagatcccaggcccacactcaccagaaaggcaaaagagtccccgttcaggtccacgtgtgacctccactaagcctggaggctaccccctccccgccccaaactctccgtgctgcctcctcccaggtttcggtcccagcagccacaaagctactttcagattcagataggggtgggggtctcctggagagcggatcaaggtttaagagcggctggggagggtagcaaaggcacaaacagggtccaggccccctctgcagaaaccccggcccaggcttttgcgaccacccaaactcagggggctccaatctgtgcgtttcccgccctcccctgtgcagcagcgagaagcggacccggattaggggtctgggaccattcgcaacccacgagcttgggagaccccggtggggagggtggctccggggtcacctcgaccgggcctctgttgcccggctatgctcaagttccctgtcgactggcgttctcgatgctatcgtgggacgcggcggcggagaggcggagggcgggaaatcgggaagcctgaacatgcagcccaccccggacctaaggggaagcgtaggaacaattccccaccctgcaacacagtacacgtcgcccttcctcttcccctagcacacattccgactgcgaaagccattactgccggcgcgcgagagactttttaaatatttacagcccgctctccgcacggtagcctgatccatctcgtgggcgcggaggcggggcgcggggctccgctcccgcggaggcgcggagccggggctggggagcccggtgcctccccccacggccctgaggtcctccctgcgcccccactctgtttaacccccaggtggggagaggaccccgagactgcacacagcgcgcccggggccctgccggggcctgagcgggcgggggacagtgtccgggaggagggagggccgagaggctgatttaaaggttctcaccgggaagcgagcgaggcacagacctgagagccgccgcgcggtgaaatccgaggagctctcttggcgaggaggggctgtcagaggccatttatctctcgccagagtggaggctcagctcccacaccgcccgcgagtaacaatggcagcgatcagcagctctgcacgcgcttcagtgcatgaatggattgcggaagatgcctgcgtccgctccgctcaggaggctctaggagcgccccctccccgcccgccgcgcccgcccccgtggcctccctaggccctgcgggcgcctcggggttcgcaagctgggccctgcggcgcgatcactctcacccagaacccccgccgccgttcccagggccttggcacctcgccaccgagtgtcattgggggctgaaatttgacacaagccttcctggcctccccgacgcagacaccgctgtcagccccctcctttcttcgcgcccctagcccctggcggcaagtttactttcaaggagttggaccgtgtttccgccgcaaaggccggcggcgtgcgggcccgggaggagggggcgggctcggaacgtttccttcacctgctcggccgcctggggtgtttgtaggtccccgctggcccccagccctagcgtccatacgcggcgctccccagcttttggcggctaatccaccgagagtccctgcgatccgcacatgcacgtgcactctggataccctcgtcccagcccacatcagcggcaaaatcatgtacccaaattctctttcttggcggcttacagtcttgaaagttgggagagcgccacagacctcgaagtctgccgcagaaatgttccccgtcaactctgcaaagtaggtctcattaaaacaaaacaaaacaaaaaaaccctccagtttcggcctagggctgagagaagcgggaaacgcaagtgaaggataccccaatccctcgagtttgttttggtggagctaaaccagaaacccggggatatttctgtttgggggaccgccaagcccgggatgcgtctgcctaaggcgaggtggggagaaggagagcgcaagaagtggacactcgcagcgatccaaaggcaaagccaagtaccccgcgggaagaggccgagctgacccaggttgcaggaagaccgccacatgtgcgcaaagacgcactcggagaggcagagcgcgacccgccgacctaggagactggcgaggacaggcgagaagctgacagcaagacaaagcgggagtagagagccagggaggctcggtcgaagacccgaaaacgaaggcagcagcagccgcccgagtcccgaagcggaggcgtgcgcagccaggcccagcctggcatagccccattctcacgcctaaggacgcggacacagactcttggcatgacttcctgccagagctggtctctgtagggcttgggcctacagttggctgaggccttcccagcagacagtggggtccccaggggaggtcttcaagaatccgggcccctctggtttccgccccctccttgagcccaggacaaaggtagcgggtttgaggagctcggactgttctcagggcgtctacaaggccatcagagagctggtgcctccactctcagggcctcgggcaactttttatctgacttggcggcgctggagggctgccactttccaccgcatttccatttggccttcgcaattgcaataccctgaaggcactgcccacaccctagccttccagcaatcgggattcaagctggacttcccataaccagcaacagtgtaacgtgaagacactcctagactcaggtttccctcaacccttctcccgcttgtccgcacacggggcggatcaacgccccccacccacggccccacccccgcgggctccgcaacccagggccgcagctaccgagtgtgcttctcctccctcccgaggctgttggctttaaacacacttgctgcactcacccccaccacacactcagtcgttctcacccttcctttctccctgctgggcctcctccaaaccggattgcctagcctgaatgcagagtccaggcagagcaggaagcctgagagatcaagcagaggtggccgaggaaacagaagagagggcccttcatgggggaggaggcccatgtctgagaaagaaggcagccaggagacacagcctgcaggagagagggagtataaagggaaagccagcactaatccctcagcctgcctacgtggggcctgacaatttacaaaagccttttccccgaatattatctcatgtgccgcggcagcctcaccaccagcgctgtgagggaagtaggacagatagcatcacccccattggcaaaggagggaaatggggcccagcgggttgagagaggtctgtgctaaggtcacagcgcgaagagtggtggaagaggcccgaggcctggggtttcctgccccaaagttaactttcctgttccatcgttgtgtatgtgtttctgggtgagcatctgcatggaggggaaggactgccggacaggaatgcacagtccagttagggaagtccaggaaggaagaacacagccccacacctcttcctctgcccgggtctcacacaacagcccctgctctttccacaacagcctggagccggccccccaccagcctgcctggggggagctgttagtgcctggctgtgccttcagtagtgcggatttcagagatctcgtatcctctgctctgctccgctccgctcagctctcttctcagcctgtcatccccacccccagcctcggctgcaggatgccttgcgtccaactgtggtttccgggcaataaaacaactattaaagtctcaggcacggctggtgatttgcatcacatcctcttgtgcatggattcaatgtttaatacacaatattgaatacggatattaaaaatcaatagctggggacccctggggaggcggcacagtgcgatcctgcttcgggaacacaaccagctcttctaaaaagacaggaacggcaagttcagccaagctgagcccagcgccaggggaagtgaggagtagtggatgcatctcagcttcctgatatgcttaactgcgccattcccaggtcaagctaaagggaagccaaaggaatggtgtgcccctaggctctactagctttgagatgggagggtggggaggtacggtttgtttccaagcagggtaccagccaggtgcgcggagttgctttttttccttgttatttgcacttaggtttggttcgagtctgagtcttacatgcaggctctcaactcttcccaccatgatggctccttcctgggcctcatgacatccatcaccataggccccatggggagctcttggcataagctttcagagagatggaacaggaatcccaatggctccgaatatgctttgcacagtaaaagaaatgtgaatgcatgataccaggctctgagctgcaatcttctgaggcactctgagccttcagaacagaaatcctcaggccgtgtgacccgcctaaaggcctggtgatggctgagtggtgacagaggaaaggggacgagaaggagactgggacatcgaagcattcctgctccagagccagaatccagattgtccgttaaacagccaggagaagagcaagctcccaggatgcataattatcttttcaggcctgaagaggaacatgtattactctcttctttatcaaaacatagaaatataccttaccctaaacagaaacaaggttctcacagactgatggggtaggagtgaaggagaataaacatctttgagaggattcagtttttttccactacggaaagggaagagaaactgacagtgggaaacacacttaggttatctgattggaaaggcctgggggattttagatgccaaaaactgtgtgaacttgacctagtgaaatgtcatcttagacaccaaattataataataattttatggattcatttttatcatagtttaaatcaataaggattgagttggaaatcttgctctagttataaatagatggagagaacacctcaggaaaactccaaagtagtaatttgggtaaaagttagaagcggaggaaagaggtggaaaatgacagttaatgagcctgtggcctccactctttgttacctaacagttgtcagagaaccatcaaagggagggaacaggcgcccttctcagaaccatcacaggaaaagcagacattctctggctgctgcagatccccccggtggtggttcctacacccagcctcctgggagtttgcctatgtgtatttatgtgtttccgggctggggagtgtagctactttcacaagattgggccctgagcctgtgaaacccactagcgaaagttctaccacgaggaaaagccattctaaggcaatgctggagaccaggaactgctctgccatcatcaacaatatcttcatgattcctgcactagcaaactgcttcacatcttcccacctcaaccatggggccgagctctgggcctcttacagatccatacaggcgggaccttttgcagctagcacagatgtgtggttaaggcatgagacagctggccaaggggaaaggaggctaaggctggggatggctgggaaggaccaaggcccaggagggcctcctggtacaagcatagaactgacccagcatgggggagttgtacctccagaacccactaagggtggcacttcccccctggacccaccaggtactccaaaccaagaggaaaagcatccttgtggcatgtgggtggattaggcccaaggcgcaggtgagctctgctgcagaaggaacctacacaccaagtcccaaatgcccaagtgctgacagggattggggcaagcaggagggaggggggatctttctgcctcccatcacctcacccttctgtaatgttttcctggaatgaacagaagtcgccagcagagttgttcctggagcccctccctccgggactgtcactacctcctggtgtaagacagggaggaccatggccttctgccgggaggatcctctggctagtacccgagccttggattctggcacgaagcctcacagttccgataaggctttacctcccttcccacgtctcgaagaaaaacaccccctggaactgctggggtgaactcggagcctgaggccagggtcagcggggggacgggtccccaccaccaccaagttgccggcagaggtaacagctgtggaagggggaggggagcgacaggcagccacgactgaacggttgcgatctagaaaattcaacaagaggccgcagcggtggcggcggcggcggctccaattagctgagccaactggggaggcagagagcgagacggcggccccgccgatcgtgtcccgggcgagcaggcaggcgggggcgcggggcctcgagctgccccggcggccctcgctcggcccctcccgtgggttctcggagcgcgcctggtgtttacacactgtcctttcgacgtgagatcaagtttcaggccgcgctggaggcgccaggggccggccacaggcccaggagaggggaagaggtggagcgggatctaaggcagcgctgcgccgacgagaaggcctggcgctcgtgggcacagctagtgcagcggtccccacggggtggggtggagagaagttcactgggcacggtgggtaggggttggtggggttgcaggggggtatccggagagagaaacacctccaagtcactagagtatttgtctttcgctcactcgggccggggaatttagtcctgcaaggggacaggcggcggcggggatatgctcagaacccaggcgcttcgacagccctgagcgccccttgtgcgctcttcacccctccccaccccgtccctttgatatactaccggatctaggccattgttacggggaggggtatgtgggccgaaggaactcggggttggagacctggagcttcccagcgcgccctggccctggcgctgcggaggcctcgggtggagtgctggagggctcgccgctgcgcatctcctctgagctggcagccagcgggtgccccacgctgtcaagcggcggcgggtgagcttccagcagcacaggcacactgtaaacagccgcgtgcacgccctccccgcccgggctgggaacctcacccaaacaccacgccgctttctctccggctaccgggcgaggcttttgtggccaagcctaggggaagggggtccccaccccacccccaggccacccgggccccggagccagcgttctgaatctgcaggagtgcggggtgctgcggggaggggagggagtcagcgcctgccccctcctcactgaatgtctgctttgttccggaaaacaagggaagcattaggcggctgcccccggggaaacacaaaacttctttttgaatctcgggaaaggcggttgactgcattaaggagctcccgagacagaatgaggaagggaaaagccgagagggcgggaggagacagggagacttccgcgggaggccgatggtcaaagtggggggtgaaaccgctcagggtgaccgggctggagacccaggaacccgattcggcgcgaaggtgccgcgcgagttccagcgagcagcctgcccggccaagtggcgcctgcccagccgtcggccgtgccagcttcctgccctgcccaggaccgcggagcagtcggggacgccgccgcaggctggcccggaatcgcaggacagcggcggggggagggggtagccaggccgcaagtaaactcgcactagagctttctgcacacctccgccctagagagggggcccggacccccggtctgtgaggcgtcggctttggccttccaaccttggggtgcgcgaggaagcaaagacccagggggcacccccaccctcgcccaaggcccgagggtgggggacagctgaaatgtctttggtcttgtttgatgaccgcttggcggatctgctcccatccgggttctgccgttccgagagtgccgggtcagtgatacccaggccggtctgagcaggcatgtggatgagcaaaagcaaatctgtcgctcctccgaccgccacccctcacttaacctttcctgcatccaaggaaggggagggcacccagactctgccccaccccccgcggggcgctccctctgcctcggaagctgagactaagagcgagggttttccccctttcccctgggctcgctgggtttctaacttcctctaaacctccctcctcgctccgaaaagccccgaggagaggagctgagaggaagcacgccgctagtgtgcaaaatgaagaccatgtgtgaggacggcggcatcagagtgcagccgcgggggttagggggtggcaaaggcccccgcgcggccggaggctcggggccgcagcagccagtgcctctgctctgcgttggggactcggagccgcagcgagaggcagtggagaggcagggctggcctcgtggcgggaggcgaggagggggtgcgagggctgccgcgccgtggggggcagggggcggggacgcagccccggcttcctgggccgcagctgcgaccgagggcgcaagagcagatcgtgctctgcggcggtggcggctcgggcccgccgctctagcagctgagaatcaacaaagggaggcggcgggggaggggcgccaccgagcgttcgctggctgctctggaataataaaaaataattaataatgataataagagaaaaatcccccggctttcatggctctgggtttccgtgtggctgcagcgggaagcgcgctgtccttgaggcggcctctctcgcctggcctgcccgcccctccccctcctcgccccctcccctccccaggaaccgggaagagaaaggtctgcagctgacaaatattatccattctccccatcgatcgcggagtgtacagatgtgagcgcttgatgtgcccgcggagcggcggatcctccctgctcgctcgctctcgcccaggctccgctcgccgtccccctcctccccctttgttctcctcccctttccctctctttaaatagatttcagggcgctgcctgttggagagcagctggcgatctctcccgagagagggagcgagcgaagcccgaggtgccctgtcaccagcctcccctcccccacctcggcttttctctacgtcccccccaccccacctttctccagtttccaaaatagaaaacaccgggaacacccacgtccactgcaccgcgagcccctgggagcctttggacccctcgtgctgttccttgtgtctgtgtctgtgcagaggaagggcagtgcagggaggggacccagggccgcggcagaagagccaagggtccggatctttccctggcagcagcagggacgcagcgtgggtcacgctaacagggtacagtttacccattagggaaagtcggcggagacggccctgttattcctcttttgcagatggcagattaatccggcagcacccggcctcaaagggaccggctgctcggcaaagggttaacccgtcggccggtaatcgtggacacgcgcgcacacacacacacgcacgcgcgcgcgcgtcctctccgcctgcccgagcgcccgccgcggcccgcagtgcgcccggggctgggggagtagctgcgggaggggagggggtcgggggaggggcggggcgggcttaaccaggccgctcgactgagccggggccacctcgccgtctgtcacttaaatgattgtcctccgctccgctcagtgcggtcagtacgggctgttaacaggcagttgcaatcagtttccgaaaggtcagccaaggtcctccggctctcgcagacggaaggcattacgaaaccgcttttgtatctgcaggcactttagaaaaagaggcgagaaggggcgcaccgcagtgccgcggctgctgcgaccgggggagagggtcgggggctgcggagcagaggagtccgcacccccgcggccagggtcaggcggcgtggatatcacccgcggagtgacccagggcctccgggtttcggtggggaagcaggaagggggtggggagcaggcggcaagggaaggaggagtgggaggaagtgggagaggcgtcctggctcctctcctcacccagccaacagcccacacccggacccagacgggagcgggcggccttggacgcgaggagaccccactcggactctcaggccctcctggcgcctggaagtagggagggggtgtgggggggggaaagaccctcgccgagcgagcgagtcccagcgcggtgtctgaagacgctgctgccgccgccgctagaagtcgtccatcagcaaccagtccaacctgccagtgataatgtgcgatcaacaccaaatcacccccgccaggcgcgatccatcatcgcagcgcgccgcgggcccgcgtgaggctgactcgcggctggggtggggagggggggcgcgcggagcaggaggcggtcgcccagcacacccggactctccgcgcacctcgctgcccctcctggaggcctgcacccaggcgctcataactctccaagttccccagctacagagcgaaaacccagtggctccgagttctgggcacagctcacttaggaatccgcgcgtcctccgcgccctgctgtcgtggtcacaccctgcaaagccattccagcctcggagctgccctgcccatcccctccccctcctccgagaaaccgtggctggcaggaaattaatatttaatatcgtgaaattgattaaagggctggaagccggcgatgggttggggggaagggtagggactcctagcgtaattaaagatctgagagtcgtggtcgttccttgtcggccctggccgcacgtggcctttgtgaagccgaggcggggtcggactgggctgagcctggcgagccggggtcaggagcccgtgcagcttaggctctggcccgcgcggccgggttttttcggggcgggggtagggctggggcggcacagcagcggcaggggatgaggaggtgaccttagggcacccggggctgcgcgcagagccactcttcccctgcccgcctgcaccgtgggccactggagcccgagggtcgggtgctacaactgctgtcttgcttgtacagcacagaagcgcctttactgaccaggtggcctcgagggcgcaccgcctaccccccaggccccctttcagcagcctcactctgggccccgcttcgaggcgcctccccaacccctgacaggagtcttctgagccccccacgcagcccttcgggaggggagtcaggttcacctttccccctgcaacttggaaatcctagggcttaggcgccccggggccccccgccggttctctcctgtccaggccccagcctggtacgctcacgcctggggcagcttaactcgttcagctgcgctgcagatggggcctgctgctcgaagccgctgtctccagggagtcgtcaccgaaccagctcggccagccgcctgtcgtgccgtttaaggttaccgcgcttcccgcgaggggcatcgggactggaccgggcaggaggtgggtgcagctgaggctccctggccacccgagctaacgctaggagaggaattcggtgtgcaaaaggtcagcggtaacccattggccctggctacagtttagaagtcgaatggttggcttggtggtggggtgaccccagctcacggaggcctggctccaaagggctgatgtgaactttttcttgtatctgattttttagtgaagcactctgaaaagtaccaagtgtgcagaggggagaaaacacaaaacacatcaagctgcgtccttggccctaatcaggggagcaggaaggccctccagactccaggccctccagactccaggcccgctgtggggaaggtcaggaccacagaggattaggcccagtcttgggtttattgctgtacttgaacaaagtgccgggggctgcctaaactggagcaagagagaggtaattaagagggcctgcagaaggaagtaaaggctggtgtggctgctgcccagggtaggtggaggaagtgttttccataagaataacaagccggtgcaaatgttatgcagaaagactatttcaccaaaacaaaaccaaaaagttcacattctgcctctcaagctgagctgataaacaacatgcaaactttggttggaaccttgaaccagtgggaggtgtcaacccagtttacaaagggtaatggggaaccgtttctgggtacttctctgtttctaccattgtgattctacctgcattagctgctccctttgggggcccttctgacctcccaacctgagcccagcgggagatcactcagaatgcaccgcattcatcaatgccatttctggtaaattggacctcaggttttggagtgtcctaggaggcaggcagcctacactgcgcgcataccgatgtcacagcaaatgtgaggaaccgcacatattctgtagcctttactgcctttactagagaataccgtggatttcacaaccagaagtagcagattttccaagacattcctgatttcaagtgctttgagccctgtgtttttacggggcatgaagccctacctgcggttactaatgtcgaattgcgcaccagaggtgtcccagggctggaagaaatggcttgggtgtggggctggcacccagtggtccccgctggtcccctgtccaccatgtctagccaggcggccatcctcctggccgtcccgatcccagccggggcccgtccaggtagggctccgggcagggggcctgtcaggacgaagtggcaggactggccctcggggtccccgtgggtaaaggaggagcggcttcgcgccctgggacagcgcgcgccccggctgacacggggctgtcgccgcttctcccccggacgcgggcggctgcgcaccggccgccatcttggcccggctgcgcaggcggcgctgcccccggcggtaggaccgcggagccgcaggctgggccggggctgccgcgcgggcgttcccgggctgccggggggcgctccctcccgaggcccccctccccgctgcgggccacgctgacccaggtcggggacgatggggcggccgtccctggtgaaagcgtggcctgtagtgtcgcccctcctcgaaacgctggagcggattttaatcctgagaaacgacctctggttcccggactcccgcgatggtcaacgtgttatcgcttctcccgcgcaccccagaactctgtccccagaggcaacctgccgaggcagctgggggtggggggcgaggcctacccaccgttcacagggcgctgttgaggccagagaggatttgagagttaccacggtttagggctcctgattggagaacactggaactttatttgtccactttttgaatttaacatgcatttatggagcgcttgctaagggcgaggcgctgtgttaggacctagggggatccaaaagtacagaagtgaatttttaaaagacacctttggccccctcaagtaatttacaatctagttggaaaggcagacttgtaaatgactgaacacaaataaaaggcaccgtgaggtgaacgtaaataaagggcatgaatcttgcagtaaatggcctgggtaaaggccaattattttaaaaataatctttatttctaaaaatgtagaatcagttcgggggggaggggagggtaaagatttactaatactgaatatttccacggttcccggggctaacagtcattacttctgaaaagttgttgtttaggaaaaatgatgaaagtttatttcaaccaagcaaaatatcaaatatcagaaactctggattaatttctcagctcttgacattagctgggtgggacagacacaatttcccaccaaaacacaataccccatttgaaatcagtaaaaactcccaccgcatttcataaaagtgttttttttgtttgttttttgttttttgagacagagtctcgctctgtcgtccaggttggagtgcactggcgcgatctccgctcactgcaagctctggctcccaggttcacgccattttcctgcctcggcctcccgagtagctgggactacaggcgcctgccaacgcgcccggctaattttttttttgtatttttagtagagacggggtttcaccgtgttagccaggatggtctcgatctcctgacctcgtgatccacccgcctcggcctcccaaattgctgggattacaggcgtgagccaccgcgcccggccaaaagttttagaaaataaaactaaatggaagattggaaactttttgaaaaagttttcagatttaaagaaaatagggattaaaaaaagaaacacaaagcaaaaaaagatcagcccatttgcagatggtcttcaagatttggacatgcagaaaattgtcctcagattaattgtacagaggttggaaagtatgggaaaagtagtcataggtcaaagaaaattaggcaaatataaaaatgaggcaattattaactccaggaaaaaaaaatcttacaagaaaggaactgcaatcactgaagctcatttggctcagcaatgaatgatatatatgtggttacaaagtaaacactggatatgaatttagtaaggcattgtgctctagtgctatggtaagaatggagaagggaaagtatggtacagagatctgaaatccccctccaccatcagatggttgacatgg

SEQ ID NO: 7135 - DNA, 1111 bp, artificial
  synthetic oligonucleotide
caaaatcacctcaagggaggctagggtgaaccagatacatcctgggaagccgtggtgaggtcaggaaaggggcaggtgtggcagagttcacccaggtgtattacactaattcggggctccaatctgcactgaggtctaaaatctgaacgtcatgcctccaaagtcttactgaaaatgaaatcttcaggaggggagaggaaagcaggccagagggtacacatgccttttggattttcaaaaatgggaaaatgattagattttggatttagggaagatgtgtcatgttaagggagccatagaaaataataactgccaattcccaagcaaaacaaaatcatgttttccaccacgtttctatctgtgtctcctagtcgaacccacaataaactagcagatcaaatagcagatcaaaggcagaggcaaatacaattatgcccgtgaaacctctagcatgaaattagaagtcaaactctccattcaggggttagagacaaggataatgggaacctggggccctagagatgtacccaggccctttcagtcacaacactatccatgctggatatttaaaaccacacctcagggagggcacaaatagtaagtattaattgtttttccatacacactacaggaaatgcattgactacattcctagctttgtaccatataaagatagctgtatactggtggtagagggggcggtgacttataaggcaatagtgaaaataatgttgttgggagcgatgaagggttactagatcttccccaagacagtaggctaaggatggcggcagatagaatgctaatcttttacctgcttccctttcaatgcagaagagcctaaaacccatctgatcccaccactcagttctccctcagtccttcccacattggacaagatcatagagacagctgtcttgatatattttctatttttcctaaaatccatatttgctttataggctctatttcttttaccctggcctaattttagctctctgagtccccctgcccccatataatttatgaggcctcttgagggtagaaacccctattacaatgtagactagtctgtttagagctactgctaattaagcttagctctcaaagg

SEQ ID NO: 7136 - DNA, 13014 bp, artificial
  synthetic oligonucleotide
taaagcagcttgcaatggggagaaaaccaggccacattgtgtggggtggggtgggggatgagaggtggggagctactgagcagaccagaaggaatagcaaagagacgcaggcaaccccgcttcccctccccgccctgccaaatgccagaggatgaacccgccaaaaataaaatacagccatgattactggagcagaggtcaaagctgaaggggcagttctcctcttgaccacagaaagccagcaccaactgggattatctgccagccactcatctccagcagcctggtccgcagtgcacaactaggccccagccacaaccagccctgtgcaggagagtccaagggtctaggacctgccccttccccagagcctgagaccaaggctggcttggcttcccaagttcacagctttggagctgcttgccctgttggacagtgcagtggggtcctgtggctccaattcacacagtttagaaacaattccttcttctgatccaaatcccaggccagagagacctgtgcctagctagggtgtaacacaaaccttcctacttacaattcaaacaatatcagtccaaatcctctcttcactccttcaagagcaagggcatgagattatctatctatctatctatctatctagttttgctttgtttgagagagtctcactctgtcacttagtggcacaatctcagctcactgcagccttgacctcctgggctcaagtgatcctcccacctctgcctcccgagtagctaggattacaggcctgagccaccacacccagctagggcacagtatttattaaaaactttattatcatcttcctggtgcttcacctgcaactacttcatcggatctttctccaattttttgatgtaggcattctcatacccattttgtagataaggaaactgaggctcagataggctacacaaccactgggggcagagctcccatcttaagcccgtatgcatcttgatccagagttttccatcgtagcttgtgatctcccatcttgattacttattttgtgccaggtcccgggccgggcctgcaaaggtgaataagacagtccctccccttagggagttcacagtttagtaagggagacagactgcaacacagtgggacagcagctctgacctctgaattcgggttggtggaagtaccatgggagtctttgtgaacatctccatcatcactgccccttcaccccggctctatttcctagcccctctggttccttctcataggctgctccttcttgtccttccttaagacagacactagctgctggcttccctcccatgcctttctttcctcctgttaatgaggtctgaacccacacacctggcaggaatcttggcaccctacctgcttggagaggttgccttagttgagtaaacttccttggcttctggggccccaggggagaggctagaccctgactgcagccccaggctggctcaggtggaaagtgggcacaggggccccaacgctgagcaggctggtaggccctcaaaaggcttttattgaagcctgttaaagggctttgggcttcctctgatgaaaggcgcttaagtgcatctggttatgattacaggggaggagaaagccaggcggtctctggggggttggaccagtcatctggctctgccttcctcagggcagagctggctgctggtgaggccaggaggccaggtgtgggggcaggcaggaagcaggaccagtacaaaactctccaactctctgaggctcctgaccccagcctctgactttgtcaggctggactaccagaaacagcatcggggctcagaagtgccaggctcctttgagaaaatcaagttcagagtggctgctgaccacccctgactcacagctcttcactgatctccacctccctccatctccaaaatatcctcccaagaacccctgaccctccatctaccttctccactgctcttctccctcggaggaagttaaaataggcttttgccacaagggtttctgacagtgataaaaactaaggaaatgcaaactttcaaaagttaaaaaacctcaacgtttgctttctctttttcaactagccaggtattgtttcccataaaacagacatcgttaaggctgtttcacgtcactgtaactgacaaccatgccgaattaagggaagagattaatatgaacgtaacgtggctgccctggaacgtcatcgggcagtcccaagccactctgtgcccggcgcctgtccctgcgcggaactccacgtgtgcacaaaatgctctggggaggggaggatcggatgggttaaacacagtccgcggttctagaaacgaaaatacatttccttattcccgccctgatttaatcctgctgcgtgttattattgtcaagtctcttcgcaccactgtttctaaaaagaaaacccgtgggtctgcgcggccctcagccgcctgctcggcttttattgtgcacgcagcctggtctgcgtggatccagcacgtcgtgaccgcctcgcaggcgcgcacggacaccctcggattggcatttctataagagctgggcgcattgtctctgcggcgacacacacacacccacacagataataaagggccacggactcctgaccaaccctcctcgcaacccataattagagatgacctttgcgaaaggcaattaaaatatggtaatgatcgatgggctcgcctgtttccaaaaaggaaaatacacaggtgttggcttcaggaggctccacctggccgggccgcgaggcctcctacagctcatgaatgaactctttctcctgggaagcttcgattccccgctacctacgctagcgctggctcctctcctccctttcccctcccccaccagagctctggcagccaggagcttgctggcggcggcggggctttgtcatcggaacgcacacacagacacgcacacgcgcgcacccggccaccacgggaccgcggcagccgcgtccttcctcgctgcgcttccttccctgccccctcttttaaagagctcctccagaccctttcttttcttccgtcctttatgtgtgcggtccttttgcatcaaggagctcaggaagcattttaggggggccttccgcggagcgccggacagctcctgggaggcagaactcaggaccctacacgcgcggagaggacgcggggacagccgggctttgttttgtctcttgcctctgccgggagggcggagaagcctcggccgagctggggcccactggcgaattggcggcggcaaacacccccctcctagcctaagtggaacctgaaactccggacttggtccgggtggggcacaaagctacgtggagggtctcccagtccacaagtggctctccccacacagacaaatgtgcagtgtcattatggtggctcctgttgctcgaggcctcgggggtgctccggcggtgcgcgcacacctcacctccacaaggcacggagggcgagaggggggccaaggggctggggctccccggggggctgcctggaggagacgccacatcgggccttcccgcacccccggctgccttcctggaccgcgagcacggagccagggcggcctctcgcctttcattacggggcctacgaaagcagcagcccaggcaaatatgtagctattaaaattaatcgccccgcgttgtcagctgaacataatgcaaattatttatgggctgtctgcgcaatatttatcatcgtgcaggctccaggcgcttcgtgcctcctggcctcccccgcccgcccgccctggccggcgcagggcgaagctgcgcgcaggctgcagcggcctgggggctctgggaacccgagtggggttccaagggcgaggccgtgcgtcaggccgtcttccaggccgagggcctcactttagtttctgccattcagtacacatttatcggaggcctattacgtgcaaaattaggaggtccgcgaaatcggggtgaaaaccaatttggagaaatctaaaccaaacagatgagctcgggctcgaggggcgatgcagacagaggctcctcagctgcacaagagaattttctctggctcaagtcggtccttcaacctgggaaacccatgtttgctaaagctggattcgctctaggagaaacagggagcatctgatgtgctcaacagattcgagtacaacgctatcgactggaacaggaattcggtgtccttcgagcctcaaaacttgtttgctgatcgcagataacagattaactgttaattgtcgaaatcggccaaccatttagtttatcactgttgggggccccttggtattcgctgcactttttatatgtaaaaacagtcttggtacctcctaaacggcttttgtgtggcttttgtttctctttcaaatacggtgttttaaaaaacagcagcaacacgccaccccaccccctcttcaaccaagccttctggtttaaaaaaaaacaaaaacaaaaaccaggaggagaaataatctataggacaatcccccccctactggtcggagctggcgttggggctttttacgcagatcgagtcgcccagggctgcggaggtaaacaggctttctgcaccgctgctaaatgaatcacgagggggaagaaccgagactgctgggcgagggaggcctcgggatctgggccgggagccagggcggggacggcgctgcacggggggcaatgaggtggagacgggaccagggttaaccctggtccaaggccccaaggccagggaagggagagtaaggccggtgggcggtccagccggaggcccctactcgctatctgcgaggcagggtgaacgcgcagcctgggcctccatccccagcgcgcctgggcaccacctggggccggtcacgctgcctgagcccatctgcgaggaaggaggtcacgaggcaccccctcccacagagttttaacaactccaggccttcaagacgcagtagcaggcctgggtcttctgatgttcatttaaagcaaaatgatcgcctttcttcactgtccccaccccagacgccaacaacaccttgcacctagcagaccaagcctgagtcaagacgtccttcggtcctggggctgggggaatggctaccaacgggcatctcttctgcagactaacagaaggggatatagccaggaagctactataaatttatattcttcttccggttttgttttggttttggtttttttttttttgagacggagtttcgctcttttgcccaggctggagtgaagtggcacgatctcggctcactgcaacctctgcctaccgggttcaagcaattctgcctcagcctccccagtagctgggattacaggcgcccgccaccttgcccggctaattttttgtatttttactagagacggggtttcgccatgttggccaggctggtctcgaactcctgacctcacgtgatccacccatctcgcctcccaaagtgctaggattacaagcgtgagccaccgcgcccagccttcttaaaatgtgatttgacccaatttaaagcctccctttcttccccattaacctccagtttttgacagattttcttagaacattccaaagattctctcattacttcagaaacttatctcgaaatgatgtaaaaggaggttcaaaatattaggttgcttttgggttccctttatctcgaacattgttgcgtagatttgagaaagggctgatttctactttgttttctaatcagcaagtcactggtttttctacctaagagagactgaacattaaccacagtgaagcagaagggttgagccgcatttacaaagtgccttcacattttggtcctcagaaacccatccgagggggacagagtaggtgttactgttctgattttacacatgaagagactggccactcgcccccacaaatttctggaagctagtcttcctcactgaactggagccagaagccatgtgaagccagcctgctcctgcctacaccctccttcctccaggtcaatgtcatttagaatatattgcatccttttcttggatctgtctgctaggacccgggccaccctcctgctggaggcaaccccgacagcccatattttaagcagctcttttcacagcctgcaaacctcacggattgtctcttacaactgtctgtttactcacttccctccacccagtcaattccgactccaggcccgggaggacaattttaaagtgtttctgcagacagaccctctggccgcgccggaagtgttttatggacctgtgagccgagttaatcccaggaggcgcggctggattagtcccgggtatgggtgggggattcatgtgtttaggtttaatccccatggggggggggcgtaaggagaatgggggtcgggtggcttcagcaatgtgtgccccctccccattaaactccgagatttgcgctagagcggatggaaaccgaggcacgcagccctcgaccccggccaggcgtggagtaggggagcagggggtgccccgcgtgggcgcaccctaagaaaccagtgcggacatggcgagcgagaccagagcgcagttgtgtgtggtttttccccaggtttttattcttccagccctgtggaaaggaggagagccgcaacccggagagggagccggaaagaaacacttaatcaccggcgtctcgctgctcgtcacgcgaagatggcagcggctcccctgggtttcaaggttccgggaaaggcgtgtgttctgccttaaggcgcgcgggctgatgcgctctctccctcggctcggcggccggctccggctcacagagcctctctcaacgccggcaagtgcagccgggccgcccagcccccaggccagcctggccccctctgggcctggggttggcgagggcagctgggcgtctgcgctgcccagcccagccgcggatccatggggtttcgcgagctgaaagtaaaggcttgagggagtggggacacccacaccgacccgcggcacgcaggggagtcaagctgcggccaatgcaagacgagcagggtagactactactagcggtggccggaggctcagccaccttcgcgggagaggggatttaccgccaccctcatccacgcgcaggccccaccgcccggtcctctcctctgatccccgggccattgcgaaacacggagcgaacaggtcctcgccagcagccgtcatttcccgggaagatgggaacccacaagcctgactgtgcttcctaaggatactagcgtgcgcgcagaccttggggggaaagagggcagcgcggtctccccgacccggactcttccctggcgcagcacacaaccgccacgggcttccgaagcgcccgagcggggaggaggaaggaaaagcggaggcccgggaggcgggctgcgcgcttggaagccgtgtgtgtttatgtgtctgcgcgcgcgccctggccggacgggtgttgaggggagagtgatcgtgagcaacccggaaccagcagtcccaacctggactgacgaactgggctctccagtcctgggccgtggggctccatgcctcgggctggcgggacaagcggcggggagcccggagcttcggagccgccgccgggcatctagccagctccgcgggagaagcccgggggcgcgtcgggagccaggggactggtgtgaactagccgcccccgcaggcggacgtttagctccggcacccgggagcactgacactgggcgataaggagttcctcggcaatcggctgtccccagtccccagtcacctccggcggacgtgaccgccggatgctatgcagctaggtgggccaggggggcctttgcattgccttccctgaccccttccttgccgcggaggagccacagtaagatgcctctgtacgactctccagaactttcttttgcaaaataaaggccaaatgttgggccttctagtctcttcatattttcctttggaaggttggggtccaggcagtcctctcgaaacaacccccaaacagatcactttcattacaaaacgctagagaggcaacacagccctatttctctctctggtcaatccaggccctatctctccctctggtcaatccaggccctattatcccaagctgtgcggctttgggcaaaccgcttaacagttcgaaacctcggagtcctcatctgtaaaataagaccaatactattatctacctcgtagggttgttctgaggataacatgcctccatacataaggtgcttagaacgctgcctccagtacaatgctacgtgtgtttgttactatgatctggcactccctttggatgggtagggagtacaaagttccgggttaaagttcctggaagtttacatggagccagtggtcttggcagggtggaaagggcactattgtatggccactgaaaagtgaaggccaaatgccctcaaactgtctaggtctccactagaccgtcccataaaggcttgtgtgtgtgtggtggtggataggagggagagtcctttttaatggtgctcatttagactggattaatagcaagttccgtcagggctcaggcaccattacccactctctccctgcagccctggggaagagcgctggtttccaggacctccagcctactcttccaggacaccttttttgatggctgaaggccacctctttaaatcagttctcggaggagttggccaaaagccatgtcctctgggatgtactttggtctaacactggtgcagggctggcgtatggcaggccttgtccctgggccgctggcgggccacattttactggtgcacagatgcaaataccacttctgtagacagaatcggtcagacttctaatttcaaaaggcttcccattacctttgaaatggcgactctggcaaaaaggggaggagttgcggcaaataagagcctagggaggcctcggcctcccctgcttggcctctccagggtcacccataattcattaggtgaggctgccttttccttttcaaacacaacgcaaatggcctttgccttaagtggctaccggcgtttgcctaatcactgaaatgtgctggcagtgcgctctagctctcagtagatccttatcggaactgtgcgtgccaagctgccagccccgagaaagacaaagaacacgggcgcctccaggtttgcttctgaggcctcagggtcacctctggggcttccccttcacagcctccggcccctacaagacgctcccagccagcctccggaacaaacccgcagccctaaatcagaattccagttctcgagcgccacccggagagttcacatttcccctcctccgaggccgcgtggtgcgcaagaaagagcccgagggcggcggcagcacacgtctgggcagccccctccccgtacccagcagcgtgtacgcaggaaaagaaaaagccaagagaaaaacgtggactgtaaaagccaaaacgcagaaccatctactactaactaccgacaaccccaggcgggagtttgcaaggagtaagcaaccctctaatagaaactacaactaaaataattcctctcttcgcgttctattaaggtcctggaaggtggaacgcaaaggggaccctgtcttcttaggacacagactggctgcgccgatagtgctcagccccgcacctcctgagcatacatttaatgttaggcaaagagcaagtttcctatctaccgtttgaccacagtttctcacagtatttctaattgattcaacgtgtattagattgaaacaaaaatgatcttggttggaatatacacgggcaacctgtatttagatggggtaagttcctgcagctatctgaccacatttgtctggtccctctgagaatccacgttttctagcccgagaaggggcaggcggccctcatggcgcctccttcggcggtttcctggcgaagcgcccatcctccccaagcaccaggaacggaggccgtccatattaatactcgcgggcagcctgttctgacctatactgtcattttttccatcggtcgggatcgggctgggggtggggtggggcgggggctctcctccgaggggctcagcacggatcgttgggttttccccggcgaacttaacacggaggcaaaaggggcagatggaaaccaggccccggctggccccgcgcgcgtaagcgcggcactcagcagctcgacgcaaagccagggctggattttcgcggcccgggcccggcggccgcccagcgcccgcgcgatcctctctccttcgggttgagcaaacgtggtcgcctaattccgcccgggagacagcagctgtgcggcgagagggggagaaaaaatatcgcaacttttccaacagaaagtgtgtgcgcacacgagaggtgaaggcccaccccgattctgtgcacgtatcgacacagcatctaatcagtgtcactgccaggaatacgcttccgcggcgggcgacaccgccgccctcgccaacctgcaggagggaggggggatgcaaatggcgtctcgcgtcgtcctagactccgcgcagcacccgctaccgcgactccaagcagacgttgcagcaaactggggtgcagcgtctggggacgcgaacgcgcaggcggcccgagcggtcgcagggaagaggaactagcaccactccccgctacgagaccgttccccgcccccacctccggaagagccgcccttactcgactggggtgaggggcgggaaactttgcaagaagactgttccgcgccttccccgcgtggcacctcagaagaacgtgggtgggtttcccgtccgaggccagaccacgctaccctacttttccaggtttcggacctgaacctcgtggactacgggagggagagtacatttcgggccactgcggggggcggagggacaccaaagacaggcgtcttcaagggttctggcagatggccaagtttgtgtcctttccctcccacgctagagtagcgcacgccactttggggaagcgtgagaccgttcaccaccggccacgaggccaccaatgtcttccaggtggggccgatggtttgtctgcagcactcccttccgccttgcggtcctcgcctggctcccacagtcctggggagcccccagagctagcccgcgtcttccctcgcccgctcttccgggggaaagggaggctgtttgtgtggtgtgtagccccgctccggcttgcacccccgcgagccacctcgcagccctccccggcctcggcctcacggatcccctcccggagtagccccgcgggcccccccgccatgcgtaatggggcgcccctgggacgcaggcggggatggcggttccggtcgttccgggatttgcgtgcaagaagaaaacaaggccggcgactacaagagcggcgactccattcttggggttcagacgccctcgcagcctccgcgtcggttccgctctcgccccgggagcccgcttccgtgtccctgcccccgccccccaacgattcctcgtccggcccgtgccgcaccacgcggagctccgcgcgccctggctcccacaccggtccctccataactcgcgctcctccctcgctccgggctcggggagccgctcgctcccagcgcccagagtcagccggttccaccttcggctgcgagagccgccgccccgcgccacccccgcccggcccggcccttgtcccagcccggctcccccgccagctgcgccgccaccgccgcacgtgacccgcccccgtcgcggcttccgctgagctgcctgttccggggcacaaacaatttttgctctgacgcggggtctctcgggggccctggcgtcctctactccctgctccccaccccaccccaccccctaccttccgggtaggagaactcaaaacaactcgctgaccttcgggccgaccagctccgtcttccactgactccagcattccgttcaaacccagcagccacggcttctaagatttcactccgctctgggctgggggggagggggcgagttctccgggagggggtgtctcagatcgaaagagccacttcacgctctttctcctcctccgaggtgagtttttagactatttggaggccttggggaaacgcgagcagccgcgtgcaaaggagcccccccgccttctccccgcacatgcagccttgtctagtgtgacccgatttccagggtcagcagcagagggcctggccagcttcggaaataccaccaagcggtggactgtggcaccaggcagagctggggtggaggactgtgctaaataataatggtagctcctactcacgtggtctgtgctaagttcttcacaagccttccaactttacagagtgagaaactgaggcatagggaaaggtcagtcgtgtaaaactgggtaaagctcagttactcagctaagtaagtgacttagtgaggatttgaacccaggtctctgagttcagggtggttaaacatgctgtaagtatgttacagtgcataccttggtatccacagtacaaacctgtctacaaaacccagtgtttgcttgagagctgtatatttggcgtgtaacattgtggctggcatatagtaggcactcaataaatatttgtggaatgaatgggtgtcagaataaatgattgacagaatcattgatgacaagtgatgagagaaaacagtcctaaccattgttcttcctaagagaaataaaaacctctagctgttttttgagtgttcgcaggtaacaggaaactcttattcaaaaatatattaatctcctacccctatcccctagccaaccaccctggtagtcatttgaacttgctggggcacatagccaaagcagcttctacttggtctcggccattttttcccaaccctgttcctgttctgtaggattctgctcagggtcaggcagcctggaactgcaattgatgtgattctgaacacataagcagcagaggaggagggtacacccgccaaacgtggttcgttggcttcccttctacccgctggtgggggctcgggggaacgtggcttatatctctgtggttatttttgaattcacgg

SEQ ID NO: 7137 - DNA, 1096 bp, artificial
  synthetic oligonucleotide
tagagatatttttcaggccaatattttctaccaggtattggcaaactttttctgcaaaggttcagagaataactattttaggctttgcaggccatatggtttctgtggcaactattcaactctgctgctgtagggcagccacagataatatataaaataatgagtggggctatttttcaataaaactttatttacaaaaacaggcagctggccagatctggcacacaggctgtagattgctatagaatctacagcggtgctgtccaacagaaatataatgcaagccacttttgtagctgcagggagaggagatgtctccccagcatcattcccctgcattcagtagaaccacctcccctagtacagaagaaagcaaccaggcagagcatcagagagaggtaggtgcttgaggcagcaagttgtcagagtacagcaaattgtccatcacagctgcaggcagactcaagtaggccaagggcataagggacagggcatcaatagtatctgcctcaggtagcaaacctgagaatgaagcctgagccttggaaggtagagcagtgaaatgaggaggtatgagggcattggggattttatgatgtcgctggatcaaggcttgcccgaagtgagatatacctctggacttttcggtcatgtgaaccagtccatcctccaatcaatatttaagccaggggccgggtgcagtggctcacacctgtaatcccagcactttgcggggtcgaggctggaggatggcttgagctcaggagtttaagaccagcctggccgacatgacgaaactccagctttacaaaaattacaaaaattagccaggtgtggtggcacgtgcctatagttccagctacttggaaggctgaagtgggaggatggcttcagagcaagaccccccatctcaaaaaaaaaaaaaattaagccaattcagtggaggtttctgtgtcttgtaacagaaagcagtttttactgttccaggaattaaacaggttaattatcttgataattctttggatgctgaatatcttcactatgagaattaagattggcagagatatcgatattctcatttaaagtatttcttgag

SEQ ID NO: 7138 - DNA, 704 bp, artificial
  synthetic oligonucleotide
ttggcgtccagccagattccctgtactggccggtgcgtacatccccagacagatggcttgcggagtcagccttctctggggaattgctatcagcctcacccagggatgaccatttgggcttatgccctccttttgccctcatgggggtggcctgcagtcaaccaatgactgatttggggacagaaaagcctggctgccttgtgtcaagtatggggaggagtgtcgctatgatgccattcataatccagaacccccaccccaccctcagtctgacgctagactttggccaaatcccaatctttgcttgccttccccacccccactctgcttctctccatccttacctttatctcccgagagccctccctcctccatctttcatttgcacaagaatccctgtctaaggctctctgcttccagggaacctgacctaagataccactggtcaccacggcctgcagtaataaccctcgcaatgcatggagactgttaccaagccattccttggcctctccgtccccacttaagtaattagttccctctcagggcttattttctaaccctctaatcagaagctggcatcagagggagaggatgataaatgaaatagggggtggtggtgccgcgtggagctgagcagcacagtcacctgggagccaggagcagcgggaagctcctactcaaaccgcaatgtcaggaccacc

SEQ ID NO: 7139 - DNA, 285 bp, artificial
  synthetic oligonucleotide
agctataacatgttaacagatgacacaattaacaaataaataagataaattttaaaacagtaacttcaagttgtgataagttgggcccccaaagcctagaccctagagaagcaggtactcttgaattgacaccattttggggggcatcataataggtggcccacactgggggtgaggtgggcccagactgcacggtccagggagaagggagtatgtcccagctgtggccagataagtgtaaagccctagtgagccagaataatctggtatctcccaggttcttca

SEQ ID NO: 7140 - DNA, 752 bp, artificial
  synthetic oligonucleotide
gttaaagagcacatgaggtggatgatattgttgcagcccttcttgggaaatacagtctgccatgcatgacaatttcctaaagcttttgtctttgatgggtgggagcagtgggggtgggaggaattagggcccagggcatcctacagagctatctttgttagacaatgcttgttctgccctaatcatagcttgctggctgcaatggtataaacatttgtgtccccctaaaattcatttgttaatactaatccccagtgcaatagtattaagaaatactaataccaaaggcccagaggatgggcctttgggaaatgatcagttcatgagggctctgccctcatgggattagtgcccttataaaagaggcccaagggagcttatttgtcccttccaccatgtcctcacacatagaaggtgccatctatgacacagaggaccctcactagacactgaatctgctggtgcctcgatcttggactttccagcctccagaactgtgagcaataaatttctgttgtttataagccacccagtttatggtatttttttatggcaacctgaacagactaagacactggcccaagcccaagctgacggggacacacaaggaggaagagatgaatctaggaaaggtggttcttcacacaggcccatgggacagtgtcccagaggatggtgccagagagagctctgccacttactgactgtgtggcttggacaagtggcttgacacttgtgtgccttacgtctaa

SEQ ID NO: 7141 - DNA, 435 bp, artificial
  synthetic oligonucleotide
aggtccccactgcggcttgtctcctaggcaaccgactctgctgagaaacacgcagtaatgactctctagatttgcaggttaccaagcagttgcacatatatctttgtctcatttaattgtcccagtgggaattatccccattctacagatgaagccactgaggcctcaaggctcagagaggtagggtatcttctctcaggccaaggagatggcagagccaggcctggaacccagtggtcctaatccctagccaagtcttctctccaacacactttcctgcgttctagtctcatagctcccttaagagctatttctattgaatccagttcacaagtatttgcagagctcctctgtgaggtgggcaggtgtggcaggcttcaggtgaagttgcaggcatctctgggtttttgggtgggggaccctgagagaagtgtg

SEQ ID NO: 7142 - DNA, 3333 bp, artificial
  synthetic oligonucleotide
aagagcctttataaatctcctgtctttcctcattcttactcatgagagaaaactccagaaaacttcaatgaggataggggccagagggtagggaggagctgtgaggcaggcaggcaggcagtcttctgccctttgtgctcagagaatcacaaatccctcggcagaggaggaggaggaagggacccatctctgaggcaggggcctctgaggggcctgagaaggtgttcaggctttgaaggcttggaggctgcggtgtcctcggcctggaacacttgttccccgtgaaacctgaaagtccaccttctccctgacctctaagggcagctgcagcaggaagataattttctggggcagatttattatctcaaaggtcactagtaagcaccggtgagcccagctcctggaagacaggtcctcccgccgctctgcctgactcacttccatttctagtacattttgaggagagggagaattttccagaagcccgaattcttcctttagatctccctgagttccacatttccagctttcctgttcaggggccagggcctctctttcctccccctctccatctgcccaggaacttgcagaggtgaagcccagccccgacacccctgcagagcgcagccctgacacccctgcagagcgcagccccgagcaggagagaggagcaatggatttctcagcactggagaaagagcgaggcagacgcagggcaggagcacaggctggaggctcagaggacctcctcagggccctggctgcctctaacagcctctccctgtccctgactcccctcggaaaatgtgaccggccaggccctccggacaagcccccgacgcgcctcccccttcacaggctctcaggcggaggagatggaaagcagaccctcccgaatgtttaacttcagcggagatgataataactttcccatggacgcaactgtatcctttccctgtgttccttcggggatcccgaaactccatacggttctcatttgcagctcgttcctgaggaggcctcatttcctcgccacacacccctgatgtggtcagggtctccctcccacagcccgggcgggggcggggcgcgggtgggggagggagcttccctgagcttttctctaacgcctgcccccaccccactttgccagccctggcctccccgatccctcccttagcctctgccctttccctaccacggcccccagctccaacacctcaggcctttcagctcctgctctccacggccagggaccgcggtcagggctggggctgttccctaggcagaagtgtcctttctagaattttctagcacccagcccgatgggcatgtggaatgactccaggggtcaccattagcattgtatcctatgtgaatggcgcctcctggagttataagacgaatggttcccctgctaggtcctaaaaggagagtcgcttcccagcccctttccagccaggaaaagaccccagcggctttttcccacacctcaaccccctcttgccagccagctctgctccttaagctactcccaccgcacccctctcataactttgatttgcaggaagccaagaggagtccgaagaggaaagaaaaaacaggagactctcactttgcctagcactttggtttggttgatattaacactttcacatttactgtacctttcaagcttcaaaacacccctgtcgggggctttggggaggaggtttgttatcacatttgacaaaagaaatgagcaagcagagacccagagagcattagaggaagagcctgggtccattaggtcctgtttctgcccctccatttcagaggtcaggaggcaggaaaggaggaaacggaaggtgaagtctcctgctccagcatatgtcagctgtgtaaccgcgcatgagtcacgtaaccgctccgtgcctcggtctcttcatctgtaaaatgggcacgatgatagcatagctctgggttaataaaggggaagtattaagaacagtgccaggcatgaagtaaatgctattactgttcttgctgctgatattatgagatgtgaatgaaagatcacggaactctgcttctcttttcctctcagtccccagtctccaataccccagtcagagaacttggatgacaagtaaaccccgttgatggtgctgctgtcttctctgcatctggctgtcacttcagatctggccatcatgtttggttttccaggcctggttccagtgcattcgatccccctctccccgttgccagccggccagggtccgcctgggcctcaggggtcccagatttgccttcttggttgcccaaggtctcagtaacccacagagaagctcaggagcgaggcttgccctcaaaggccggcccttcagggcggttcttttgtctcaggctggacccaagataaatagatgtgattaggagatcaaagccttttccatgggtttggcctgagggggccctttgatcggccagccatcccttcactgccacccacatcacccccaccacccctgtgtcctctctgctcagaaacccttccctgctctccagctgccgcctctgctccccaagctgggccaggcaagccttgcctggtgaagggtagctgggtttcccccctccaggttgtttactaaatcaccagttcgaagccgaagccagcacgctgcagcaggtctgcgaaacccaaatggtttcattttgagcctcagttgcaaaacctgaaatcttgatatgcttgtaaatgatgggcggtgaatcacgctctctgggtatctaattagatacaggtcctgcccggtcgcctagaacttcacccagtaaagagagggatcattacgagcattctttctttttcctttgaaaagagtaggcattcccgtgtaagtgcttattgcggagaacctgtggaattttccttaattgctcagaatgtaccctctgccattgatgggctcctgttcaggctgtgcaggcaggcagctaagcccgaaactagaagggatgtatgtttattactgggcacattacaggacaggacacctccttgccatcaatacaggccatgggggtgttggctggcctgtccctggggctgtcgtccctctgtcttaacaccatagttctctgggccctgctcagggagttgacaatgtgcagggcaactgtgtgtctgcgaggggagaatttccttgtaagaacacagttgtctgggagatggaggaccgtttcaggagagaaactctagcggggagggacacccctgctctgagattccctcgggatgggggcagacaaatggggagctctggctgcttttatactttcatctcc

SEQ ID NO: 7143 - DNA, 552 bp, artificial
  synthetic oligonucleotide
taggaagcaatagctaacagcagacacttgtagttgctccacaatatcccttctcccccttttcctctttaaaagaaaggctgagttttctagctggttaaatggccacctaaaataaaaattacatttctcaactttccttgccactagatatagccatatgactaagttccagtcaatgagatgcaagtaagaatgggtatatgcaacttccagcgtagtatttattttggaggcctttatcttaccaatatatcagagtctagcactggaaagataagaataccatgaccatctttccttcctaccctacccaaatgagatatgggttgctttggagtctgttaggaaaaaaacaagagcaacagcaacccaaacactgtagtgtagacaggccatgaggatcaaaaggtcaatggagaaaaaaaggagctaaaaatgatacagtgagcaccaactgaaaagactatctttaacccactaacagtttctaacattttgagtaccttgaaaaataagtggtggtgaatcttctcattgaaaatgaattta

SEQ ID NO: 7144 - DNA, 865 bp, artificial
  synthetic oligonucleotide
aggcagaaaaggaagggaggaagggagggagggagggaggaaggaaggaaaagaggaaggaaggaaggaaaagaaggaggaagggagggagagaggaaaggaagaaggaaaggggcagaagctggcatgtgggggaaccccaggccccgcctggttctctttttctgtatgcagcctcaggtcgcttccttctgtggacctcaatttcctcttctgcaaaaagaaggcctggattagctcactccccaggcctcttctagccctgacagtgtgattttctaatttctttcagacttcaggggcctgcagaccccatgctaatgtgtatgaataaaacatggccatctgaaagctctgaatattgcaagtatttgctttggatgtgttctcccttaactgtgcgaagcagcgtccagctggggcccccgcagcctcctgtttggattgttcgcgtgtggcctgactccctgaggtggggaggggttgggggtgggggagggtccagcctcccgggtatgcgtgggccctcctccctccacctctcccataccctggccctgaggagggctttgttcttagacctcaaccccaaatccacctcaccagttccccttcgaggcggtgctccaggccctaatccccactgcaccgaggacatttcccttggccatctgccctggcaccttcacacttcacgtgtctgtccgtccaccctgggagacagcctgtcctccattgcagggctgcaccttccggcagccgaacgtctgtcccctgggactgtagccatatcctatgtatcttttgtgggagctcaacaaatgtaggctttttttttcccttaattttcaggttttttaaaaaa

SEQ ID NO: 7145 - DNA, 4048 bp, artificial
  synthetic oligonucleotide
ccttctgactcactttggccagtagtatattgcagaagtgatgccatgtcagttctaggcctagaccttaagaagggctggagtttcggcctttgtactctgagaagccagggcatgccataaggaaactaagcttaggctactgaaggatgacctgccatgtggagacagaagccatgtggaagaggatcagacatgtgagtgaagttttcctggcctagtcactagctaaatgtggctgcgcaaatgattccagccgatggcaggtagagcagaagatccactcagctaagccctgcttgaattcctgacccagggaattgtgagaaattataaatctttgttgtctaagctaagttttagggcattttcttaccccctatagacccttaaacattggatgatgcataatagtcctaccttcaggtctagatgttgcttcttctagtctggcaacctatgaaccaaacaaaacaagttatcagcaccctacaccttcagcctcaatccaatggtggagcaggggcaggataccacagcaaacgctagcgttctgaaaggggagggatgggagacatacagcagtcactagtccatagtcattctcagatcctactgtgaaggcctcatgccctgacggtgaagaagatttcttttttctttttatttttttgagacaggatctagctctgttgcccaggctggagtgcagtggcactatcatagctcactgcagccttcatctcctgggctcaagtgatcctcttaccttagcctcccaagaagctggaaccacagtcacgtgttaccaaacctggctaatttttttttttttttaagtagagagaaggtcttgctatgttacccaggctggtcttgaactcctaggctcaagcaatccacttacctcggcatcccaaaatgctgagattacaggcgtaagccaccacacccagctaagatttccttattagaccccaagttttctcctggaggagtttctttgttcattttctccccaagtcatggctctgccctctagttcttttttcctataatattttttggctatatctaaatggatactgaggaaatccctccttgagggtcatagaactttcttagtctactttttgaacatggtgggagcccaaggattattttatcttcatagctgactcaagaaagacttttttttgaggtctaggctcaaggtttctttggctatacaattcccctaaaaatgtaatgggccattgatgtatttgcttatagtcacttccacatgccaaagaccacatccaaagttcttttcaagatatagttttcatatctgctatatgtctttgctttctcatccgtataccttgccccctgcatttaatcaaagttacctttaggcttctggaaatttgggggaaggccatacccttagtctaatctttaccttaagtcatttttgccactcaaaggttttcccatcacttactatttgcaagtggaagcttgactgaatttttgtcactgtgtaacatggatcactattttaccaaccttttttttttctttttttgagatggagtctccctctgtcgttgcccaggttggggtgcagtggcatgatctccgctcactgcaacctctgcctcccgagttcaagcgattctcctgcctcagcctccctagtagctgagactagaggctcccgccaccacaccctgcaatttttttttttttttttttaagtagagacaggctttcaccatgttggtcaggctggtctcaaactcctggcctcaaatgatctgcccacctcggtctcccaaagtgctgggattacaggcgtgagttactgtgcctggccatctggcagcaatttttgtattagcctgggtaggatagactatgctgcagaaacaaattagcccccactgatgagttgggccactcctcagggcagcactcagccactaggtgaatctgggatcccaggtgcatctatcttaccatcttaatacatagcctctatggttgctgctgaaggtgacagtacagtgggaaggttgcacaagatgtttttaatggcaaggcctgggaggagtgctttatattatttcaacttacttcccattggccagaatccaatcacatgacctcagtctaactccaagggaggccgggaaaggtagtctttctgtgacccccagaaagaagaaaatgaaacaggatttggtgaacacacaggttatttctttcacacacccttttcaaagctctccattctcgttcatctgtccctgtcaagtgcctaatgcgccctcacttatcccctacatcagcagacctcttcagacttcatttgcactaaggaatataaatgactgataataatctaaaacgtgacccttagagatagttgcatgcaaaagcaaatgcaaggttttggctagcaggttaatgcagtgacagaattttaggcaggagcagacaaatagggaaaatatttgggtattcctgaaatgactgactgggcaggtcctatgtgtcatcgtttgtgccattttgccactgcctggggaccatttgtgtgagacactttggagtcaagagatatcaaactaacagtatgagtggccatgctattagatacgaccagaacattacagcatgattttcatctggctgtctagaggtattgatgtgaagtggggataaattattgtctactccaggaaatcagctttcaaatcgtccatctcccagcctttactccctccctccccactacagatgaaagaagcttaatccagagtgggtttgtcatgggcctggagagggagttggagttttccctgaggttctgagaagactggagtctcttgagtttctcactgtcagactctggctcatccatggctgtctttgctcttcctgtccctagtccaaggagaaagaacagagagcttattatgaccacctctttcatttgctgcactcatcccctaacacatactccagccctgtgatgcctgtgtgctgtggccactagttaagctagaactacatttcccagaattcagttctctgcatggttccaagttagagttggccacaggagacatttgtgtgagatttggaaggcagaggtgaagcagcggccactgtcacactctgcagctctgtgtgagccaggcgctgttgcagctcagatgtgttgttgctgatctcctggctctcctttttggcctggggaatcagccaggcctgtagcatcagccaggcctgtagctgcaacagctctttttggatcttcttcagcatctccagattctgggtgcatgtgcagtaattgcaaaggatgccagcttttcttgcaggttacccataccatcaaggttggagatggtcaaatgtggattccagctgtcacatgggttccagtttgtctttgcacctgtctacatacgttcatggtaggcggcccaggtggctgaggctgcagtgagccatgatcataccactgcactccggcctgggtgacagagtaaaaccccgtctcatcttaaaaaaaaaaaagacactgtggtttctgtcttggtctcattctctccctctctcttttctctgagatcacttgatgtggggaaaaccagctcctatatcaggaggagccctatggaaaggcccatgtggtgagaaactgaggcctttggccaatagccagcaaggaactgaaacctcctgtcaatagctatgtgaggaagccatcttggaagcagaccctcccgccccagtcaaacctgcagataaccacaggccccagctggcactttgactggaacctcatgagaaagcctgagtcagaaccatccagccaggttgctcctggattcctgacccacagatgctatgtgagataataaatgttcattgtgtcaagttgaaaaatttgggggtaatttgttacacagcagtaggtagctacaactgtgtccatcctttcatctcaactgctgttcctgcttcaagtccaccatcagacacaggt

SEQ ID NO: 7146 - DNA, 819 bp, artificial
  synthetic oligonucleotide
agacccagctgctccttaacaggtaacatctcagtttgaccatttgttcatccaacaccaccacaataataaccgtagctactacttatatagcacatgctatgtaccagttcctgttctaaaggctttacattgataaacttatttaaccttcacaataaccctgtccgctattattatcctcgttttacagataggaaaactgaggctcagagagtttaaatgacttgccgaaggtcacacagctagttaagtggcagagctggaattcaaattcaggcagatggttccagaatctgtgctttcacccattctgctatcttacctctcattccttgatgctgtgtgtcaagctccactagagttgcttaggatattgagatgcataagcctatctatgacagagactgttccccagtatactacatccccttctaacataatactcaaaccctgattttcaggtgggcacatggccacttagaagaaagattacatttcccagcctcctttgcaggtaggcatagacatgtaattaagttcaggctattggattacaagtggaagtgacaatgtggctgcttccaagaaccttccttaagagatggctgatatttgaccattgcctcctttagttttcatcttttgctgcctggaatgtagatgtgatggctggagctctagccactatcatgaaccatgagaacaagggcttcaccttcatcaatgttgggatctggaatggtaggctgaaaggagcctgggtctctgagatcttcttagaacaacagccatttccatgctgaactgtttatctct

SEQ ID NO: 7147 - DNA, 2128 bp, artificial
  synthetic oligonucleotide
tctggatgcaacaatccctttttgccaccattttacccagtctgaaactttctcttctagcacaatgtgcccataactataggaacggtattcttgaatcctaagtgggccacatggtctctgtaagaattaataaacttatgcacacagctggacaaaatctttgaacttgagactggccacaggacagcaagggcccttggtggtcctgccctaacagtgtctctgacttgccagtgacctcgtgtagctgctgtgtctgtcccatttgaaaccctctctgtcatgccctccctgttccctcagaaaaggagatagtggtggtggaaatgcggctcctgataaacagataagcagattaggactggcagaaattaggcccctcaaagcaaccaggctgaagataaaagagaaatttaatgaaaattgaaaatacaatccatattacatagccattaaaaatgatgtttaccaggaatttgtaatagcatggaaaatgcttgtatcaccacattgagcaagaaaagagcaaattaccaaattgcatgtacagttgatcacaattatattttaaaagatgtatagtgaaaagactggagctaaatacaccgtcatgctggcaatgactgactttcagtgggaggaggagcctccccccactgttccgtactttaatctatatatttccaaatattttctagaatgagtgcatacatctaatttaaattaatctttaaacttagaaaaatagaacgttggaacttgcttttaaaaatacaatttggagcaccggtgctatatgtgtaaatgatcaaatatttattcagcacctatcatggtcctcagaatcctttgcataataaaaccatcactgccaacctctcccctctccccccatagcaaagcctccccagtctctctccccgcaatacacacatacaccatcgtctgtgtgctgcatttgtgactaagtgcctcaccgaatacctgaggcaagctcaaggatctggcacagacatcattgacaagtcagcttccttttggcacttttgccaagacaggcactctataacaaatgaatgcctgggcctcaaaggtccccagttaaaaccctggtctctccaatctcatctctcacatgaagtcgcgggctccctgtgactctggctcatcctccccccattccagcccagcccccggagctcatcaaacatctctccttttgtatctggtggcccactctttcaccgccagcttgtcctgattgacagagtccacctgtcaatcacaggccctgctcagccgcctttgaggagttaatgcgggggcccctcggccctgcctgatggagttaatgcctgccttccctgacatgggcattcttcccctcggggctaagacctctcccagcctccccaccatgccctaggagtgtcctgcaggcctttcacaatgcctggccgccttcattagccctgggggtcttctgggcccctttccagtgcaaggcgccattcacactgatccccgccccccaaattcagtattaggccacctgacccctgtcggcagcaatttctgtgacacagctcagtgtgggaaaggccagtgacaccctttctagaccgatcaggccccacacggcctcctttgaccccacccatctcctgctgcccctccctactgcagggacaggagtgtgggtgggatggcacaggggctggtgacagaagcatgctgggcctggagtgtacaccctgctggggactgctcttcaattttgggtccccatagaggattccagaaagggctctcgcaacacttatgaaccacaaaagcagtgaaagtcaataaaagagaagtaggctttgtgtggaatctatgacagtggagagccgtggagctgagcccctgttagacaacaggaaagaggaggcagagcacagtcacagagcaagagaatgagagtgacagcaacagagagactgtctccatagagagacccaggtggttttggctgacttagctcaagaagtcattcactgtcccttgcactgcgttctattggttacaagtgggtcagtaggccatctcagattccaggggagaggacacagatgacacctct

SEQ ID NO: 7148 - DNA, 800 bp, artificial
  synthetic oligonucleotide
gccctttctcctttcaataagctcagcagagtcccggcctttgtctgggcccctactcccagggcagatctcataaagggcctcaaactgctggcaggggctaaggacagggtagtgtgagttgtcctcacaatggcagggtgaggaggttaaagcccggcatcagctgcccagaatctcatccctgaggcttttcctgcttttgttattcctgatcataggcctgatatgtgatttgatttgggcctctttgcagttaattgaagaagaaattcaggtggaggatggctaggctggatttggccaaggttacaatgtagtagtgagcccggagtggtgtgggagaagtagggccaaaacaagggaggtgtgcagtctctgggctttcagactcccagaattatgggctccatggagctcctcaatgtgtattttagatccccactatttggggcaagagacaaactgctcatcttgtagacaactcttgtatggcaggtctgatagggttttgagggaatgatcttgccatgcaatgacactgctgggggactgaggagccttcactcctagactctccaggaattgtgcattaatgctccaaaactgcatatcccccaaaacaggaggagggtagataaattgcagtgtaatcacacaatggaatactacacagcaataaaaagaacaaaccactgaaacctctgtaacagaaatgaatcttatggacatcaggttgagtgaaagaagccagacacaaaagagtaactattggattccatttgtatgaagttcaagaa

SEQ ID NO: 7149 - DNA, 1083 bp, artificial
  synthetic oligonucleotide
tattgcttctctctccccagcattcgtatcacacctggcatcctgagcctgcacagtgccactgaactgttcctagaaaggaatgttaactatgctagtatggtgtagtcagaggaggagagagtggatgtgagcatatggtcttctgagctaaagccagacgacaagaaacagtaaatgctgcagctgggtggattcctgggcccctgcagctgctgagagcatgtgaggacttgcgagaaggaggaggagtcacaggcaggagccaattagattctctgtctttccctctgtttacaacttgcatacatcagtagtctccaggcgcaaagtcaaatgccaggaaagtacacatttccccggcccctcctcctccccacaccccaagccttctgtggcagacgtggggttgagctgctccgatccccttcaggagcacatctgctgtgcaacttctccgagtgttgtgagcagacagcctcagggcccacctcaacctttcccacgtgttccccggcaagcggctgagcaaggcgggtggtactcagggccagccctttctgaattagacagggttcctctgatgagcacctttgctcggaactcccgctgggctagcagagacttttcagatctgcactgccacctgatggctctccctgccccgtccttcttcctcccctcctccttccgcggtgctacttccaacaaacccttggccctccttactccacctcagcacctgcttccatgagaaatcaacctgtcacaccctccccagaggtcaaaactgttcatcgtgggtgtacgttcttccagatagtcttttctttgtatttatatacatgtaggtacgtatgccaccaaaaggtttgttattactcattttgtttttacataaatgggattatacggtgtgaatggctctacaacttttaaaatttaacacatcttcatgagcagtcagtatcggtgcacataggtatgtcttttttgtatttgctgtagagtattccacagtatggctagcccattatttaaccattcttatactgatggacatttgggttgtttcccttttct

SEQ ID NO: 7150 - DNA, 1979 bp, artificial
  synthetic oligonucleotide
gtcagaattcaggcagggctcggctgggcggttcttttgttccttatatggtatctgctgagaacactcagcagtatttgctagcagcctggttggtctagagggtccaagatgggctgtgtctagtgcctcggccagaaaggttaaaaggctgggctcgctgggccactctcccatatcatatgatctcagggcctctccatgtgatgtctctagtaggtgagtcagacatcttatgtggcagttctaagagtgagtgttccaagaaacaggaagcgtaagctgccagggtcttaaggcctgggcaccaaaattggcacagcatcacttctgccatattctgtttgtcaaagaagtcacagaacccacccagatttaaaggaagagatctagacttccaggagtgtgaaagcattggtggccatctttaatccgccacatctcctttctgctgggaattgggagaaatgctgtggaattaaaaataaaataacatgaacactgccattttgttccctttttatttctgctgggttcagtccatatctgggggtaaactttccctaagctacaggaaaaactttgacattgcaatgagtgtgtgtgtgtgtgtgttggccaagtgggtcagagggtggttgggggtggagtaggagatagaaactgatcagggcagagttgctctcaagagataatattgggtgggggttaagatccaggagaaaagaaactgcagcgtacaagactggggccaggctaggtaggtggaggcagagaggaaagctctgttggcagttgtcaggggagggaattaccttgaggatgccttagtctgggttccccctacaagcagaccctaaaacaaagatttgagagcaggtagtttgttggggaggtgatcccgggaggcatgatgaggggctggggaagtgagacagggaagggagagaaaccaatcaagggtgtgctaaggaacaggtaggcaacagggctcaatcctgctagggccccctgtgtggaacatgccccataccctggggttgttgactgaagagcccggaactaggctgtttatgcatcaactcccctccatctgtgatcaagagttgttcttaggatgttaaccccccagcaccagtgacctactctgccacagtgaccatcccaggaaacagtcattgtgtctgttttggtggcctccagcattggcgaagggagcttgggcagtgccctgatgaaactctttattccctttacagtgagatatacacagggtctctgccttgcacacctccaggggcgattgtcacgctgtatcttaagtgagagttaccccctggcaacgtaaaactcagcagcctggatatttggatgtaactccttcctccatcttcccacaaattcttcattacaacctgcatggcccatgaatgctttaggaatgagcagattctctttggggtgtgtgaagaatgctgagtcctaagctaaggtcagctctgagctaaaacacttaggcagggacaactagtacatgtggtccccttatctgtcttcttgcaacagagagagtctgggaataagagaaagagagcaccttcagaaccatgagaccagccttggggactttgtcttgtgtcttctaagacttcagaaacacaggagttcactgagaacagatcaaattagcaagttcattcacccttcgtggctccattttgtcagccagcccctaagcggacctatcttgtccaccctggcgctccccgcctctgctctccagccatgtgggtagcacaaagggtactgcctgtgaagttctgcagcccagtttggagactttccctgacattccttatttgtgtgacctgaaggaaatcacttgacacctctgagtttccgttccctcatctaagattatctctcaggcctcttggactctggcagtctgtgattttgtgattctatgaagaatgaga

SEQ ID NO: 7151 - DNA, 1405 bp, artificial
  synthetic oligonucleotide
tgattgggctagaagggtaaagctctgcctctgaattgggatggcatcccccttcttgaggctggacatctgaattcgattcgggttcctttagcagtgtggaggttgaggaggccatcaatcccatctgcttcacagggttataccaccggcccctccaaaatcacaggctccttatgctggattcagatccactgcaaaacctggcatgggcatctcgtttttgctcccttgcttctttttgcaactgtaactgctttatgctttttatgaaatttatccttataatctctgcaaagtacgaaatgacgaccatttggtttggttaggcccatttcacggatggacaaactgaatgctgttaaatgagtcatttgggagagcctaggatatggttaatcgaggaggccttgtgacagacaagcagatcctactcagctgcctgcctttctccctccctcttactcacacccacctctcctttggcttaattgataggcaaattattgagtattcagccaggctgggggccaggaggctgtttatagcctgcagatcttgccttttctacctggatgagtctgccagcagccatcagataatcgggctcttccagtgacaagggcatgatggatttcccccattacttgatatcaatgcttttgttagtttgcattttatgcagtgcctttcctctcagcaactcaaggccttttgcagagtcttatgtaatggaaaatagttctgcaaggtaggcagaccaggcaaggccagaatacagaaaccgcattccttacacacatgcgcagcaaccctgctggggcccatctgcgttggggtgcgacattcacagcactttgagatgataagagagtacagacccagacgaagtgggacacaattgcctttgctgagctccaaggaggcccctctctctgtgcttgggccactggcttttaaataggaaagggaggggctttaagaaagagagagatcttggtcaaaacaaaacaaaaacaaagaaagaaagagagagagaggtaagggagggaggaatggggtaactatccaaaaaagtcagtaaggacaagaaagcgtgctcaacaacattggtcatctgggaaatggaaattcaaaccaccacgaaatgacactaccccaccagcatgactaagacagcacaacaaaacaaataactggtaatataagtattggtaaggatgtggagtaacaggaacttcatagcctactgatgggtgtgtaacttggcagagccacagtggagaattgttcagtaacctccgaagctgaacggcttgctccatgacccagcagttctactcctaggtaaatgcccacagataagcacatatattcccccagagacctgtgaaatggtgctcat

SEQ ID NO: 7152 - DNA, 952 bp, artificial
  synthetic oligonucleotide
aaggtgaagggctctggagctcagtgtggaggtgaccaaagtagaacagaggacaagcctgggtgagtggctcaagccaggagatcctttttgcagtgaggggctggcatacctgaaaatcctctgagattctctccagaggtccctggacatttttgggggtgtggggggatctctgtgtgctcagactgactatagcagaaggaccttacccccaggtagctgtcttcaagaagagctcctcatgggcccatccaacatgctcgtgtcctattgctatgtttatgccgtagatggttgtttttcaagcaaaagtccccagttcgcagatgaaaaacaacttgttttgagagcacgcattcctgagatcttcaggctcttcctttgggctgactgttgagaagaaattaattttgagggtgggaggaattggtgaggaggttgggaacagatccatggtgagcgcagggagtgttttctctaatttggtttctctgcccactcatgaacgcttacagtgtttacctgatcatcagtctgctcagaaaacaaattttaaaagcatacttttttgttctcaagttattttctgctcactggctgtctactggatcttgccttaagatgcagagaaagatgccccagaccttgctctgggggattgaaatatcagagcaatgagaagaaaaggtctagaagcagcaatggcgacaaccacccagaaagtcaatgttactggcagagagtagggaagggattcttctttcgctgtctttccttttttttcctctttctcttgctttccctttttatcttctttgttttcgcttgtcattgggggtggggagcagaggcagaaacgccacatgtgtcctcagtaaaactttccagaaggagagagatctgtgaagtttcaaaagagaagaatgaccattttgttgactttgttttc

SEQ ID NO: 7153 - DNA, 2122 bp, artificial
  synthetic oligonucleotide
ttcacactgagggcatgaagaggacaggatggggattctgggagggtatcacaggaatggaggctaaagtgggaatagatttgcagagccccaggagggactgtcccaggtgacctccaggtgaccttccatgtgtctggtggaatagggtggggaggggagccttgtgagcactgcccgcaatcctggcttcccacccctgaaagccctggccacgcttcaccatggcagcgaggacccttcacaggccagcagctcaacaggcaagtggcagggctgggtgtcaggaggcagagagcaccccggataggcagctccatttcacctggagctggtctggtttgcagggggccagccatggaggtattcaggaaggagatgtactgactggaggagggagaggagggctgagaacatgcccagggcccaggttcttctttactttagtggaacaatcgatctgcacaagcttcctggagagcaattcagccacgagtcaaaggcttccaaggtgacccagcaattgtagaaagtcattgtaatgaaatagctgacacaggtgagttcatcacagtgttgtttgcataatactgagcaccttccctaaatgaaccatagggggtacatttaataagttacagtatatgcatacaacagaacactgggcagccagtcacagattcatgtggatcgaattttatttagaaaaatacaagtcattgttaagtgaatgaagcagtttctgaattagttcacatgacatttctaattttgtttaaataaatatgttgatatgtatatatctgcataggtgaaaatctgatcagatgtataccaacacgtggcaaggatggttaactctcagtaggtagaactttcaatggtttcaattatcactatcttgcttatcactgttgttgagttggggtggggtttttttccatttaaagaaatatagttgactgggcatggtggctcatgccgtagtcccagcactttgggaagccaaggcaggtgcatcgtttgaaccccggagttcaagaccagcctgggcaaacatggtgaaaactttgtctctacaaaaaatacaaaaaaattagccaggtgtggtggcacgcgcctgtggtcccagcttactctcaaggctgaggtgggaggatcacttgagtctgggaggtggaggttgcagtgaaccaagatcgcaccactgcaccccagcctgggcaacagagcgagaaaagaaaagaaatatagttaacatgtaccgctttcgtaattttaaaaggcaagggtcaaggcaggaggagggggatcactcaagcccaggagttcaagatgagcctggacaacacagggtgaccccatctctacaaaaaaaaaaaaaaaattaaaaagtggtgctgtggcgtgcacctgtaatcccagctacttgggaggctgagctgggaggattgtttgagcctggaaagtcgaggctgcagtgaggtatgatcacgtcactgcactccagcctgggcaatagagtgagatcctgtctctaaacatacatacatacataaatacaagcatacatacatacatacaaacatacatacataaaagcgagggtttctttgctcatattttctcacccataatggaacttagactcttttatttgggcctacatgaggttcactgggagaaacaccaccatatagaatcctgagagcactggcttgacagagtgtctggtcagggcggcccacaggagccatgagacagaatcccagttgtagtgaaggagggtcattgtagtcaccattgtctgaggggcaaggccaggccaataaacacagagggaggcccaagggcagaaggcaggggatggaaggaatcaaaaccattcagggaaggggcagggcagggcacctcgggctgtgattgtcttcaccgagaggccagaggtctccattgttgtgcccaggcggcctggggagctggcaccttaaaacagccacgcaggcctgggcacaaagagatgctcagtgatatttgaacttggcattctctgtaactccagagtacgaaaaagaagttaacatccggaatcttccagtggagggaagctgttcagaacaca

SEQ ID NO: 7154 - DNA, 1072 bp, artificial
  synthetic oligonucleotide
gatcctgtagtatggatgtgctacactttaacagtgctgctgtacacatcctgttgtgcacacccttgtgcccaggtgcacagttctgttaaatagaaagatatgaacaggttgatgcctctatatatgatgctacattgccttaaagccctctctagggctttaaaaagttttcggaaccgtatctttaacagagcggacaaatccagtaagatgacagttcgtataccatcatccataccttacacatccttgtatttatatctacttcagtggctggcacatggtggacccttgataaaagcttcttggatagataggcagaaactaactagacacaggtataaaatggaagcgttcataacccaaagttcctaaaattagaagtcagatcttaaattggttagtgaatcaagattccatttgatcccaagttttgtacctcacatctagaagctctgaaatatttcactaagtttcctcgtttggaagagttgtgagatgaatgaaatttctttctttactgttgaagttttctcaaggaatttcatgaaataaagggagaaagaaaatgtaagactaaagactaaatactacctggacagattaaaggaggaagttacaggcacatttgcactcatctgggctttacaaagtgatattaagtgcattttaatgtaaaaatatacaccaaataaacccctgccctccacccattctacagatgacatccttggtgggcggctggataggcacacatcttcactgggcttggaatggagcctttcctgcaggcagtgaggaacatggcaattctgttcctgaaggtccacaggcaacttgacccagttaagtaccactggccttggaaacaagtagatgcggggaaaggcgaaagtgaggccgactccacggaccactgcctatgatggggcagtcattgcgcagtttgggaaaccagcaggaggaactcaggagtggatgactttaggggtaaaaggtatagaagaagcatgaacgaatgtgtgaatttgttgaaagaaaatgatgtctttgaatttccacaagaatg

SEQ ID NO: 7155 - DNA, 735 bp, artificial
  synthetic oligonucleotide
agaaaaacaaccccaatgttcaacaatgatgaatggataaacaaaagatggtatagccatacaatggattatttgacaataaaagtgaatgaagtattgaaacatgctgtgaacctcaaaaaaaatgtgttaaaaacagtatgtaagagaccacacattatgattccatttatatgaaatgtccaaataggcaaatctatagagttagaaagtagattaatgattgccaaaagggaggcaggaagggagaggagtgaatgggttgtgactgctaatgggtacacggtttctttctgggatgattaaaatgttctaaaatcaaattgtggtgatagttgcacaactctttcagtaaaaaccattgaatgaggtaattatatgtgaattatatctcaataaagctgttaagaaaaaaagacgaaaaggcagtggtggttagtagcctttctaattccagtgagagtttcaattatactttccaatcataatttttaggtctgtatttaacatctttgcttgagggattaaaggggagggccttctactgaagcttttaattaaattaagataatgaagtactgataaagctaatgttaaaccctgatagggctaatggacaggcacccccaagacacatctaaccaatacattcaccaaatttctggcagatcctttatttcttttttaaggcccatatttgcatttttgttaagttaggctgcccctctccttagt

SEQ ID NO: 7156 - DNA, 2258 bp, artificial
  synthetic oligonucleotide
cagccaagaaatcaagagagttctgttgggaactcggacaaaaatttcacacaattttcagtggaagtgtaacaacacgcaaaattaacaagtctctgttgcatcgttgccaggaagaccccagatacaaagcttcttctccacctctgctgaaccccaggagttcaaaaattctagactaagcagtccagcggagaacacagcagcctctcggggagagggaggtgcaaacgtctcagccggttgggcgggaaggggggctggggaacaggcaggggtttcggggcacttacaggtccgtcaacaccataagctccgagtaggcccggtgcagcagaaattcaatgagggtgctcagccggtagcccgggctagccgcagctgcagcggccgccgccacggcggctcccgggggaggaggggctggggctgacgggggtccgccgctgcccccgccgccgcctccgggcgggaccagctggtggttctccagctgcactggggccatggcggcgcaggaccgggcttggcgcaacggcacacgatgcggtcctcgagcctcccgggcgctcggtcaccgcgccgaaacgggagcgggcagagtcgccaccgcctaccgccgggccgcctcagaacaggaagccgtgcgccgaccgcggaagcccgcccccatgtagcgagaagtccgccgaccccagggacaggagcgaggggcggggggaggcggggatgggggggaagcagggcggccccgcagaggggaagctgcgcctccgcaaacgctcagaagcagcttcgccagacagccgcaacgtacatgttgactgcccgaggcggaagtcgatcggcagagcggaagggggacctgcagaggaccttccgacaggtctgtgtctgttctctcagctgtctagcaccgcagcgctggggggcgcgtgggagtgaggcggtacctgtgagcgcgcgggagagcggaaaagggagccgcgcgccgccggaaaccagggtgagggctgagccggagtcgtcaccgggaacgtcagcagttgccccgcccttaccctcgccgctctccctcccgcctccgccccctggcgttgtaaaggcgacaatttgcccagagaaatccaccatcgcttcctaagtggggcacaaacacagccaggggaggcctcctctaaatgttcgtgaattctggttctggaatcgcgaagaaatgggagcggccgcgcgcttgtgattctcaggcctttgctcctcccatacacgtccacggcgcgttacgtgggagaacgttttcgcccctttttttttttttccaaactgtgggaaaaggtgctagaaaatatgattgcgggtagagacagggccgctggcagagtaactcaattttaatagagtcgggtgtatgctgaggtcgtcaccatcccccaaatcctgtcagtcccacacaaaaacggcccttaaatcccctgccacgggctctcatatagtttttgtccttgctcttgcagtcaccgctctattctgaagggcttttcagttcatccatgcctaccgacactcccgtcccccccatcaaagtccacgtttaattttttgtacctgctttaaaacagcgattctcaaccttggctgcactttgcaattatctgaggagctgttttttaaaaaaatacttagatatatgggttccacccctgtagattcagatttaattggtctggcttgaggtctgggcttggggaatttttgaactttcctaaggtgattctaacatgccctaacgtagagattcactattagaagcattcgttgctgcgacccctttcaaacatctttttgcagtttcatctcctcttggtgtaagagatgttcatgatgttccctaaggttagaatattcttactgtcatcacttgggtaattctttatcattgttgaaagcggttcatctgcttctgaaggtgtaagctcacttgttccctcccttggtggtcctaaagcacattgaaacagaatatcattgtgctagttattaaaatgcattgggattatttataccccttacagatacagttgctggaaggcagctaccttatttttaaatattatttttatttttaattgatagtatatacttatggcatacaatgtgatgttttgaaacatgtaaccattgtggaatgagcaaatcaggctattaacatctatcaaatgatatacatacttacttcttttggtgagaacatttaaaat

SEQ ID NO: 7157 - DNA, 456 bp, artificial
  synthetic oligonucleotide
agattggggataggacctatagtcttagtttaattttggacacacttgtttcctaaaagtatactacaaagtctgattataaaatcttctgttagtatttgtctgggttacagtgttcatatgtgtgatcttcagagtcttaaatgatattattcagtcactgtcacataaattgactcaaaagttcatcttacagtgaaagaaacatgaaggattgactttaatccaactatccgaatagccttcctatcaatggaactcagacagtggcgcagatctggatttcacaaaataatgtcctgtggtccgaattttatagcccttggccaaaagaaaggactaagaaagtacaacctagctcagagtgagaaagtgttacagaaatctgtccagccattcattagactggaataatacacagataaagtcagctacacagttcagtatcaggggatg

SEQ ID NO: 7158 - DNA, 582 bp, artificial
  synthetic oligonucleotide
aaatatgcagataaatctaaatagacattgactattaaaaaaaaactaagaaaatggaaaaaagcaagaaaaatggcaataatgattgagtatatttttaaaagatggagttaaaatattagcaataacatgaaaaattggaaggagaaattggaggtagagtatttcaaggtccatgcgttagtcagggggacagtaaagatatagattaactttattttatttttattattttttttttttggagtcaaggtcccactgtgtcacccaggctggaatgcagtggcactatcacggctcactgcagtctcaacctccggggctcaaacaatcctcctgcctcagcctttcaagtagctgggactacaggcatgcaccagcacatgccactaatttttttgtattttttgcagagacgggggtctcactatgttgcccaggctggtctctcaaattcctgggctcaagcaatcctctggccccagcctcccaaagtgccgggattacaggtgtgagccaccaagcccggccaatatagattaactttagatttcaaaccaagtatgccaaatttaagagaaa

SEQ ID NO: 7159 - DNA, 915 bp, artificial
  synthetic oligonucleotide
aaaggccacatacaagagattaagaaacagagacacttcaaattttgatgtgttacaatacctaaggcttagcacaaaacttccatgggtttccacgtaaagaccaaaataaaattaaggtcctttccttgtcttagcatctatttgcattgtaaattttagcttgggctattcaaatgaaattcttcttgtgcagttggtctttctctttctgcagctcttttaacattttcattgaacacacctactttccattctctctacaagtcacgagcctttgcttctgtcattctaagtgattttcttctggagcatacataagtaattttaaacagtggccctggaaacggcttttactgtgagaaaaaacttctaaggtgatatgtaagtaggtttagctggagtccacccacatccccacagagctaaatccccctgttacagtagaaaggaggacttcagaaagagaaataaactgcagaaatttcaaactaaaagggactttagaaaacatttaacacaatttttcctaaatattgcaccaccaagcacctgcccagcccacacttgcacagtagccctcattatgttgcaatatggttggtagtgtgcctatcttgtctgctaccttctgagattgtgaaaagagggatcaagtcttactcatctgaacccccagcaccatacttgatacatagtaggtagtgagtaaatgtctgataaatgagtgaaaatgctttgggacttgtaacaatctatttctaaaagatccattaataaaagatcagagtgaggtctttatgtcccatcatttttgctttccaggggttgtctttgttctctgttatggttttacacttcctggggctcagtttctgtaacatgtggctgacattttaagtggcatttaaaatg

SEQ ID NO: 7160 - DNA, 1000 bp, artificial
  synthetic oligonucleotide
accatcattaatactagcgtctcatttcctgtgggtggcgtgggctctggtggtgtgcttaggaaccagtcattcatatagaactgaagaaaatctgttctgaattctaagacagattttccaacaaacttttggatcaataccaagttttaagttgtcagttccctataaagccctaggggtgcctagcttagctaaagggaaagaattcaaggtttctgtgggtgaagtaagacagggaacttcaggggaactccagaaagaatttcctgggaaataaaattgcatcacggctcacctgcctgagctgcttagagtgttcatgcttctactaaagaagccttcttctctctgcagccccacattttaaatacgaacagtataataacaaactccaccaagaagagctgatcattcaccacacaatgtgatttctaattgcttgaataataccgtatgatggaataatttcctacccagtaaaaatgatttctttttttttcagagtgataatatcctgttaaaatataatgccattctagacagtgactacacaatggagtggttttttttttttcctatatataacctttaaatgctaagcattaggatcaaggcagtagcaagtgataaaacaagttcccagatgaagaaaagaattctttgggtctatgttggaatctaattacccaacatccttgggtaaaatagtgagttgacaaatttatgatacatagatggtctttgctctgtttcttcagagaaactcagttgcacaagaatggaaatggatttttccataaagctggtgtgcagtataacatctatatttggacaggcacacacacaccatgttgctaattttaatgcgccaattaaatcctcattttgtgcatcactgaacccataaaagcagattttttttctttagaaaatgaaattgcaagacatttgttgtctagtgacctactgtgccaataggtatgtagagcatgaggtg

SEQ ID NO: 7161 - DNA, 2204 bp, artificial
  synthetic oligonucleotide
taatttgcaaagcccattaatttcctaaagactacaggagtgctgaagtgaagaaacttgcttaattttgtttaacctaagtgtatctgacccccaattctcataaccccagttgatatctcaaaggccactagagtccatgtaacccaggtaagaagtgctgttcacaggagactttggtatttttctctatcataatgtatcatagaaagggtattacagggctgggcaccgtggctcacaccagtaatcccagtactttgggaggccgaggcaggaggatcacttgaggtcaagagttcgagaccagcctggccaacatggtgaaaccccatttctactaaaaatacaaaaattatctgggagtggtggtgggcatgggtaatcccagctacttgggaggctgaagcaagaagcaagagaatcacttgaacccgggaggcagagtttgctgtgagctgagatcgcaccatggcactcaagcctgggcaacagagtgagactctgaaggagagagagagagagagagagagagaaaggaaggagaggagaggggaggagaggagaggaaaggaaaggaaaagaaagtctattacagtattacactggtgttcaaagcaagtgtgccttctcagaaaaacaattagatccttaaccttgaatatgaaatgaaacttcttgtcttagcttggattctcctagaagcagaccacaagacaaaaatatgagcacaaatttggggagtacggagggagatgctctcaggaaataccgtaagaaagtgggaaaatgagacaagaaagagaagggaagcttaaaagggcgagttatgggccgggcagatcacgaggtcaggagattgagaccatccaggctaacacggtgaaaccccgtctctactaaaaatacaaaaattagctgggcatggtggcaggcgcctgtagtcccagctactcgggaggctgaggcaggagaatggcgtgaacccgggaggcggagcttgcagtgagccgagatcgcaccactgcactccagcctgggcgacagagcgagactccatctcttaaaaaaaaaaagggtgagttatgaaacatgttacagttatgggcaaccgaggcaccatcccactggagagctctgtgagaaagtgtagactgcactttggggtttagtcgtacatcacacacacacgcgcgcacgcgcgcgcacacacacacacacacacacacacacacacacggtatttatcctaaactcttttccatctttggctgagggctgctgccaggggtgttcactctctggcacttcctgcctgccctgcccgcagctgagcgccagtgcacaggcagactcacaggtgcttgcggttggaggccttagtcttgtactggaagagtgagtgccaagggaatgtgagtaggtcaaggtcaatgtctgtcacatgtttgaatttttttttttttcttttgagatggagtctcactctgtcgcccaggctggaatgcagtggcgcgatctcagctcactgcaccctccacctcctgggttcaagcaattctcccgcctcagcctcccgagtagctaggactacaggggcccgccgtgatgcccaactaatttttgtatttttcgtaaagacggggtttcaccatgttggccaggctggtctcaaactcctgggctcaaaccatctgcccgcctcggcctccaaagtgctgggattacaggtgtgagccactgtgcctggcctctctgaattctaaacatgtcttttctactttcttctgtgctccagtgtagttaaatatacaaccctgctggtaaattatttttgaagatactaaaacaagctatttttttacttctatttttttttaagttcagaagacccctgagaatgaccaagtgggctgcagtaagatggggcatgctgggaagtactggcacctcaaaccaccttcccctcggcctctggaataacactgatgctagtgagacaggcacagctgcagatacatgggtcacagacccagcttctgagctgagagcagtccaatatagcagacagcccgtggcatctgacatatatggcaaaggcagctgactgaccgtgggacacaggcagcattaggagggccaaagatggatgaacagaattccctaaaggtgctcagagcatctgatggaaatccaggcttaag

SEQ ID NO: 7162 - DNA, 1845 bp, artificial
  synthetic oligonucleotide
gcgtggctagacagcattttgtttatccattcatccgtggatggatatttgggttatttccatcttttggctattatgaataatgctgccctgaacatctgcatacaagtctttgtgtggacatatgttttggcctctcttaagtagatacctaggagtagaatttctgggtcatatagtaaatttatgcttaactttttaagaaactgccagactgttttccaaattcattataccattttgtcataccacccagcaatacgtgaggctttccatttctccacatttatacatttatgccagcatttgttactgtctgtcttttttgattctagctagcataatgaacgcgaagtatctcattgtagttttgatttgcatttgcctaatgacgatgacgttaaacatctttttttgttttttttgagacggaattttgctcttgttgcccaggctggagtgcaatggtgcaatcttggctcaatgcaacctctgcctcccaggttcaagcgattctcctgcctcagcctcccgagtagctgggattacaggtgtgtgccaccacgcctggctaatttttgtattttcaatagagatggggtttcaccatattggccaggctggtctcgaacttctgacctcaggtgatctgcccgcctctgcctcccaaagtgctgggattacaggcgtgagccactgtgcccggccgatgttaaacatcttttcatgtgcattagccatttgtatgtcctctttggtgaaatgactattcaaatattttgctcatttttaattgactagtttttttttttttgagatggagtctcgctctgtcccccaggctggagtgcagtggctcaatctccgctcacagcaagctccgcctcctgggttcatgccattctcctgccttagcctcccgagtagctgggatcacaggtgcccgccaccacgcctggctaattttttgtatttttattagagacagggttcaccatgttagccaggatggtcttgatctcctgacctcgtgatctgcctgcctcggcctcccaaagtgctgggattacaggtgagagccagacttgtttgtatttttaatattgagttgtaaaagttctttatttccaatcgaaatgtaatataaatctatgcaatctttctggagtacaatgtggcttcaaatgtttcaaatgccctagaattgtgtaattgtgtgtgtgtgtgtgtgtgtgtgtgtccctttaggcagggcactgtgatgcactacccagattccccttcagtgaaggacttcttgcccaactccaagagtgtggtcagcagacagccctcagctgtcatcccctccaggtctgcctcagctgcagagggcagcccatgcccactgactgatcaaggcaagggtctaaaggtctggacatttccactcagccctggacagctctgaaaggctgttctaacaccagagttccctgtagggtcagctgagtccatcaggcctgcatcaaagcttggcttctctctctacccaatcctgcttcatcctcctaccttccacaggtgttgatcccaagagcacttcttagtgaacatcctacacactaaactccattgcagagtcagtttcctgcagaaccccacctacaacaagcagcttcatcttaactcccccaaaagtatcatcttctaagaaattctgtgtaattctaatggcacacacacacacaccatctcttgttgattagcccagaagttagcacctgacccaagatgaaccaaacaaagcttttccctgggggtgttgaacttgggaatcagagagactaagtcactgcacctgcc

SEQ ID NO: 7163 - DNA, 513 bp, artificial
  synthetic oligonucleotide
ctctctgcctaaccataactgtcaccagacaggcagggtttacaatgactgcgtaggtgatttcagcgcattatcttatttcttttaacgtacgtttctgccattatcttgagcctagttttgttgttgttttttttttttaacaagaccttaacaagaacaaacattgtctttttaaggggagaacggctgtagaattgcgggactggaggaaggcagcaacaggccatcatgaaaagtttagagaagaagtggccacccttgggtatcaattaaagaaaatggttgagagtttctcctgatgttctgcatagtacagctcaactcaatcaagaagcagtccctaaaaggcagacagtaactgttcaattgaattgattggggatggatggatgagtaacaaaaattggccttaagtggaacccacatatcccacacatgtatagcaattcagagtttattcaaccaaattctgtggccacagatacaaaatcacttgatttagccacactg

SEQ ID NO: 7164 - DNA, 1273 bp, artificial
  synthetic oligonucleotide
tataaagcggcatttttattttggtgtttgtcatgggattatggttcacatttcagttttataaaaagcagaaaatttaatattccaaattagaaagattatttagtgaacttccatatgaaaagcagaaatattaatattctaaattataaagattaatgaatttctataaataaagtaacagctttccccaaattcaagaaagacatgatcctccccagcttcagccttacctggtattctatgcttgcaggaaccattcccatgaaatgtttttctgtagtcatagcatcagcctttttacacagacaaaatacacagtgaaaatactcagttgctagctgttcttatacattgccagtagaatataaattggtatatccctagaggttgattttgcaaaatttgtcaaaattacaaatacattaatttttttttttttttctggcggagaaggctattctcccttcacttccctagtctgggctagctttgtgacttgctttggtcaatagaatagggcaggaatgactcaggactctcacaggtcaggaagtttgaagcttctgccttttgcgtgtgtgtttgtttgtttgttttgagacagatctcactctgttacccaggctggagtgcagtggcacgggtccaggctccctgcagtctctgcctcctgggttcaagcgattctcgtgcctcaaccccccgagtagctgggataacaggcatgtgccaccacacccgactaatttttgtatttttagtagagacagggtttcaccatgttggccaggctggtgttgaactcctgggattacaggtctgtgccatcacacctggcaaatttttgtatttttattagagatggggtttcaccatgttggccaggccggtctcgaactcctgacctcaaatgatctgcccacctcggcctcctaaagttctgggattacaggcgtgagccaccgcacctgaccagaaatacatgaatcttttgatccatcaattccacttctaaagatttatcctagagaaatatttacacacatgtgaaataatgcatgtaaaggttatcgtgaacatcaaagattgaaaacaatctaaatgtccttcagtgggagactaattacataaattatgccacattcatggaataccatgtgactatgaagaaaaaaatgagaaagtagtctgtgtggtaacatgtaaatatatccaatatatattgttaatgggcaaaagcaagaaacagaatatagtatgctgccattta

SEQ ID NO: 7165 - DNA, 1911 bp, artificial
  synthetic oligonucleotide
cggctcacgcgattaaccctgtcgtggccacacaccccgccagtccctgccgcccagcccctcccgagtggtgtgccagatcttttcgggcctcccttccccaacttcggtcctagagccacctctgccctcgtcccgctcctgagccgaggggcatggaacaggatttctggccgtagcacgaccctgaaggggccagccggaagaaacagtactgcgcgaacaatctttaccgcattgtcttcccctcccccaccctagctctccgggttcccggcggctcgcgccgaagcccggccccctcagcggctcgcgctgctctcccagccttgacggcccggggtggagggagagaagagggggcagctgagcgggagggggctgggcaggagcagggggagggccgaaaggaggggcctgaaaggggcgggccctgacgggggcggagaacttcgggtcttgggcggctctggggctagtgggagtctgcgccgccgccgccgccgccaccgctgctgccgccgtcgccgctaccgccgccgccactggccgagcggtttttttttttttggtttgccggatccgccatattgacgaggacgggcatccgcggctgcggacgctagtctccgccgccgccggagccgcaacctctccgcacccggccccgtcagggcctctgtcgcgcctagcccctccccgccttacacagctcccgggcctcgcgggagcccgccgccgccgcctctctctcacgggaggcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggcgcggcgaggagcgagttccggcgccggtgtgcagccttttggttgagacgcccgcagccccgagcccggccgccgcagcctttcgatacactttgttgccggtcacccccgggcctgggatgcacccagggtaggtctcgtcccgggaccgagccccaccgtcgcctggtgcctcccgcctccgtgtgccctggttgtgagaagacgtctgtgtcgtgcggtgagtggccagctgcactggggcgacgctctttcccggggccaacagctggatgtgggtgaggggaggagggcgaggggggtgtgcgtgtgtgcgagcctcttccctcggcggctgccggccaggctggggcttccccgttccccctcctccggcccgggctgggcgggcgcgcgggcccgtgttgtgtgtggagccggtgtcccgagagcgtgtctgtgtgttttggactgtaagggaaaatggctgacggctccgtccctccccctcctcccccttcccgtcctgtctggggccgagtaggaggatggagtctccgggcgtggcgggcagcccccccgccgtccgcacccgggggccgggtcggtttgggggctggccgccccccgcccggcggccgctttcctacccggtctggttccacttgacaccaaacgccattactgaggtggagtgatttggagctggggagctaggcctcggctacgcctggctatcaggcctgacgacttgtccgcctccccccaccctcccgcgataacccgcagtttctccccggccctgggctcctggagtgggagctgggttatcggcctcctacacctccttcgccccgctttatttgcagagggccaaagccgtgaaaggggtttttgaatgcagaaatcgcttcca

SEQ ID NO: 7166 - DNA, 357 bp, artificial
  synthetic oligonucleotide
ttactaatctcattacaatgagaaatcctggaagagatctcaattctttctagtcagacccttcatttttcagatgaaaaaaatggctcaaagaggtgaaaggtgaagtaacttgaccaagatagcatgccatagactaccttctttatgaagctatatctatatgtgtcaaatcacattaattattaaattctctgtagtcactcataaaattaacattaaactgtctccctggtaatggataataaggtcagggattctgtcctttacctttgtatattacagagcacctagaataatactgtttataataaccatttgattacctgaatgggaaaatctggggcagtatttaac

SEQ ID NO: 7167 - DNA, 929 bp, artificial
  synthetic oligonucleotide
aggtcagccttgggaaggtgcatgaccactcagccagtttgcttcaggaaggatctgatgggcacatggagacacaaacacacacacacacacacacacacacacacacacacacccccagaggtgaaggcaaggccagttcaccaggcctgggaagaggaggccccagtgaactgctctgtaggagcctggggctgggggagagccacagctttgaacctgctcttaggaaaagcagggagccgcctgggattgtcaggcatagagctggaacttattaatcagtaatgaagccagtcagcgcgtttatggattctaccctagcaacctgggagcaaagcagaggaatgaacatttcagatgccagttccctcgcagtcccctggaccgtgctggcttctccctgcaacgcagaatgtctggatgggactgtccctggtggggtggggaagttgctgtccagatgaggcctggcctgtgctctccagcaaggtgcccacctctcaagggcttctgcttgtgtgtgtcttagctgctatgcacttggccatcttagacccctggccaggccctaggtgtgtgtggcggtaggtgggactggatgcagggtgcatctcctgtgttcactgccagcctccaaggtccctttgctcaagggggagaatgggcagaggttgctgggagttagcttcctccggagccctaacctttcatctgcttctcagtcatccccagggatttacgagaaagcagagcccctgctctgaagaaggaaaaccctcccctgaggtggctttcagccagagccccagcactttttatgcttatctgtcacatgacatcctcctctgtttagttttttccacttttaattatcttattattgcaagattacatgcttattgtcagacattcaaactatgtggaaa

SEQ ID NO: 7168 - DNA, 3871 bp, artificial
  synthetic oligonucleotide
attaatttgaattcttaggagaggttttcaatggttaattactattcttatccctcaaactggataatcaacaaaaacaatctcacttccctgaaagtgaggaggccaatatccttgtgctctcatgatgaatgtctttacgtatgttcaaccattcctgacttggagatgatgctgtgtgttccttttttattttattttattaattaattaaattaattaatttattttttgagatggagtctccctctgttgcccaggctggagtgcagtggcatgatctcagctcactgcaacttccacctcccaggttcaagctattctcctgcctcagcatcccgagtagctgggactacaggtgtgtgacaccacgcccagctaattttttttttttttttttttttttgagatggagtctcgctctgtcgcccaggctggagtgcagtggcacgatcttggctcactgcaagctctgcctcctaggttcacgccattttcctgcctcagcctcccgagtagctgggactacaggtgcgcggcaccacaccctgctaattttttgtatttttttttttagtagagacagggtttcactgtgttagccaggatggtctcgatctcctgacctcgtgatccgcccgcctcggcctcccaaagtgctgggattacaggcttgagccaccacgcccggcctcctggctaatttttttgtatttttagtagagacggggtttcactgtgttagccaggatggtctccatctcctgacctcgtgatctgcccgcctctgcctccttaagtgctgggattacaggcgtgagccacagtgtccagccctttttaattttaagttctggggtatgtgtgcaggatgcgcaggtttgttacataggtaaacgtgtgccatggtggtttgctgtacctgtcaacccatcacctaggtattaagctcagcatgcattagatattttttctaatgtgctccctccccctaccccactccccaagaggccccagtgtgtgattcccctccctgtgtccatgtgttctcattgttcagttcccacttataagtgagaacatgcagtgtttggttttctgttcctgcattagtttgctgagggtaatggattccagctccatccatgtctctgcaaaggacatgttcttgttcctttttatggctgcatagtattccatggtgtatatgtaccacattttttatccagtgtatcattgatgggcatttgggttgattccatgtcttcgctattgtgaatagtgctgcaatgaacatacacatgcatatattgttgtaatagaatgatttatattcctttggttatataaccagtaatgggattgctgggtcaaacggtatttctggttctagatctctgaggaatcgtcacaccatcttccacaatagttgaactaatttacattcccaccaacaatgtaaaagcattcctatttctctgcagcctcaccagcatctgttatttcttgactttttagtaatcatcattctgactggagtgagatagtatctcattgtggttttgatttgcgtttctctaatgatcggtgatgttgagctttttttacacaggcttgttagtcacatgaatgtcttcttttgagaagtgtctgttcatatcatttgcccactttttaatggggttgtttgttttaatctcataaatttgtttaagttccttgtagattctggatattagacctttgtcagatggatagattgcaaaagttttctcccactctgtaggttgcctgttcactctgatgatagtttcttttgctgtgctctttagtttaattagataccacttgtcaatttttgcttttgttgcaattgctgttggcaatttttgtcatgaaatctttgcctgtgcctgtgccctgaatggtagtgcctagattttcttctagggtttttatagttttgggttttacatttaagtgttctttttgactactgttctcattgaggaatagtagaagggtgacgccacgctatgataaagaaggggaaggaatatttatttatttatttatttatttatttatttattttgagacagagtctcaccctgtctcccaggctggagtgcagtggcgcaatcttggctcactgcaacttctgcctcctgggttcaagtgattctcatgtcccagcctccccagtagctgggattacaggtgtgtgccaccatgcccagctaattttttgtatttttagtagagatggggttggccaggctggtctcaaactcctggtttcaagtgatccaccagccttggcctcccagagtgctgggattacaggcatgagccacggcgcctggctgggagagggattttaaaagatcccatgctttcctcagatcatcccattcaggaccctttttattttccatattgaaattagaatagtcaatagatgctctcagaatttgtctatactgtcactggcaattgtctcttacaattttctttctaggagcaacaaaattcagacattttttctttcttttaaactcttttacaactcttaatttttgcttctccaaagtctctattcattttctcttgagacaggggctcactctgttgcccaggctggagtgcagcggtgcagttagagctcactacagcctcgatctcctgggatcaaatgatcttcctgcctcagcctctcatgtagctggtaccacaggcaagtgccactgtacttggttaatttttttttttttttgagatggagtcttgctctgtcgcccaggctggagtgcagtggcatgatctcatttcactgcaacctccacttcctgggctcaagagattctcctgcctcagcctccagagcagcttggattacaggcacgtgtcactatgcccagctaatttttgttatttttagtagagacggggtttcaccatgttggccaggctagtctaaaactcctgacctcaagtgattggcctgccttagcttcccaaagtgttggtattacaggcctgagccaccacacctggcctatgcttggttactttttaaaattttttgtagggacggggtgtggggggcatctcgccctgttgcctaggctgatctcgaactcctggggtcaagcaattctcccgccttggcatcttaaagtgctgggattacaggcgtgagccactgtgcccagcctagtattcatattttgaatagacatgccagaggtcttagtggcatgtcctttatggctcataacagtgaaaatattaatctaatcagtcagttaatttccacagtagaatgtaaagtccaagagctttcatgttaactataatgttgtcatgaaatgacaggagcaactttttatgtttgaatttagatacatctatataagagaaagtttcacccaacactattggttaattcttttgcagttttggaacaaagtgtttccagagttgttctactttttgttggtgctgatgaaaaaatgcaagttttaactatgtgaaaattgatgcttagtacaatctgaaaccatggttgtgttagataatgatgtgagccgtttaaaagataactttttctgattagaaaagtactcttccactttaacagaagaatttcatgaaaatcttcacacacacaatagaggctacagaactggcggaactgctggttttgttcatgaagtctgatttcctgctgtaaaaaagatttatcccacttttccactgagtacagaatggcatagggtcaactttgtaaaactacatgttcttctcataccttttgtgctcattttgacagtaaaataaaaatcgcatttaactgttttccccgaac

SEQ ID NO: 7169 - DNA, 1784 bp, artificial
  synthetic oligonucleotide
cagaactgtgagaaatcaatttctgttgtttgtaagccaccgagtctacggtagtgtgttatggcagcctgaactgattaagacaatacaccagcttcttcaccttgcccttggctcctgctcccccataactttgacctgcacatggctttggtacaaactccagccccaaagctagacaggttggtgctcacatcaccttactgactagttattcactgcctattccattttcacggagaaagaatgaatctgattagctctgtttaggtcaaagtgttcaactgcggtgcaaacagctgtggttgggaggagatggcagagacacatggggctctgagtagggtatttttttcttagaggcagtggctggcaacacctgctgtcagaccgtggaaaatgaaagctacaagggctctcaaagaccaggatgtgcagtgtcttagtctatttcgtgctgctgtaacaatactagagactgggcaatttataaagaacagatatttatatcttacatttctggaggttgggaagtccaggattgaggggctcacatcaagtaaaagccttcctgcggcgccatcccatggtggaaggtggaagtgtgagagagcaagatggggctgaacctgcttttattacaaatctacttttgcaataataacattaattccttcatgagagcagaggcctcacgacctaaccacctcttaaagagcccacctctcaacactactgcagtggggtttaagtctccaacacgtgaacttaggaggacatattcaaaccatagtatgcagtttcttcagtttacagttaaagcaatgaaatctcagaaaggctaggtgtgtggggtgggagatagtacagtatagtgaaaaacaaacaaaggttggcatcatttaaccgtcctgaacctcagtttcctctttcatgagaagagaagaataatccttatcttgcatggctgtcatattaaatggaataatgtctatggcaagcttagccctgagcaaattctttttgagacggagtctcactctattgcccaggctggagtgcagttgtatgatcttggctcactgcagcctctgccactcgggttcaagtgattctcctacctcagcccctctccccctgagtagctgggactacaggtgcgtgccaccatgcccagctaatttttgtatttttagtagagatggggtttcaccatgttggccaggctggtctcaaactcctgacctcaagtgatctacccacctcagcctcccaaagtgctgggattacaggcatgagccaccacacccggccctgagcaaattcttattaaaagctggttgttggccaggcgtagtggctcacgcctgtaatcccagcactttgggagaccaaagtgggcagatcacttaaggtcaggagttcgagaccagcctggccaacatggtgaaaccccgcctctaccaaaaatacacaaaaaattagccaggtgtggtggcaggtgcctgtagtcccagctacttgggaggctgaggcaggagaatcacttgaacccggcaggtggaggttgcagtgagctgagatggcgccactgcactccagcctgggcaacagagcgagactccgtctcaaacaacaacaacaacaacaacaaagttcgttgttttaagagcaaaagaaacccatacaatttaattaatttgagtagcattatacatgttcatattacccagataacatatgttaccacagtacctaaactatgtcctgtagatatttgctgt

SEQ ID NO: 7170 - DNA, 6148 bp, artificial
  synthetic oligonucleotide
agccgcatgtttaaaaattctgagtagtcacattaaaaaacgtaaaaagaaacagttaacattaattttaatattttatttaacccaatatatctaaaataccattgtaacatgtaatcagtataaaaatcattgatgcagctgggtgtggtggctcacacctgtaatcccagcactttgggaggccaaggtgggcggatcaactgaggtcaggagtttgagaccagcctggccaatatggcaaaaccctatctctactaaaaatacaaaaattagccgggtgtggtggcacatgcctgtaatcccagctactcgggtggctgaggcagaagaatcacttgaacctgggaggcggaggttgcagtgggccgagattagcgccattgcactccagcctggcgacagagtgaggactctgtctcaaaaaaaaaaaaaaaaaaatcattgatgcagtattttactctttttaagtctttgaaatctggtgtgtcttctatatgcatagcacatctcaatttgggttggccacatttcaaatgctcagtagcccacggggctagtggctactgtattgggcagcgcagatctagggtgaaggccacagcgatgtcctcggagatcccccagggcctgcagacaacaaaccctcaaggccacattctagtgttccccgaccaaactgagggtggggctgctatttctcacggcccaataatgagatgcagatgaactgggaaaggagggagttttttatttctgtaactggttacagggaaaaggcctggaaaatatctctagaccaactcaaaattacgaacttttccagagcttatataccttctttttttggaggggggggatggagtttcactcttttcacccaggctggagtgcaatggcactatctcagctcactgcaacctccgctttctgggttcaagcaattctcctgcctcagccttctgagcagttgggattacaggtgcccaccaccatgcccggctaatttttgtatttttagtagagacggggtttcaccatgttggccaggctagtctttaactcctcacctcaggtgatctgcccacctcggcctctcgaagtgttgggattacaggcgtgagccaccgcacctggcccagagtttatataccttctaagctacatgtctacgtgtaagtgtgcattcatctaaagacatgtgattaacttcttttaatctataactaaggtctgagtcctgaagaccttcctctggagcctcagtaaatttacttaatctagatgggtccaggtgctggggtgattacccttattttgtctcctgctaaatcatggaggtttggggagttcctccagacccccaataaacttgtctgtggaggtctggggagtttagacccccagtaaaacttgtttaatcctaaatgggtcctgttaagaattatttcataatcttgtcatgctttaaggcccaggaaaggcttgggcaaaactcttggtgggcttttgttaccttccagcctttgtataagggcactggtgtatatatatatatgtatttttttttttttttcccctggggtaactggttctttagcaagaggggagcactggggagtatcttcagggtggctgaactttgcaacctctttaataaacaacttccccctgtgcagtttgtcctcctttatcaccacactccgatgccctggtattcaggcaatggcatcaggcccatatttccgtagagttcagagttctgtgaggtagagcattccttccaatgggatcttagaattcttagagttgcagaattttactgactagactcaggaggtctcaggagtccagacttccttaaagcttggctcaaaattccaagggagctcataactccatggagcccagagttcctggctcgggaacattgggaggcctgggatacagtggcttagcctcaagcaaaaaggtgaacaatatctttatggcttgaaggtatacgaaataatgtcactacatcggagcagcgcctctgcttgcacacctatgggagtctgtagctgtgacacatagaagttggccacatccatgtcggtggctccaaagtgggtggccacacgcacaccctcgtgcaatgtgaagctcacctgatgactcaccatggccagcaggccgcggaggtaacgatcccgaagggcggctcgggcccgctgcttctgggattccaaggattcttgagctatggaacactcctggatttcaagaacctctgactacaggggggctctgcgtccatcaggggcaaagccacggctgagaccatcagggcctcggggcagccggagcacaggcacaggaaaggtcactggagcctgcattgtcttggcgaggtccgtggctactgtgcgcgcccccacttccgccggcaccccgcagtagaggccagggcaggccccgagccgcggagcctgggttccgcctgcgccaccgccaccaacccacgtgtcacgggcaaatttatttatttatttatttatttttgatatggagtctcactctgtcgcccaggctagagtgctgtggcgtgatctcagctcactggaacctccgcctcccgggttcaagggattctcgtgcttcagcctcccaagtaggtgggattacaggagcccgtcaccacgcccggctaatttttgtatttttagtagagacggagtttcaccatgttgctcaggctggtgtgaactcctgagctcaggtgatctgcccgcctcggcctcccaaagtgctgggattacaggcgtgagccactgcgaccggtcagcttttaatatttaacttaaccattcagtcagtgccgaaacagtagttatggaggcctgcattagtgagtcctggcctgccacactaggagcacacaagtggtggtacaggcaggagggagtttagaacggggtcagctgcagggattgcagctgggttttgctgattaaggtaaccggaaagcaaaggagcgggtgtcttaggtggataaacccgtgtgaggccgcggaggtgggaagaggccatgtgcctgacacaagataactcggtggagggcctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctctactgctggacttttcagagtctttcatatgctaacattcattgtgaatctcccaagaggccacacaatccttttttcttagcgttttgtgggatgaatgtccggaagacacagagagcggggcagggaggctccagcttggatgattccattaggtgtggaaattattatgggctgcacacttcggggctgactaacggccaagagggaaggaggcagccagtagctgggaaaggggatttagagatttctcaggttgggggttggccaactatattccccccggcttgactgcaagggcaaaggccagccaggcctgcagcaagcatgcatggctctgggtgtgctgtgcctgagggcggggctaccaaatcccacctaggggccctaccaaacccagcttttctcagggttgcagtgggaacaaacggtgtttgttctgtctgcctcaggatcagcagctcgtttagcatatgctgcaagaataaggctttgcaggctgagttgcaaatgctggctctgctggtctgcagtggccatctctgtggtttgcagcagaaccgtcctaagctggtcacaacaggcagggattcctgacagactgtaaggcagtcaagtcaagaaaagtgcatatgctgctcaccacttacacaagaacccaagctgttctctgcactgcatgctatgactgcatttgtcaacattctggaaattgtcatctttttaatgtcctctctatatttgaagaggtgggttttgaaaacccaca

SEQ ID NO: 7171 - DNA, 2386 bp, artificial
  synthetic oligonucleotide
gggaacgtgggagctacttactgccaaacagacccagagttgcttggaatgagttgccagtgaatttgtggccgttatgagctctcgtgagaaaacagggagtgaagactttccattttgagttcatttagtctctcaccccatcactggctacatggtaccttaagtaaatagtaggtactatagattctgttaagcaaaactatgtgtaccaatcaggatgggccatattatgctgcggtaacagataactcccaaagctcagtggcttacggaggtttatttcttgctcatgctacctgtccattgtaggatcattagcagggctctgctcattgtagctattcagggacccaggctgacaaagggtacaccatcttaggacattgttatccaaacacgaggctctagggtttgccacagaagaggagagcttgggagagttgtgcatcactcttttttttttttttttttttttttgagacggagtctcgctctgtcacccaggctggagtgcagtggcacgatatcggcccactgcaagcttcacctcccgggttcatgccattctcctgcctcagcctcctgagtagctgggactacaggcgcccgccaccacgcctggctaattttttgtatttttagtagaggtggggtttcaccgtgttagccaggatggtctcgatctcttgaccttgtaatctgcccaccttggcctcccaaagtgctgggattacaggcgtgagccaccgtgcccggccttttttttttttttttttgatacggagtctcgctctgtcgcccagactggagtgcaatggtgccatcttggctcactgcaacctccccatcctgggttcaagcaattctcccacctcagcctcccaagtagctgggagggcacccgccatcatgcccagctaatttttgtgtttttgtagagacggggtttcaccatgttggccaggctggtcttgtactcctgacctcaagtgatctgcccacctcagccttccaaagtgctgggattacaggtgtgagccactgcacccgccctgtgcatccctcttaaatgcttccactcagatgtgacacacattgctgctcaaatctcattgaccaaaaaggacacatagccagacttaatttcactgagaaatggaagcatgattcccctatgtacccaggagaggggaactgggaatatcagtgaacactagtaatgctccaggctgggtgtggtggctcatgcctgtaaccccagcacttcaggaggctgaggcaggagatcacttgaggccaggcattttagactagcctgggcaacacagtgagaccctgtctgtacaaaaaaaacaaacaaaaaaattagccaggtgtggtgacacatgcttgtagtcccagctactagggaggctggggtgggaggatcacttgagtccagaagttggaggctgcagtgagctatgataatgttagggtaggtagtcaggcatgagcagagcagaagagggctctccccccaccaggaatggcaggtggccatcaagtgatgggcaggcagttggtaaagtgtggcgctcaaataataatttgtcacagctggtgtcagggaaaggcaggctgccaatagatagaaaacacctgaaactggtgatcagcagcttcccgataagatctcaggagttggccgagtggactcaaacatgcacacaaaatggcaaaatggtggagtttaaccttcctctaggaacactggattggtaagggaaaaatgcctcaagtgagcatgcatgcgactccagtaaatgcactgtgcgtacagcccctcccaagtgctggcaggccactgcgcatgcaggcagctgaccccaagggaagactcaggggagaagtaatgcaactccggaagcatgccaacatagaaaaccccaagtcaaaggtcacaccatgcacttgaatctctcaagttgcctgcttggccctcttccaagtctactttacttccttttgttcctgctctaaaactttttaataaactctcactcctgctttaaaacttgcctaggtctctcactctgccttatgccccttggacaaattctttcctctgcagaggcaaggatcgagtctgctgcagacccaggcggattcaccactgctaacaatcacggtactgcattccagccttggcgacagagtgagactccgtctctaaaaaacaaataaaaacctttacttctcagaactgtcaaaaggaatagagactcgagggggaaatctggtgagcaatccactagcccccggctaggcttctggacactgtatttagccaataggaatgctatggcctctttgtattggttctttcaagttaaggggacag

SEQ ID NO: 7172 - DNA, 509 bp, artificial
  synthetic oligonucleotide
cccggtcaactccagttcctgaacaaatgttatttctattccatttatgttccaggcagaggaaatgtagaagcacttagacaaacatgtgcaatcttcaagagagttcccttgacattttgctgacttttacaactgtgatcctgcgaggagaaaaggagtttttgttcacaggtggactcactgaaacaccagccttcagggaagcccatggaggtctttccttcgtggttcccatttgcctagcaggagttccctaatgggcctacatcacctcaggcctaggccggcttgtggcttgcttgccatccagtagcaggtcacgtgggttgtggcatcattagttacaagctgcaatacaaaataatagtaacaaagtagatggggaaatttccacatgcatcacaggtagtaagataagtattacttcattaaacgtttgcttcagttatgtgtgtgtgcttgtgtgcgtgtgtgtacaccggattacaatacaaaaatgcatcttt

SEQ ID NO: 7173 - DNA, 430 bp, artificial
  synthetic oligonucleotide
tttctgtgaactcccttttaatcacttccaagggagtcattacaaattaaactgtcacccaccactgaggaggttaagaatagtgtctgggtaggatgagcacctagttgtgtgaaaataaagtgtgtggtggactctgaaagccaaggaagttgcaatctctgttctagaagtccactgaagaggcagaatgggaattagttccttgaggatggtaggtgtaacatgttttaacaaggtggctgaactactcaaaagaatacagccttatcagaagccaaacacattcactaatgaccctgctgatgttcctagttctaggttgtttggtgggtcttaaaactttaaatagccctgcaaggggatgtggtaaatccacatgacccctctctgttttgacagcttggccctgtccaaatgaatcttagtc

SEQ ID NO: 7174 - DNA, 925 bp, artificial
  synthetic oligonucleotide
ataggatattttggtcactgcatatcaacttcggtgtttaggaaaaagtattctactaccgtaggtcccacagaataacagatttgcttgaatactgtcctcagtgaagttacttttgtctcttttagagatgagacaactaagccacatggtatattgattaaaatcaaacaaaaataattatgaattgttcaaaagacacaggacttatgagaaaggctgtggatctgtgagccaagtgctagaaggctcctgggaaaagggatatgtctgagacccagaatcatttaaaaaaaaatcagagtggttagggcatggggttgggaaggcaagtggggaaaggagacagagacagagtagggtctcattccttgttcaatatcaacaggtttactgatggggtgagtttatgtgagctacccagtgccaggaccttcaagcaaagccatggctttaacaggcagagacctacatcaccttctaaggaagaaagatgaagaataaactccacaacattttaaagccaaatgaaactgcagtacttgcactgcagtataaatgaatcatcacaatttgagcaagggctagcattagctctgactaatgtgagactttgtacttgaagatggggagtgaaaagtgtctttatgttggggatagcccttaaaattgaagtgtgcttcatttttccccccaacaggcagaatttcaaatagtagccacttctgcttgtcaaatcccattaagactaatgccataaggctgtttaattatcattatccagccgggcacagtggctcatgcctgtaatcccacactttgggagggatgaaatcccacacttttcatcctagtgaaattgtggtcaactgaccagtttgaaatgaggtaagtgattagacagggcttgggtagacttgtttcc

SEQ ID NO: 7175 - DNA, 2969 bp, artificial
  synthetic oligonucleotide
atgctgaccctatgtgataaggagtgagatttggtgaaaagcatcatgggctctaaaagtcagatctgagtcctaacttgggcactgtcatttaagagttgtgtggcctgccgggtgcggtggctcacgcctgtaaccccagcactttaggaggcagaggcgggcggaaaatgaggtcaggagttcaagaccagcctggccaacatagtgaaactccgtctctactaaaaatacaaaaattagctggatgtggtcccagctacttgggaggctgaggcaggagaactgcttgaactcgggaggcggaggttgcagtgagctgagaccatgccattgcactccagcctgggtgacagagtgagactctgtctcaaaaaaaaaaaaaaaaaaaaaaaaagagttgtgtggccaagagtaaagatcataacctcttgaactttctttctttcttcctttttttattttagagacaggttcatgctatgttgccttggctggcaggctggtcttgaactcctggtctcaagtgattctccagcctcagtctcccaaagtgttgggattacaggcgtgagccactgtacctggccaaccttttgatctttcattacctcttttgtgatacctacctcacagagtattgcaagaattatgtaaaggaagtaatataaatgtgtttaacacagtgtctggtacacagaaagtactaaataaatattagttaatggtttggccatctagcttaagagttcaattctgactgcacattaaaatcccctaaggagcttttaaaggaaaccagtgcctgaaacccattccagaccaattaaatcagaatatctggggaaggagccaagcactggtatctttaaaaaaccctcaagaggattctaatatgcagccaggattgagaaccactgataatcccttctacaaagaacccaattggtggtagtctcaaaaatctccagtggtaagatccttatattgcctcccaagagagatcatttcattagaaaaaaatgatttccttaaaaggaggcaacatctgtctctgcaatttctatcattggttcttgttttgctttgtgaagacacatataacaaagtgaaacccttttctctatggctttgtaaagcattctcatctccagggtaacgtgcctatttccttcaacttgcttctttgacatgatttgagttcttctctccatttggtccatggccttttctaagtgtgctgctgtggatcaaacactgcattccaggtgagaccctaccagcctgggacagaagcagcatagtagtaacaattttcatttcagacatcacgtatctaggaattcaactaaagatgggtttttcgttgccaccacactacgctagtgatagagcaattgcaattgtgtttgttaatgcagctaaagctcttcctgtacttgtacagctgcttttaatatccacatgtagaacttcatatacatttctactaaattccctctttgatttaataatatttattatgctaagcattaggtacagagagccgaacaaaattgacttggttcttaatcctaatggaacttaaattctaacatgagagaagaaaaaaaatccaaaataactactcacaggtgagtttttcacgtcatttcagctacttgagctctcaaaatcacattacttcttgtgcctcaattccctgaacctatgagagctccctacataaccacacaatataggtggttcctctacagacacccttttccttttcctggtaatgcaggttgcattatcagtttcatttttggtagcctgacattctttctagattgccctttccttttagaatcttagatcacaggttgggcatagtggctcacacctgtaattccagcactttgggaggccgaagtgggcagatcacctgaggtcaggagttcgagaccagcctggccaacgtggtgaaaccccatctctactaaaaatacaaaaattagccgggcatggtggcgggcgcctgtaatcccagctactcgggaggctgaggcaggagaatcgcttgaagccagggggcggaggttgcagtgagccgagatcacgccattgcactctagcctgggtgacaagagcaaaactctgtctcaaaaacaaaacaaaacaaacaaacaaacaaaaaccagaatcttagatcacaagaaacatgcctatacctttctataaactttctgaaatttgtcttcctgcagttgagacacatgacagactagactcagtccttccccgctcccttcctttctccctccactttcctgaattctggaaacaggctcttaccagggattacataacttcctcttcaccagccagttcctcttctgtggaatcaatgctccccaactttacaacattttaaatcttaatgttaccctctaccaaaatgctttgtttttaatcaaattatgtgtagagctttaagaaaggctatttttctctgtgtataagatcaaatcagggacttaatttatgtaattcaaatccactttgcatggtagcagtcagggtttgaatgtccactcctccaaaatgtttactaatagggtctctgtcttattcaccttcctttcccacacagtacttagccaagtgtgagatatttactaaaatgagattaatcaaaaggtgtttattaaagctaacttttattaagcagtcactatgtgccaggattaagttcttcttatgcatttttcattttcacaaatgagaaaactaaggcatagaaaagattaagttatttgcccttggtcacaagttagttgggtctgattttgagaaccttgctctgggcatctttatgttaaccctgctaagtggctgctgtagagaaatagggcagtcactctatgagaggaatgtgatgagacctccagaaatgctttctttacttgttatgaccagctctcaga

SEQ ID NO: 7176 - DNA, 894 bp, artificial
  synthetic oligonucleotide
tttttcttcacactctgattaagggtgggacacccacgatcagagctgcttgtggcaggcggtgagggcctgagaacagtgtgactggaaacaaggctgtggccagacaccacttcctggagagggcagggggctcagtgagccttgaacaaaccatagctttgagtaactgcactgtgtctcactcctcctaaagataaccactggcttgggtgtatgttgaactggacaaggcttacttaccactgcccctgatttaaagaaataattatcttttgaatatgatattctaatgtgtactaaattagtcatgtcttctctttctgcataccagcctcccaatgccctgagctcctgattggttagtgagagtacttaagaggccagttgcagccagtttaaacactagtttggatagcctaaaataatttctagatgaagcacatggcttcaggaatgactaagctgtcctgtgtcctctgggttctggctctgagggaaattgataagggaccctaattctaaccccaacaatccatgtgagtcaggaaagctctcatgtccccttgctatgtatagcccaccatggattgccaaaataaatgtccacatgcctgccctttgatgatggtatctcctctgccaggtaagtatatgcctgccctttgaaacactctcactgaaccactccagatgaattttggggccagattaaaaaacacacttgatacacaaatccatctcaaaagcaggaaaattaatacaagacagaacttcaattgtaggacataactctaacacctcaaggaagtaaatcctaagggtgacagcagaacacttaggagatcaatatttggcagatgatacaggaatcaactagaactgttaggccaa

SEQ ID NO: 7177 - DNA, 1544 bp, artificial
  synthetic oligonucleotide
gtgattattattcatttttagcttaaaaattaaactctataaaaataaacaggacctaatggtttaaattttgaaagctgatcattaagaaaggcagtcagcatattaactatgtagacagtcattagtaactgaagttaagagttgtagaacttttttcatttgtcaaattagcagagacaaaatgtatgcatgagtgacttgagatagacattctcctgaggggaatatagacttagagacattttctggagaccagttttgcatctgtaacatgtaatttttatttgatttcttaatagtactttccaaattctggaaaatagttatctagtagttttatgatccaagtttatttttgaaggagatgtacatagtagatacaagtttgggaaggtaaagatggtgacctagttgttgactgctacactgagagtcctacagagactcaacttctgtctgataaagctagcctctgcagaagtctatgtcccttttgtttggaagcatttaatattcatacagaagcaccattacctttgcagtttttagtatactatgcattatctgcacaaggtaggagctactgcttttctttaacagcatcataaaaggaagctccaatccttatgtaaaatcaaaacctactgtgagcagataattttttcttaaataaactggctcatttcactgtctgactgatttttgaactggtgaagttacagattaggttttatatatttataccagggtctacactaactgaaaccagattataattcatcaggttgcactagattcagatacaaacttacaatgaagcatatggactgttttctaaataaaaatagcaaagaaataaaattataaagacagtggtaaacattaattaagaatcttgttatttaaacccacagacactgcacagtcctcaagttttcaagactttgggtgtggattggtttaaaaagttattataaaattataatatcatatttgaaaaaaaaccccaatttctgtaatccaagatgcagaaaataaatcaaaccataattctgaagggggtagagagtaaaattgccctgaggggctggggggatataagaatttcaaagggttgtgtatggtacagtttttatgtttatcaaaagagaacatgattaaaaagaagattgagaaaccttgctctagatcatgaaagagtggagaatgtggtgctcagaaggctatggtgaagaacacagagaatatggcacattctgaatagagatcatggttcttatttgaccagaatccagtaacttttgttattctcacctgaaagaagtgaggaaataaggagaaaaataagaataaaagcagtttgtatatgattcttcagcacttcatgtgtaccctttgaagcgagaaagatttaaatataagacagaaaaaagtaaaaaccagcatttatgttgtgattaaaacatcatatcctttaaaaaaaatcctctgaaaaactcagatagcaaattacacacaaggacactctaaccaacaagcat

SEQ ID NO: 7178 - DNA, 2587 bp, artificial
  synthetic oligonucleotide
aaggcaatcaatttccatatcttcattttccataattttgtctgtttgtaaacaagtctgtggtctgcggtttttcttttacatctccacaactacaatcacccatctccacatctccagttacccatccaaaaggcaaactactcctccaacccaaaaagcctaacttcaaagagatggctgggaaatgcacagcccctgagggagggagagacctttgaaagcaaaacaaagagagtttgagaaaaaaagggaggttccaccttactttatccaggcaatatattcatggtaagctgtttaagaattcaaaatcaatactaagatgagtgtcacagggatgtccatttaacactttaattttgtttgaaaaatgaagtcagattttttttttccctgacagaaaatgagtctgatttggctgagtgatttgacaataaggactagcattgccatgtaggtcacatagcagacattttccatacagtgaatgagataaacaggcaattctacagttgtgtagaaaatatatttaaggctgggcgtggtggctcatgcctgtaatcccagcactttgggaggccgaggcgggcagatcacaaggtcaggagttcgagaccagcctggccaacttggtgaaacctatctctactaaataatacaaaaattagccgggcatggtggcacgtgcctgtagtcccagctattcgggaggctgaggcaggagaattgcttgaacccagggggcggaggttgcagtgagccgagattgcgccactgcactccagcctgggtgacagagtgagactctgttcaaaaaaacaaacaaacaaaacatatttaaaagaatattcaagatactgagaattatattctcacaataaaagtttttatatatcaacctaaaaaatatgtgaaggggtacatacgtttttcaaaattcttttttttttttttttttttttgaggcagggtcttgttctgttgcccaggctagagtacagtggtgcaatcatggctcactaaagccttgacttcccaggctcaggtgattctccaacctcagcctcccaagtaactgggactacaggcgtgtgccaccatgcccacctagtttttgtattttttgtagagacagggtttcgccatgttgcccacgctggtcttgaactcctgagctcaagcaatccgcctgccttggcctcccaaggtgctgggattattggcatgagccaccacgcctggcctcaaaattcttttagcaggtttgccagaaaagattttgaaggctgtgtctctatgacacaattttcaggctcctttccattctggttatcctattctgcagacattccagtgtcctgcttactatgaatggtccagggtgaacgggaggagtatgactttgttctgaatactatatactcctaattaatgtagcataaccttccattcagcgctttttaagctgttgcaaacaacaactaaaatgtttacatcttttttcacataatcacaactaaattcacactgatcttgcacttactcatatttgaatgaaggagttaacattaactggtcttaaatttcaccttctttgtttcagctcctttgctacaaacttgtaaaaatatttttgaattttgatgtagacagccaatatgttagctagccctttgtagggggcaacttgtgaaatgcctcccagtgatcctcacctcctgatattcaggccctggtataatcccatcccccttgtgtataggctggatctagtgactcatttctaactgcagaagtgatggtgtgtaattttggagattaggttacgagactgtgacttctgtcttgctcatactctcacttgtcctcttgcttgctctgatgaagccagctgccatgctggaagctgctctatggagaggcccaacggacaaggaaccaagggaggcttgggccaacagctcttaaggaattgtggctctcagtccagtagcctgtgaggaaggtaagactgccaacaatcatgtgagtgagcttggaagcagatccacattgtagtggagcctcaaaatgacttcagctctggccaacagctttattatcaccttgtgagagacccagagccagaggaccctgctaagttggaacacacattcctgatgcacagagactaagataataaatgtatgttgttttaagccattacattttggggcattttgttatgaagcaataggtaatgaatataacctctgaccttggtatcttttgaatatttagcaagtatatcttctgttttttttcctaatcaaagtcactgattacaaccttttttttttttttttagaaaaaaatagagataggttttggtatgtttcccaggctggtctcgaactcctggcctcaatcaatcctccctgcttcagactctcaaagcactgagattacaggcatgagtcaccactcccggcctgattacaattttgaacagaataggatcaaagataaaaccctgtaggatgctgtcctataaagctttatataatctctttggacacaatcatccgaccagagctggatgacc

SEQ ID NO: 7179 - DNA, 2817 bp, artificial
  synthetic oligonucleotide
gtcagcagtccttccaataatgccatgctgggtttgaacacgatcatattagaagaatctggcagtaggaaagaaatagcggggtcaagagaaggttttacttgtttgtttttttaaaggaagcactctgtgtgtttgtaagtggcagtgaggaaaagcctacaggatctggagtcagaaaatatggtgctggtcctgcctttgtcctaccatctgcaagctgactgctaacttctacaaatgactttcttagagtcaatgaaatggggcagtgacaagtgatgtggtacctgcagagtctaccaaatcagttggagagggcagtgttaagattctaatgagaagctggatgtttggagcccagcatggcagggctgggggctcagtgtttactgcaaaggaagagatcagaggcacaggaaagatgcctccatctccaaaagtagttaggaaggccccgcaggaggggaggatgtgaagcagctgtggggtttgtgctgggaagtcataaccatgaggaaagcttttaacaagtgtgctggagggccaggctgagccagacaacatcaatcacatgcctgcacagatttttcctctccaggagtgttctgccttctaattctaggaaaagcttaaaatttttattactcatttttatgtttatctctagcttcccatttttattagaactcaccctttcatatcttctgttttcgacttaagtttttctctttccattcctctctattctaatcaaaagcctgattttaactctatcctgtgacacaggagtcatgaagtaaacagatttggtgtttgccacaattaaaactgatattttctctttattttcagcttattttctattttgcctctttcatgtaactaaattgtatttttccttttttgagacagagtcttgctctgttgcccaggttggagtgcagtggcgtgatcatggctcactgtagcctccacctcccaggttcaagagattctcctgcgtcagcctcctgaatagctgggattacaggtgtgcaccactatgcctggctaattttttgcatttttagtagagacttttttttttctttcagaagcaaaccatcacaaatgaggactttttatttgccactattttaagtctgaactttaaacagattcttggactggtggttcatatccatcagctcgttcaactttagcacctggagatggggttttaccgtgttggccaggctggtcttgaactcctgacctcaagtgatccaccctcctcggcctctcaaagtgctgggattataggcatgagccactgtgcccagtctaaattgtatttttatctccacattcaccatttgctatgtgatacattggttatactgaaagtttgtaagcagaaatggatgctccatttctgccacacatttggctccatttgagcctcacattttgatttggtaaatggctgaacaagtccttggtctagtctcttatcacctacccactctcaaaataaaggcagaattgctggggggccagccttcaaagcaatttaaatgtcaccggatctgacatttcagaactaaagtcagaacactgatttgacttgatttgctagtatgaaactagcaacataaaaatatatttcaaatgataagggcaatgatctagaaaaattgtggtcatgttttcctgaattcaagtataaattaaatagctcaaatagcacaattaaaaacacaaatatatccattccaactatagattccacgaatattaaactcaaaatgtttgtttctaaatatgaatgtgaattaaagatatatgtattaagtgctattaagtccacgctgatatagcaaactaaaaacactatttgcctacaaatcaactctagaggcaaagtaggaaggaatttgaaagcaggtgatgaaaatatgatttaaagtggtgattatctgactgcttacagatgttagcacaaaatgtacctgggaatgacatgacccagggttaccatctctattttgaagtattgttttgtttacagactagtaactggtacctctcttcactctcctttgtactttctttttttttaatgagtacattttttattttaatttcaatagcttttgtggaacgggtggtgtttagttacatggaaaagttctttagtggtgatttctgagattctggtgcacccgtcacccaagcagtgtacactgtacccaatgtgtagtctttatccctcacctcccctcccacccttcccccaaagtccatcgtgtcattcttatgcctttgcgtccccatagctcagctctgacatactagtgagaatatacaatgtttggttttccattcctgagttacttcacttagaataatggtctccagctgggtgcagtggctcacacctgtaatcccagcactttgggaggctgaggcaggtggatcacctgaggttaggagttcaagaccagcctgaccaatatggtgaaaccccgtctctactaaaaatacaaaaattagccgggtgtagtgacgtgcacctgtagtcccagctactcgggaggctgagacaggagaattgcttgaacctgggaggcggaggttgcagtgagccgagatcacgccactgcattccagccagggcaacaaagggagactccatctcagattaaaaaaaaaaaaaaagaataatggtctccaactccatccagcttgctgtgaatggcattattttgttcctttttatggctaagttgtactttcttttttgtaatttctcaggaaattttaaaaatattt

SEQ ID NO: 7180 - DNA, 8160 bp, artificial
  synthetic oligonucleotide
caccacttttccagtaatgtaattctgctcccatggtaccttatcattctcaaacaacaacaacaacaacaacaaaaaacaccccactttaatgtagagttacaataaaaaaagatggtcagtgacaaggttcccaaatgctcttagatttccaatcatatgcagatataaggaagatgccatcagaacctacccataaatgttgcttaaaagatgtctgacttgaccatttgaagtaaagagcagtgaaaatgtgacccaagaaagactgctgtacaaaacctgaaaatggcccccaaagcattgcatcccagacacttagtactgaagctgattccttaattgtcccagctgctcacccacttcaaagcagcatactatggtatcatagtctgttttctgctgttataacagaaacccacagactgggaaatttataaacaacaggtttatctggctcactgttgtggaggctgaggagttcaagagcatggcatgagcatctggtaaggttcgtcccattgcagaagggcaaccaagcacaagacatagagagaaaatgggcccaagctcattcttttatcaggagcccactccagcaataactagcccactctcgcgataacaacataaatccattcatgacggaggattcctcatgacctaatcacttctttatgtatgtatgtatttatttatttatttgagacggagtttcactcttatcacccaggctggagtgcagtggcatgatctcagctcactgcaacctccatctcccaggttcaagcgattctcctgcctcagcctcccaagtagctgggattacaggtgtctgccaccatgcccagttaatttttgtatttttggtagagatgggtttcaccatgttgtccaggctggtctcgaactcctgacctcaggtgatccatctgcctcggcttcccaaagtgccaggattacaggtgtgagccatcgtgccaggccaatcacctcttaaaggatccagcacccaatactgttacaacggcaattaaatttcaacatgagttttggcagggacatccaaaccatagcacatggtgatgataagcaaggccttggcagtttgacaagattgagtttgaatctaggttttgccatttactcgactgatatgtgagcttgaacaagtcacttaactgttttcaagctgcagtcctcctttctgtaaaataggcataacatggcacctttataataggattataatgggaactgagacacctcttagcaaggcgtctcacatcactgaaatgctaaataaatgttagctttgttagataaaactctgtaatagtctgtctctatttgaaagtaatatcattagaattaagattctttaaaatcacattaaaactcacgataagagcttctaggggggcagttccaagatggctgaataggaacagctccagtccacagctcccagcgtgagcgacgcagaagacgggtgatttctgcatttccaactgaggtaccgggttcatctcactggggcttgtcggacagtgggtgcaggacagtgggtgcagcccaccgagtgtgagccaaagcagggcgagacatcgcctcacccgggaagtgcaagggttcagggaattccctttcctagccaagggaagctgtgacagatggcatctggaaaatcgcgtcactctcaccctgatactgcgctccaccctgatactgtgcttttccaatggtcttagcaaacagcacaccaggagattatatcctgtgcctggctcagagggtcccacacccacggagcctcactccttgctagcacagcagtctgagatcgaactgcaaggcggcagcaaggctgggggaggggtgcccgccattgctgaggcttaagtaggtaaacaaagcggccaggaagctcaaactgggtggagcccaccgcagctcaaggaggccttcctgcctctgtagactccacctctgggggcagggtatagacaaacgaaaggcagcagaaacctctgcagacttaaatgtccctgactgacagcctggaagacagtagtggttctcccagcatggagttttagatctgagaacggacagactgcctcctcaagtgggtccctgacccccaagtagcctaactgggaggcaccccccggcaagggcagactgacatctcacatggctgggtacccctctgagacgaagcttccagaggaacgatcaggcagcaacatttgctgttcagcaatattcgctgttctgcagcctccgcagctgatactcaggcaaacaggatctggagtggacctccagcaaactccaacagacctgcagctgagggtcctgactgttagaaggaaaactaacaaacagaaaggacatccacaccaaaaccccatctgtacgtcaccatgatcaaagaccaaaggtagataaaaccacaaagatagggaaaaaacagagcagaaaagctgaaaattctaaaaatcagagtgcctctccccctccaaaggaacgcagctccttgccagcaacggaacaaagctggacagagaatgactttgacgagttgagagaagaaggcttcggatgattaaacttctctgagctaaaggaggaagtttgaacccatcgcaaagaagctaaaaaccttgaaaaaagatgagacgaatggctaactagaataactaatgtagaaaagtccttaaatgacctgatggagctgaaaatcatggcacgagaactacgtgacaaatgcacaagcttcagtagccgatttgatcaactggaagaaagggtatcagtgactgaagatcaaatgaatgaaatgaagcgagaagagaagtttagagaaaaaagagtaaaaagaaacgaacaaagccttcaagaaatatgggactatgtgaaaagaccaaatctacgtctgattggtgtacctgaaagtgatggggagagtggaaccaagttggaaaacactctgcaggatattatccaggagaacttccccaacctagcaaggcaggccaacattcaaattcaggaaatacagagaccaccacaaagatactcctcgcgaagagcaactccaagatacataactgtcagattcaccaaagttgaaggaaaaaatgctaagggcagccagagagaaaggtcaggttacccacaaagggaagcccatcagactagcagcagatctctcagcagaaactctacaagccagaagagagtgggggccaatattcaacattcttaaagaaaagaattttcaacccggaatttcatatccagccaaactaagcttcataagtgaaagagaaataaaatcctttgcagacaagcaaatgctgagagattttgtcaccaccaggcctgccctacaagagctcctgaaggaagcactaaatatagaaaggaaaaactgataccagccactgcaaaaacatgccaaattgtaaagaccatcgatgctaggaagaaattgcagcaactaacaagcaaaataaccagctaacatcataatgacaggatcattcattcataacaatattaaccttaaatgtaaatgggctaaacgctccaattaaaagacacagactggcaaattggataaagagtcaagacccatcagtgtgctgtattcaggagacacatctcacgtgcagagacacacataggctcaaaataaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactaccctaaatatatatgcacccaatacaggagcacccagattcataaagcaagtccttagagacctacaaagagacttagactcccacacaataataatgggagactttaacaccccactgtcaacattagacagataaacgagacagaaagttaacaaggatatccaggaattgaactcagctctgcaccaagcggacctagtagacatctacagaactctccaccccaaatcaacagaatatacattcttctcagcaccacattgcatttattccaaaactgaccacatagttggaaggggaagtaaaccacttctcagcaaatgtaaaagaacagaaattataacaaactgtctctcagaccacagtgcaatcaaactagaattcaggattaagaaactcactcaaaaccgctcaactacacggaaactgaacaacctgctcctgaatgactactgggtacataacgaaatgaaggcagaaataaagatgttctttgaaaccaatgagaacaaagacacaacataccagaatctctgggacacatttaaagtagtgtgtagagggaaatttatagcactaaatgcccacaagagaaagcaggagagatctaaaattgacaccctaatatcacaattaaaagaactagagaagtaagagcaaacacattcaaaagctagcagaaggcaaaaaataactaagatcagagcagaactaaaggaaatagagacataaaaaacccttcaaaaaatcaatgaatccaggagctggttttttgaaaagatcaacaaaattgatacactgctagcaagactaataaagaagaaaagagagaagaatcaaatagacgcaataaaaaatgataaaggggatatcaccaccaatcccacagaaatacaaactaccatcagagaatactataaacacctctatgcaaataaactagagaatctagaagaaatggataaattcctggacacatacaccctcccaagactaaaccaggaagaagttgaatccctgaatagaccaataacaggctctgaaattgaggcaataattaatagcctaccaaccaaaaaaagtccaggacccgacagattcacagccgaattctaccagaggtacaaggaggaactggtaccatttcttctgaaactattccaatcaatagaaaaagaggaaatccttcctaactcattttatgaggccagcatcatcctgataccaaaggctggcagaggcacaacaaaaaaaagggaattctagaccaatatccctgatgaacatcgatgcaaaaatcctcaataaaatgctggcaaaccgaatccagcagcacatcaaaaagcttatccaccatgatcaagtgggcttcatccctgggatgcaaggctggttcaacatatccaaatcaataaatgtaatccatcatataaacagaaccaaagacaaaaaccacatgattatctcaatagatgcagaaaaggcctttgacaaaattcaacagcccttcatgctaaaaactctcaataaattaggtattgatgggacgtatctcaaaataataagagctatctatgacaaacccacagccaatatcatactgaatgggcaaaaactggaagcattccctgtgaaaactggcacaagacagggatgccctctctcaccacacctattcaacatagtgttggaagttctggccagggtaatcaggcaggagaaagaaataaagggtaaccaattaggaaaagaggaagtcaaattgtccctgtttgcagatgacatgattgtatgtttagaaaaccccactgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattacttcaaagagaataaaatacctaggaatccaacttacaaaggatgtgaaggacctcttcaaggagaactacaaaccactgctcaaggaaataaaagaggacacaaacaaatggaagaacattccatgctcatggataggaagaatcaatatcgtgaaaatggccatactgcccaaggtaatttatagattcaatggcatccccatcaagctaccaatgactttcttcacgaaattggaaaaaactactttaaagttcatatggaaccaaaaaagagcccgtattgccaagtcaaacctaagcaaaaagaacaaagctggaggcatcacactacctgacttcaagctataatacaaggctacagtaaccaaaacagcaaggtactggcaccaaaacagagatatagaccaatggaacagaacagagccctcagaaataataccacacatctacaaccatctgatctttgacaaacctgacaaaaacaagaaatagggaaagtattccctatttaataaatggtgctgggaaaactggctagccatatgtagaaagctgaaactggatcccttccttacaccttatataaaaattaattcaaggtggattaaagacttaaatattagacctaaaaccataaaaaccctagaagaaaacctaggcaataccattcaggacataggcatgggcaaggacttcatgtccaaaacaccaaaagccatggcaacaaatgccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaataactcaaacaaatttacaagaaaaaaacaaacaaccccatcaaaaagtgggtgaaggatatgaacagacactcctcaaaagaagacatttatgcagccaaaagacacatgaaaaaatgctcatcatcactggccatcagagaaatgcaaatcaaaaccacaatgagataccatctcacaccagttagaatggcaatcattaaaatgtcagcaaacaacaggtgctggagaggatgtggagaaataggaacacttttacactgttggtgggagtgtaaactagttcaaccattgtggaagtcagtgtggcgattcctcaaggatctagaactagaaataccatttgacccaaccatcccattactgggtatatacctaaaggattaaacatcatgctgctataaagacacatgcacaagtatgtttattgcggcactattcacaatagcaaagacttggaaccaacccaaatgtccatccatgatagactggattaagaaaatgtgacacatatacaccatggaatactatgcagccataaaaaatgatgagttcatgtcctttgtagggacatggatgaagctggaaaccatcattctcagcaaactatcgcaaggacaaaaaaccaaacactgcatgttctctcataggtgggaattcaacaatgaaaacacttggacacagggtggggaacatcacacaccggggcctgtcgttgggtggagggaggggggagggatagcattaggagatatacctaatgtaaatgacgagttaatgggtgcagcacaccaacatggcacatgtatacatatgttacaaacctgcacgttgtgcacatgtaccctagaacttaaagtataataataaaaaaaaagaaatgcaaataaagattttgaagggaaaaaaagagcttctaatcatgcaaatttaattggaataggactttctttacccactgaactagaaaattgaataagatgtatgaaacaaatattatcaggcactgagacaataggcagtaaaagattgtgattcctatggaaagggaaatgaatggaatgagtaccaaatgagagcctggcttcttcctggaagcaatttccagtatgcagcacagggaggggaagcaaagcagtgcatgcagtgtcactgagtagagaaaacagagattatggtttggggaggatgagggagatggaatgttcaggagagggtactgaaaagaagggactgaggtataaaaaaagtcccaacaatactttaataataatttgtccttgcataacttgaaactccatgaggctggtcaaaaagagcagggagatactgcagttctaaccagacacagtagagagacctcactgaaatgctaaggataattcacacctaagtagtggagctaaatttggcactaaaataatggctattctagatatagtctaatgaaga

SEQ ID NO: 7181 - DNA, 1750 bp, artificial
  synthetic oligonucleotide
aactagaagatgaaatactgttctgtggttttaggttatttagattcagtgcccagtagtgtcagagactacaacttcagaatctttccacctcattttgctcactgttaagatgtagaaattgctgttgtaataaaattttgggaagttacataaaggaacactacaatattcataaatcctatatatgggtgtttctgaaatatatattctgggattttccttttttcagtcttgaaatttcacattatgaacaattaattaatctgtcaattgtctaaatgcaaacataagaagtgtgatacaaaattccttcttttaacaatcttgggagtttttcacaacactacggaattataatctagaacagacttggaaacaaattatgaaaatctgtaactcaatactgtattttctatgtacataagaggcaatgacagtttttttttaactttttttattatactttaagttctgggatacatgtgcagaacgtacaggtttgttacataggtatacatgtgccatggtggtttgctgcacccatcaacccatcatctacattaggtatttctcctaatgttatccctccccttgccccccaacccccaacaggccccggtgtgtgatgttcccctccctgtgcctatatgttctcatggatgaagctggaaaccatcattctcagcaaactaacacaggaacagaaaaccaaacactgcatgttcttactcataagtgggagttgaacaatgagagcaatgacatttttaaaagaatttttttaagacagtgtcttgctctgttgcctgggttggagtgcagtgattacagctcactggacagtttttttgtttgttttctgttttttttttttttttttttttttgagacagagttttgctcttgttgccccagctggactacagtggtgcaatcttggctcgctgcaacctccgcctcctgggttcaagcaattctcctgcctcagcctcccaagtagctgggattacaggcacgcaccaccatgcccagctaatatttgtatttttagtagagacggggcttcaccacgttagtcaggctggtctcaaactcctgacctcaagtgagccacccacctcagccttccaacgtgctgggattacgggcataagccactgcacccggcctggacagtttttaaaaagacagaaaggactcttcaatatatttcttaggctgggtgcagtggttcatgcctgtaatcgcagcgctttgggaggttggggcaggaggactgcttgaggccaggagtttgagaccagcctaggcaacatagtgagaccctctctccttccctcttgcaagtaatttatatatatatatatataaaatatatataaaaatatatataatgttataatatacataatttatgaaagttatacttttttaaagtaatatatgtgactttattaaaatttcttcaattttccctacctgtattcctctactcctttttataaatgaggaagcaggcctacaaagataacatgagttacccaaggagaagaccgacaaatcattcaagcctcacctcctctgtaatgatttccccaacttccttctcctactaggtggtcacacagtctctggatttctcagttaatgtactcactcattcaacaactgctgaccaaatattttactatgtgtgtctgttggttaccaagttacgcagaggatatgtgcatgagtgtgtgaataa

SEQ ID NO: 7182 - DNA, 4143 bp, artificial
  synthetic oligonucleotide
tatctaaaacttactttgtcacttcatgaaaggcttccatttaattgacagtcatgcacaagctcgggaatgaaaaggacataatcttaggaaaaccaaatgattttacctaaaagccagtcatcagaaatctgcaaaacacaattagagtgaaaaagaaatctactttgtttttaccctaaatatgttggttctgagatagatttacagagagatagtataaaattactagtatccacagaaaagaagccagacctagcttttcagacacatcatgaattgactattaaacataatattcattttgataagtgctttaaattgtttctctgttatagccacatgtgttcttagtcctcagagtatattggcattttacattattgatcctcccccctcttttaaacttctgtgcagcccattatcctgattcttctaactctatgagttatactccaaaccacgagccctagagcagtcaacccccaagaacttgttcactcagttttacttccacacagatgactcccaaatcttcactgccattccatacctctcacccaaattccagctcagcatttcaagcaatgtaaaattacaattggcttgcactcaatccaaagccaaagtaacaatccatatgacagaatactgggcagcagctaaagaggagatagagacagacagatacattgatggatatgacaagatcatcaagtatatactattattcatgaaaaatcaatatttcagcatagtatacaaatatctcacttttaaacaaaaagcttccagaaagatggagaagaaactgaacaatggttacctctagagaatggggatatggatggtaggagaattgagacagactcactacttatctttgtatcacctatattttaaattgtatggctgggcacagtggctcacgcctgtaatcccagcactttgggagaccaaggcaggtggatcacctgacgtcaggagttcgagaccagcctggtgaaaccccgtctctactaaaaataaaaaactaggctggacgcggtggctcacgcctgtaatcccagcactttgggaggccaaggcgggtggatcacgaggtcaggagatcaagaccatcctggcttacatggtgaaaccccatctctactagaaatacaaaaaaaaaaaaaaaaattagccgggcgtctgtagtcccagctactcgggaggctgaggcaggagaatggcgtgaacctgggaggcggagcttgcagtaagccgagatcgcgccattgcactccagcctgggcgacagagtgagactccgtctcaaaacacacacacacacacacacacacacgcacacacaaattagccaggcgcggtggtgcatgcttgtaatcccagcttgttgggaggctgaggcaagagaatcacttgaacccaggaggcggaggttgtagtgagccaagatcgtgccactgcactccagcctgggagacagagcgagactccatctcaaaaaaagaaaataaaatttactacgtgcatcattacttttataatttactgtataaaaactaattaataaagaaaagtaacacaaaattattaaatctcaatgttggaaataaacattaacttcaaaacaaactagcttcggaaatgaaattttcccagggtagaagtcagagactctatactgacttgggctctacaaccaataccatagtggctccaggacagaaaggaaggagagcaagttctgtagcatcttaaatcccacagcataaatccagagccatatttggtgcttctagaatcttcactgtcagttgcaactaaaaaataaaaccaaaaaatgtgagaacagcacatcccatcagcttgttggctggggtccggtacctgctctgcaatagttaactcagtctcttgattatttaaggtgtacagtgctggcaaacagctagaagctcacagactcagcggctgcagctcactacacggttttcagaatcagagagaacaatctccgtatttttatcacaggataaaggaataactatcctttggaaaccactccaccccacttccaacaaacatctacctctgaaaccttattacttctggtttggcaagttaggggtaattaatcaactatcctgtctgttggggcaagggaaatggaagaaaaaatttggagagtaaaagaagtagagaaagttccaaaacaaattatattttggacagatggccaagagtctatatttccattgctagatttaccagttagtttggtaacaaatgctgatgtttcattaaagagaaagacaaaaataaaaaagaaacagatgaaagaatgaatagtatatggaacctctactgaagaaataagaaatttaaccagaaagtcaaacaactaaaatttgcagtatagaaactctgaaaatgaagacgtgtctttaagaaaatccaacacagtattttcacaacttgaattagcagcagaatgcagcatgaaatgaacagactttaaaaccatggaaccgcgttggaatctgtgtgatcttaggcgaattactgatcaccccctctgaatctcagtgttctctgtaaaatgggtatgattaaataatacatccaaaatgcctaacattagagggataaatgtcaatccctttataaagtaagctttaagttatagaagttttttaaacaaccttatgtcaaagttcctttaaatgcagtgctcctaccacatttaaaatgtgaaaacgtttaagaaaatgtaataattcaagaataatctcaagaagcaaggtatatctgctccttcaatttattgagtagaactacagctggagacagaattttcagtttaaaggaaatatccaggtacacaatttagggacacttgagacgtagttcatcaggtgaaactgttgcagatacaaggaaaaaatggagagagctgaactgcgtatgtcaagtacatagaagcgtgttacggacataaaaattaagggagtccacaggaagtatttatgaagacaacttcaaacaacacaccctaaagcaatctgtaaaaagcagacaggaagagactagagaaggttgtatacatgcagaaaagcaacggagtagctctgttctccctccaaatgatcctaggatcatcaggaatcaatattgcttccccactcccattgaggcctgctatctgtagcatccacaccctgagttcaaaaggattttcctctgtagaagtacagcttaactcccatggcttgcattctttctgggccaccaacaatttagctgctgatcacttcttttaccttgttacttggctgtcactgtgatcatgcactgctttcacgatcactggtatttctggaatatctactcatttctggaaaattctcggttccttcaggcaaacacttgatcttttcctaacattaaaaactagtttacctacaaagtctagttaaaatttccgggaaacattttttcaacacaatgcgaaattctccctatggtactagaaacccaaatcactgcatgaatcaatacatgtgaaagtcatagtaattagtacaaattagtaaagctgaatttttctgtatgctgaattatatactttacgtattattaatccagtatttacataaaggctgcattaactcaattctccagctaacagcattactggaatcacaagtatgtaatttaaagcatacaagcaacttaaccatactcttttaatagagtgtatgtacaaacacaatccatactaaactgataaatttcttcatattaaatcaagccattatagtggaaaaccatcatcaactgttattgaagcaatccttgttctgtgttgttccaaacgtcagacaatcgccatgttagcattagatgagtgtcataaatcaatgtggatcttaaaaggcccaagaaatcaaagccaaacacaagctaaaactaaatttttacacaataaggctgagaaacacaagtgcatagaagataaaatccatgttttagccatttagcttcaataccttccaaaaagaatttattctactttgtaagaattgtaagcctctgaaaagccagtcccaaaatattacatacataatctaagtttta

SEQ ID NO: 7183 - DNA, 3573 bp, artificial
  synthetic oligonucleotide
tctagcgatccttattaagcaaaaatttgctcttaaatcttatctcctcaacttctaaagccgcagaatacacgctgtgttaggaaatcaacttcagattgccagcatttccttcacaagcaaattagcaggattgtgcacttggagtactgtttgacaagaatgaaaaggaaactattcaaaatagatttaaggaatggacaattagatgaggaactgcagatttaattctcaatcagcactgtgattaatctgattccctgcttttccccagcgtaattatacaacacagatgaaaggatgagcatttggactgtcagttctatattctagaccagcccggtgactcaaagcagacggctctaccacgctaaccaccatcccaacaacagtcgaggggagtctcgagcactgattgaacagtcattgcataacaaggcattaaaaattcgaatgcccccaactctttccacgttcgtgtacaccaggagggaatttgctgaaactgaaagcaccccgtcttaaatgaccccctccaatccgagcatggggtgtacacaaaggcatctgtctaatatcccgcacaatagacacacaccccacaattaaaaccctggactctctcaccacacaagcaaaggaaatgcaagctgctctgtttcaaaaatggtctatggtacatgcaaggtaacaataaccccaactgaagcaactataaaatcggctgtgccacgtccctgtgcaaccgtcagataaaatgcaggcagccggccccacgccttacggggtggccaacctcggctcggtggcctcaatggaccgctgagaacccccaggcccccgcctggcaggagctccaggtacacgtctataaatactccaggatgagaaggacgagaggggaagaggggaaggagggagggcagggggcaggccccgagcgggtgcgggaagaccggggcatcactgaaatgcatttttccacactcccgctccctcgcgtggagactcactttccgatcacctcgcacagctcgtacacatcctcgaacagcacgtcgtcgtcggccatggtccggaggggatagcggccgcagcgtggagggcttcgaaaacgggggtgggggcgcccaagagctcagtgcccagccccgggatcgcctcctcccctcaggacccgcgagccctcggtgccgaggacgctcgagtggggccgcgaggcccagagactgcggcgccttcctctgcaggcgaccgccccggcgcgggcggcggggccggggcgcgggagcgagggcggcccgggcccggcgccgcccgcccgcccgctgcttctcgcgctgctcgggccgcgctgcccggcgtgcggatcctcggggaccgcgcggcgtcgcgctctccgctcgtcagcccgcgcgggccgcgaggccgcgaccgctccctctgtccgaggccggctccgtcgcgtcgcggagcagctcgggctacagagggggccgcggcaggaccatggagcgaggatcgccgcggagggaggtggcggcggcggcggatcggcgctggggaccaggaggcggcggcagagacgctccctcctctttctcctcctcccgcagccgccaccgcccgcccgggagtgggagggggcttcgcgggaccggcgctctgtgcgggcgggagccgcggccgccgccttctgctccgcccctacgcctcagcagccgaccggctcgccagccccgctcacccgcctcgcgcagacacgccctcctcccccgtcggcggcgcggcttccagaaccacaggctccgcccactccaaccggtcgggaggcggtggcccagggaaaggggagcgggccgagcggcgcatgcgcggggcgccggccgcgtcacggcgaacgggcgggcaccgggattctagagggcgcggggggttgagtggggcgcgccggctgcagctgccgaggcggggctggttggggtcgtcgcctccgcgcctagccgcgaccaagccgcgaaaggggctggagacaaaaggtccacggctgcacgctcgttgtccggcaagaggcacgaaactctggccgctcccctttccttcttttgtaatcgcagggagcctttcccagttttttgctgggaaaagaggcagggaaagggtgctaatgaatgagaaagctaaaagagaggtggagagaggttgtcactgaatccgtgcttggcagcggatgcttttagtgctaccctgtcattccttaatgaagatgagggctgggggtaaggggaggtcgtccaagaaaaggactaaacaaaaactgcctaggaaggtgtgcgacagcaaacggtcatctatagagacagcttctcccacgttctgccccaaactcaacaaatatctatccagcgcctaccctcactagagaccaacctagagagaagctaggaaggcagggacaaaccgtgactttaagctcatttgtatattgtcctcaaactcccaggacctactctgctctctatactccctataaatgttagacttgtcaggaacagaatgcaactagagggagtgcaggcacaggagcagccagggagtgaggttctgggtgttgccgctgtgctaggttgcattcaatatgaagatttctgttcaactgagcatgtgcggaatgagccagcgccatcagacaggtatatgcctcagttgaagaccaatagtgtctttgttcctccgcacagcaaaagtgcccaattagttcataagtcagtttccagaaatcgtctggtaaatttctcagtgcagtattttttttaaaaaaagtatttattaataccaaagtggagggggtgatgtggagactcacagcctattttctcttcagaaacgtttcgtgcaaacccttgaccactccctcaaaaggctgagagatttgcctgctaaggatttgggtactaaaccttttttttttttttaaatgcagatcagaggacaagtgtaattgcacacggttttcctcctttctcaaagagcttgtgcattctctagagacgggggcttcagaacttgagaaacattgcctcctttaagggtccaagagttactcaccacaagttggcatgtccagctcatgtctaatgaataaggcgtcactccattctgccctgaagtgcacagggaccctctcaagtcaccttgtcagcttcacttcttttccccagcccaagactgagctataccaagccttgtcgacttcattttggggtttgttgtcttctacagggacctatgctcagaggtagaaaaggacaatcataaagtaaaacagaaaagaaagtgcaggtgaaaaaaagagagacagacgattgcaaaaataagtaagtgctctgctcataggatcacagttggtttggatctggaaagagactccctcacttacagatggaagaatgtggtggttgctctcccaaaagccatcccacccctctcccccaccatggggtagcagctctggacttgaggtgagattgtaaccatctttactggagaggtgggctctgattaattaaacta

SEQ ID NO: 7184 - DNA, 422 bp, artificial
  synthetic oligonucleotide
caacataaagtttgtaatagcaaatgaaagtgaaaaaggagaggaactgctgtggggagacataccgattgaccccaggcaggaagggacattggacaagaggttgccagccatcaggagacaaaaaaaaaaaaggaaaagaagattcaaacattagtttagcactgtagtctagggccacggattgcagaggtaaatggccctatggattttgaaagaaccgtaaggtatcactcattggagctgcccagtaatgaatgtgcataatgactacgacaagaagaaaaggtgccttgttcaggaaggaggaatgaatgtaacacattttagacaggatagtttaggacaagcaagtgtgattgcttataacaatcaacccttaagtcccctggagagggcctggcccatctctagggtctttt

SEQ ID NO: 7185 - DNA, 1963 bp, artificial
  synthetic oligonucleotide
agcaaatttctagatggcacatctactcctggttgttaacttgatagattaactgattaggagtttctaacatagatgtctgtatctagcaatgatagatggtgcttatgtttattattctttattcttaaagctattgattctttaaaaactagtttttgatggtttatctttcctaaataagagaatgaaaatgtcaacacacaggcaatctgcttttatagtggtctattagcatctagttaatagacttcgactgttgtctacgtacctcactgttccctttggagctcaagggattgtacaattaatcctcctaacatccatttacacttgattaagaacaggtggtagtatcttcatttcacaaataagactcatacacgtaaagaggttaatgatttgctgacaagccagcaacaaaaccggtcctcatggcagctctcccagcccagcattctctgctccacaccatcacacttctatctctgcagtcatactttcagtgaaactagttttcatcattaaccacatgcttgctttggggatgaaaatagaaaaccagacaaagcagaccttttataatactgtttttaccatatcgttaaaatagtcactggtcaatgtttgtgtttataaaaccatttttcttaagactttgtcccctcttttgttcctctatgtgaagatgttagaaagaaatgaagtggtctatcatatttttatttttgacaaatgcctctggaatgctattattacaatatacaattttaaggtgaagggctgatgtgggattatcctcctggtaacattaacatagccgaataccaaagaaaatattttttattccatcagtatttcatgaagtgagcttcctttgtagccatgtttgctgctggagacactgagagagtttatacagtcatgattataaaacaagtcttagaatttgaggaaacatcagaacacctcaggaccgcattgtgcaatttgagtagcccgaccgtgttttaaattttaaaatggagagaagtaattgcaggcctcactttgaagatatcaaacatgaaaatttcactcaagctgtcgttcctctttccagctggcagcatcaccaccagaatcacaaacaacagcaggtaattttagcagaatgtatctcatccaaaagggaaaaaaagtttagttggaccaacagacaagtatattcaataatttagcaacaattaacaaataatgtgacatcagttctataaagaatatttgaaaattgtaactgaacgtgggaaaatgcaaattaactttgttgggaaaaattgatccaaaatacagaaaactcatagttgtctaatagagtcaggagatggaatgttcttgtaaatcaacattttgattaataaaggtagcatggcattacataaagaattttatgcaattatgtttcagaagatcaactctgcttctgagatagctgggtgacatttgtccattcatttgacctcaccaaattagtttttttttcatctgtaaaatgggatagtggtgggaataatgcatactttttctatctcacaggattattgtaaggaacaaaagtgattgtaaatacaaggttttttcaacaccatccgcagggggtcagttttaaatgattgggctagaataaactgtgtatggcatgaaagctaaactgtatgtaaatatctctttggtaaagcaagcgtgtagcattaatgaatgtcagtccacaaacccatgcgtgcaaaaaatgaccttttgtaaatttttctaaaatgccactttcatcattttttggtttgccttccctaaagcctatttaattcccatggctgggatcttacctcgagtcaatatactgtgtatgtggaagtgtccatctggtgctctgtgattggtccacactgagacatactctaaccttgaccatgtggtgccctttggt

SEQ ID NO: 7186 - DNA, 723 bp, artificial
  synthetic oligonucleotide
aggatatattaaagttatcattttaaaccctaaggaaagtatacatttagatttagtcacatattcttcccagtgcttttaatttcttcttgaattattctatctgagattattctccttccatctgaaaaactctgtttagtatttcttttggtggagttttgctggaattgtcttatttttatttgttagaacatttagtttttgaaatagtttcactgagtgtagaattctgtgtcggcacttttctcttaaatcatttaaagatgtcattccattgtcttccggattctacagtttctttgcaaaagacagttgttggtgttattactgttttgatggttatatgtcatttttcccctctggaatctttaaatgtcttctatttgtgttgagtttttaggaagcttattataaagtatcctgttaggagtctatagagattcttgaattgatatttttattattaattttttttttagttttgggaaatcttggccagtgtttctttaatcattgtttttgtttcctctctcttcctgggactcaattacacatcttagatccttcaattttgtcccatatgtttattttctgcattttacatctctttattttctctcaattatggatattttctattgatctatttttcagtttgccagttctctcttctactaccaaattcatctattgaattcttcgtttcaataaatgtgtttt

SEQ ID NO: 7187 - DNA, 667 bp, artificial
  synthetic oligonucleotide
gcttcaatatttagtgtatttgaatactgccttctcaacaggacaatatactgcattcttttcttggataattaaaatgtactaaatgttgtgtttgggcagtaaaacctaattaaacaccctgatggaaaataaggctcagggtcctgtggcaggcctgtaacctttaaaccagaaggcaggggagcccccatatgtgcatccatggttttggtcatttagaaggacatccaattttgcggcttcttaactggctgccaaaagagggatgggatggatgttatgagcactatctagcttaatgcaatttaggaaagttacctcctgagctataatgaggagttccccctacctgtttagctcatgcccgcagagaacttgattgtgattctgggccagagcaaaggcttgacttgcaactcctcctgatccacttagctgctgaattccctttctgaggggcttttccttctggtgccaagcttctgttttcagagcagagtcatctgatgtttcacacacaggctttccttgcttctctttctctttttcagctcacagtagcccaggcctttgggaagcttctataaaaggccttggagaagttccagatatgtgagtgtggcaactcagatcggaaaataacactgggacccaaatgctagtt

SEQ ID NO: 7188 - DNA, 1241 bp, artificial
  synthetic oligonucleotide
taccaacttatgttcaagtggtggggcctgtgaattaattgacaacaaatacaatatgagaaaagtttatttcacacgcatgtggggacactcaataagagttggcatgctgaacagccagtgctacgggtttatataccagcttaacaaaaaaaggggttgtagggcttcaatgggaagttatggaaggctctattgggcttattcatcccaatgctaattgacagtctccttccaggtggaactcccatctcccatccccctggggcaggggaaaggaatttgtggcagctgaattcatacctcctggtgctaagggtaagtaatctccagaacaggaaactcccttagggttaatggcagctgtattttcaggagctctgcctaagtttagataaggcttctttctgtggctgctgtttgttcagatgttttcagtttaaagtaatcttcatgccactctgttggtcccctctctctctctctctctctctctctctctctctctctctctctctctctctctcacacacacacacacacacacacacacacacacacacatctatttaaaatctatttaaaacatctatttaaaatcagaggtagaataacctgagggcacagggactgaaaagaggtcatcagggtttaccctatcttcctttccatctttctgtcaggctccctccatgtgggaggattagtggctgaccatgaccagccccaagctcatatcctcccagctaggcagctccagcaaagagagcaccttcccatcactgctctggcagcagagctccagagaggatgccactttacctaattgattttatgtgaccatgtttgactcaactgtggtcaaatggaaggggtcctctggggtgcatgctgtcttataggtatgagaccatgtggaatgggtattccacagagttctgttttgagaagagaggggactccaggcaggaaaaaaaacaggttctccctctactattctgcctgtctcctttgcccttgaatctttacctctattttaaggaactctagtaaaatactaaatgtttctaagggaaatggcataaaatcagtgagatggaataacaactgaaatcatgtttaatgatttgttttccccaaacctagtgattcttgtgtaagtctgaatcttctctcttgagttttgtgctgagcttttgattttgatttgatgctgagacatacaataagccacttcacct

SEQ ID NO: 7189 - DNA, 1511 bp, artificial
  synthetic oligonucleotide
tataataaatcacacattggggggcctgatgctttagctcgaggccctagattcgatctgtgcttgtttcctgtttcctttcccagcctttgtttttccataaagggatagtgtcagcttaagaagcagctccaccattggcttatgtggggctgctctgttatgtgtgagcagatttttgagctgtattttagaagggttgggctaggagctacagagaccttgagattgaactcagccccaccagccacagtgacaggagcagtgaggctggagcaagttgactactactttagatgttatcctgtagcctgtacaggggtgagccttccagccatgaagtattccctgctctctggactttgggttttagaatatagccatatgcaagaactgtatactgccagacaaatacagaagcaggttaaattaaagggagatgagcaaggctggggtattataaaatagagaggattggcagagaacttcatctagaaagtgccctctcctctttaagttgccctctggtcaggtccatgcctttgtgtgcatcatgagttggcaaagggcccaccatagtgcctggcacatcgcaaaccctcaataaatgtttgaatgaagacccaacacccaaacaaagacaagacacccaagacctgtctctagttagagacctcatatttttattccttttttgtttggctagacttcttaagaatgtctagagaattatgctttgtttcaaccatttttctttgagcatgttaggcaaaagtcagttaggttaacccatcacatatgtgctggtttctgcttggtgagtcaactgaaatgttcaaggagcttcttacaatgcttcagacccaggaaatgttaccgactactctggaaccctgagtagcaggcagaatgagtttaagcagtcagagacccctgtcatattagtggttgatttaatgctaccagaatggtcaagatgcagtatggctaattttttgagtctcagcctaggaaatggtagacaggtagaggtggagggttggagaagaatggaatagaggactatggcatcttaaaacttttgtgattgacataaatgattattggttaaaaatataaatgtgttagctgagttgaatttagattcctagagggggccaagaaagggtctgtttcattggtcacatgatccatcatgattgttgagcagctaccatcctagatacccaccactgtgtaatgttcttccacatttagagaagaatatgaggtgttgccttcaaggagacaaaagtgtgttttgtcttaccaaccagaatcgcaaagtgtcatttcgttgttggcagtagaggaagataatatggaggtatactatggcaaatgccttggcacttatcaattctgtacatgttcttccgactttcggctgccaccaaatatgactctctgtttgtgggtgttctccaaccatggagcatgtcagtgctaagtacttaacatggttcaagagc

SEQ ID NO: 7190 - DNA, 815 bp, artificial
  synthetic oligonucleotide
tggtatttccaacaaggtaatgctgatgccaaaggtctgggcatcaccctttgaagacaactgatttaaggtttcctattatattagtagaggctcaattcgaacttcagcaaccttaaaccacttactgtatttctgagccaaaaggataaagtctagggaaagcctagaaactgagttcagcaaccctaaaccatttactgtacttgtgagtcaaaaggataaagtctagggaaaaagattccagtacattaagaaataagctttaacagtagagtgaaagaaaacaattggtaggtttaagcacatagatggtaaggttaagtggtaaaaattactgtcttcaataatgtgaatatttttgtttatttaataagactgactccagtgatttgcagagaagctagacttcacaccttactagtgaagggtggccactcacaacataggttagccacctctggaaaggggggacagactcttggggccacattctatgatctcctgatcagctatggaggcccatagtctgagataaaaccacaggcccaagtgccctcttatggtggtggtttgggatcaggtgcccctctgacttgtgcattttttaaatagactttattttttttagagcagtttcagttatagagcaaaatttaggggaggttctagagatttcacatatattccctaccccaaaacacatgcatagcctcctccactattaacattctccaccagagtagtacagtgttattattacaatcaatgaacctacattgacacaccattatcacccagagtgcatatagtct

SEQ ID NO: 7191 - DNA, 415 bp, artificial
  synthetic oligonucleotide
ttcataagcatagaataaggtggagggctgagactccgcatatgacaataaggagaaactgtactttttttccaagttcttaggggcagtcacacttgctaccatgtactaccatccatgggatggtagatccttaagacctagaggtctaatgttaactttctcacacttttgtctttgattaggcctctctagcacataacatagtgagactatgattatatgatatcagagattcttaaactggctatgttgaataaaagattttcaagaaattgatgagtcttaggagcaaaagcattgtatgtttctgataatttttgaaatatgtggcttacaccaaataagactcccaatgatttttttcccctccctgtatatgcaggctactcttcacatgaagactttgcccctc

SEQ ID NO: 7192 - DNA, 724 bp, artificial
  synthetic oligonucleotide
actttcggtaattatttttcaatttttcttgtatgaatatttttattatcttctcctgggactcactgacacaaatgttagatattctgatattgtcccatgcctgcatctctgttcacttttgaaaatctttttctctttgttattcagatagataatttctactgactcatcttcaagttcgctatttctttcctttgttattttttttctgtcgttgagctgaacagtgaattttaaaatttaagacattgtatttttcgattctaaagtctccttttaaaatagtttccatatctactttgtgaacttctatctttctatttataacaagtgtatttacctcatggagcctagctataatagctctttcaaagtctttgataatttcagtatctgagtcatcttggtgttagtacatgttgattatatttttctgtgaaaattggtcatattttcctagctgtttgtatatgaaataattttggaaaatattctggacattttgaatatcatactgtgaaactgaatcattttaaactcatctgagaaatgtagatctctctctctctctctctccccctctttctctctgtctcctctgtgtgtgtgtgtgtgtgtgtgtgtgtgcattttagaccacaagttctgtctcatcctctgtcagcagtaattccaatgtctgttcagttttcaacatctttggtttgtttctttgagtctg

SEQ ID NO: 7193 - DNA, 4082 bp, artificial
  synthetic oligonucleotide
gtgtgtgtgtgtgtgtgtgtgtaaaataaggctgttttctgcctccctccctcggcataaatttatcctcaggaatgaagagtgttggaatgggtcagggcaggatacaccagttaatcttgaggattgaactttgactttgtaaagcatattcaaaagattctttttctttaattaaaaactactgaagtataattggcactcaataaactgcacatgtttaaagtgtacaatttgataagttttgacatatgtgttgtccatggaactatcaccaaaatcaagataaccatcatatccattacctccaagagtttcttctttctacttgctaatctcttcctctcatattttccagtccccactcttgtccccaggcaaacactgatatgtttctgtcactataaacattacattttctagaattctatagaaatgaaattatactatatgtactccttcttggtctggcgccttttgttaatacttagcataagtatgtagaaattcgtacatactgttgtgtgtatcaataattcatttacttatattgctaaatgatatttcattacatgaatatgccccaatttgtttatccattcacttgtttgtttgtttgtttgttttttattatactttaagttttagggtacatgtgcacaatgtgcaggttagttacatatgtatacatgtgccatgttggtgtgctgcacccattaactcttcatttaacattagatgtatctcctaatgaaatccctcccccctcccccaccccaagacaggccccggtgtgtgatgttccccttcctgtgtccatgtgttcccattgttcagttcccacctgtgagtgagaacatgcggtgtttggttttttgtccttgccatagtttgctgagaatgatggtttccagcttcatccatgtccccacaaaggccatgaactcatcattttttatggctgcacagtattccatggtgtatatgtgccacattttcttaatccagtctatcattcttggacatttggcttggttccaagtctttgctattgtgaatagtgccgcaataaacatacgtgtgcatgtatcttgatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcaaaagtgttcctgtttctccacatcctctccagcacctgttgtttcctgacattttaatgatcgccattctaactggtgtgagatggtatctcattgtggttttgatttgcatttctctgatggccagtgatgatgagcattttttcatgtgtctgttgactgcataaatgtcttcttttgagaagtgtctgttcatatcctttgcccacttgttgatgggattgtttgtttttttcttgtaaatttgtttgagttctttgtagattctggatattagccctttgtcagatgagtaggttgcaaacattttctcccattctgtaggttgcctgttcactttgatgatagtttcttttgccatgcagaagctgtttagtttaattagatcccatttgtcaattttggcttttgttgctgttgcttttggtgttttagacatgaagtctttgcccatgcctatgccctgaatggtattgcctaggttttcttctagggtttttatggttttaggtctaacatttaagtctttaatccatcttgaattaattttagtataaggtgtaaggaagggatccagtttcagctttctacatatggctagccagttttcccagcaccatttattaaatagggaatcgtttccccatttcttgtttttgttaggtttgtcaaagatcagacagttgtagatatgtggcattatttctgagggctctgttctgttccattggtctatatctctgttttggtaccagtaccatgctgttttggttactgtagccttgtagtatagtttgcatgatgcctccagctttattcttttggcttaggattgacttggcaatgcgagctcttttttggttccatatgaactttaaagtagttttttccaattctgtgaagaaggtcattggtagcttgacggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatctgttgtaacttggattcctaggtattttattctctttgaagcaactgtgaatgggagttcactcatgatttggctctctgtttgtctgttattggtgtataagaatgcttgggatttttgtacattgattttgtatcctgagactttgctgaagttgcttatcagcttaaggagattttgggctgagacaatggggttttctagatatataatcatgtcatctgcaaacagggacaatttgacttcctcttttcctaactgaataccctttatttccttctcctgcctgatttccctggccagaacttccaacactatgttgaataggagtggtgagagagggcatccctgtcttgtgccagttttcaaagggaatgcttccagtttttgcccattcagtatgatgttggctgtgggtttgtcataaatagctcttattattttgagatacatcccatcgatacctaatttattgagagtttttagcatgaagcgttgttgaattttgtcaaaggccttttctgcatctattgagataatcattggtttttgtcgttggttctgtttatatgctggattatgtttattgatttgcatatgttgaaccagccttgcatcccagggatgaagctcacttgatcatggtggataagctttttgatgtgctgctggatttgttttgccagtattttattgaggatttttgcatcaatgttcatcaaggatattggtctaaaattctcttttttggttgtgtctctgccaggctttggtatcaggatgatgctggtctcataaaatgagttagggaggattccttctttttctattgattggaatagtttcagaaggaatggtaccagctcctccttgtacctctggtagaattcggctgtgaatccatctggtcctggactttttttggttggtaagctatgaattattgcctcaatttcagaacctgttattggtctattcagagattcaagttcttcctggtttagtcttgggagggtgtatgtgtcaaggaatttatccatttcttctagattttctagtttatttgcatagaggtgtttatagtattctctgatggtagtctgtatttctgtgggatcagtggtgatatcccctttatcattttgtattgggtctatttgattcttctctcttttcttctttattagtcttgctagcggtctatcaattttgttgatcttttcaaaaaaccagctcctggattcattgattttttgaagggttttttgtgtctctatttccttcagttctgctctgatctcagttatttcttgccttctgctagcttttgaatgtgtttgctcttgcttctctacttcttttaattgtgatgttagggtgtcaattttagatctttcctgctttctcttgatccattcacttgttaatggtcatttgggttgtttttagtttttggctattacaaataaagtttctattgaacactagtatataaatctttatttgggtatattttttcactttctttgagtaattattaatatagtcactccagctttttttagtagcattagaatgatatattttttcccattattttacttttaacctatttgtgcatttatatttaagcatgtttcttataggcagcatacaatggaatttttttattctaatctgacagtttctgccttttaactggaatgttcagaccatttccatttaatgtgattataaatgttgttaa

SEQ ID NO: 7194 - DNA, 838 bp, artificial
  synthetic oligonucleotide
tgggtatagaggcaaattttgacacctcaggaagaatgagggactatgcataaaagaagggccagagagagaggaatgaggatactcgcaagaaagaaatcaatactcagcaaatgaaagtattaagagatcatattgttacacctaacttctttactacaaaccaaaagaatatctgttacctctcaacctgataattaaaaacaagaaaataagtgaagtacaaccacagcagaaacaaagaaacaattaagaggcaaattgtcttgtggtctcaattactggcaaggtgacctaagagaggttcagagcagaaaaaatacataatgactctttttaaaataagccaagcatattattttaaatgaaccattggaaataagaaaaaaattgatagcataagcaaaaattgaattgcatggtggagtttaagaacaaattaccatttgtttatatttcagtcccttttacaggaaggtcagagaactccatactgtattaaaatgcaatttttatgcctaggagtctaatattgctgcttatataataatcctctttaagtggaaaagacagatcagcctagctatgggcttcagcacagtcaatgtttgtctcacaaaaacgtccagacttcctgaagattttccaaccattctgtgttttgcctgtgaaaaaatactggttatggaaaatctattccttggagaaatgagactaaccaaaagctgtttgctttgctatcaattctggggatcatgttatagatttacagctttgcctttttggggtatatggaagagaggggaaagacagagaagggaggtaaatgctattttct

SEQ ID NO: 7195 - DNA, 684 bp, artificial
  synthetic oligonucleotide
aacaaatacatgtgaaatttgtttaaaagagtcactatatatatatttcatgggctgttatgcaatcataaaaagtgattacaatgagtttatgaaaatttgaagaatgcttataatttagtgttaagtgaaagaagacacatactttttctatttcctctctgctgttgagtagaaagtttctcttccattgataccactttaaaactgttatatcctgcatttaaactatgtttttttatctcaacaatttaagatgctaaaaaggtgttttctgtgtcagttttacttacttttaagatgattcttatgttggatatgattcattcacattagttttctctaggaattggacagaatggttcactgaaactttgactggaacacagcacagtagcaggttaaaacactgtcctactgtgcagtggtttacaataattttagggcttttaaacactcctggatcattgccttaactgtatttgctgtagtaaatgcaataagattttacttaaccaccaaagagattttgcctcaaggtcatttcacccataaagccatcaacagtaaagctcaagggcattctggcagggatatggcaacctgctgttgttagctctggtaggaagagctgtacttcaagctgaacttcatcattaactggtcagtccccacgttatttga

SEQ ID NO: 7196 - DNA, 1918 bp, artificial
  synthetic oligonucleotide
gcccctccccgccccgccctcaacctagtgagggctggaggctgcgcagacctcgacgggccctacatgacgtcacaaaggggccagaccaagtggggcagcaccctgcgaccctgcgatcctgcctggctcagccgccttcatatatctgcttccttaagtccactcttgcccagatagctttcagttaaaactaaagaatgaaagcactaggttgagagcccacgcggctacacccacgtctactcccccactctcgccaggcaaccgcgccccccgcctgcagtggcatcgtccggccacgcccagtggcagggtttccagcgcgagcctgcaggcaggccgggaaggcggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccgggggcacaactgcccaggtcccgaacccggactccagcttggacgacacctcctacagcctgtccgaatggagcgtccgttctgagtggcggtccgtctcggatccgctagccagttcccagtggagcacgtcctcaactgccgaggccgcctcctggagctccagcatacactccccaatcagcactaccggtcttagcgagagtactgactccgactccaagagtggcctccggggtttcagcgcttacaacccgagcagtcggatccccaagtctaccaccagctcgaactcctccgatggggccgtcacagcctccaatcaggacaccggcattccctgggtattagtaacaggacctaccccgcccgtaaactcccccgtagagtcattgcaagggtctgccttctcctcagggttcagcaccccacggggtttggtaaaaggaccgaccctgcccccggattccaacctgacctcagtgtccgactacacttggatatttgtacggggacctcctatacccaatgacctttcgcaagtgtcaatacaagcacctcctacacccagtaacacccccgagtgtcagtacaagggtctgccgcatcctcagtgtccagcttcccctggggtttggtaccaggaccacctctacccaataacatttccccagtgtcgccacaagcacctcctgcaccccataacatccccccagtgtcaaggcaggcgtctacccccacctcagtgcctgacactccgcggggttcaatacaagaacctcctgcacccagtaatcctttccagctgccgacacaaggacattctaaacctaataactctcgccgagtgtcagtacaagggtccgccccgctctcagtgcccagctccccccgggtatcagctgaaacatcagctccgcccctgggcgctcccggagtatcagcaaaagggttcgccccgcccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggtcagtgtggaccgtagcggtggcctgggggaccctggccagtgaggggtaggggaaccta

SEQ ID NO: 7197 - DNA, 297 bp, artificial
  synthetic oligonucleotide
aacaagttgtgatacaatcatatgaactaatgttataaaatcatgaaaaaacatttaagacataggtaaacattcataacatgttggtatttatttttaaaggggatacaaataagtacagtaaatacaacataaagtttgcataaagaaaatataggtggcaatagtaacagtggtaaatattttatggagttcaattatggatgattttcattttctttttgccattttctataatttacagattttcacaacaaatgtttattatttctgcattcatgctattaaaaaagatac

SEQ ID NO: 7198 - DNA, 1168 bp, artificial
  synthetic oligonucleotide
tgctcccttacaaaattttaccataatttatctgagacagccttcctgtgacaaattctttatgctgcttttactttcaaaaagtcatttctgaataataattatagctgtcaagagttccagcatcacataaaagaatctgtttgttagttattttaatgtcagttcgctggctgtgagtaaacgtagctaaacatatccacatgcttggtatctggactttgaaatcggtaacctttagcagcaatggcaaccttagaccaaaatgacaaggtaaaaaaaaacatcaacaataacagaagatgtcccaggaaaagctgggcttttctactttccaaagtaaattcttccccagcgtgcaccaaacactgacagcctgacacgcttgtgtatgagggcccactttttcccactaatgctgaattgttggaaacccaaacagcattgagagccaagggggaaaatgcctgaatctgaaaatgaaccaaaagaaattgtaccagagaaaggagatgggaactgcaaagaagttcccagagtatctctctctgtcaacaagcatgtagagtctttattactagaatatgcagagtcccgggagaattgttgcatccttttttgccttaactcttttcttgccagtctttccctggctggtcgaactgcctctacagttgtcccatccagaagccacacacagcagcgggcctcaggaattgcattcctcgcagtgacaggagaggatgtaccggtaggtggcagtgagtcgcatgccccctgagcatcgcagccgcagtgccttcagcttggaagtctggggccggcagcagtgacaggaggaacggaagggttgcttgaggacagtgctgaacgacaccaaaggctcggagcgtgacgcctggctgcagtgcccctcgcacctggccaggagcaccatctggggaaagaaaaggaggtggttactctgtgggcatgccacaaccttagccaggtaaaacagcatcttttgaaagaccctcacactcgttgccaattcctgctagattagaccagtggctcaatgcatgttgcattttttttaagtcaacacccaggcctcattcagatcgattgaattaaaatccttggagatagggaccaggctttcatggttttcaaagcttcttag

SEQ ID NO: 7199 - DNA, 1298 bp, artificial
  synthetic oligonucleotide
cctgctctctccctatttttattccctactgatgaaaggatggaagaggactccacgtttagggctgttgttggtttgtggcactgtagaaaggccacccttgagcattttctgacagcttatcaactttcttgaatgtcttagcctgttgccctttcatttttaaaggatactgcaattggttggatcatggcttaaaagaaaaagttgggattgatccaggccttggaagagagcaaattgtctgaaaaattcttagcttttgtggaaaaaaaaaagaaaaaagaaaagacaaaaatgttatctgttgcaaatcttatacccagtttaaagctactagtcaatgtttatgtccagattttgccatgagggtgaaatggaccccaactggatgaattcctgattatgagcactggggatatgtcgccaacggaagttacccattctttgaattttctgagtcagcactcttcctaacaagaaagtagttgcttcagattgcaaaccccatccagggtttcacgttcttactgttgaaaatgggtctgggggtaagactctagtgacatatccttgaccatcaggctctgagaacctctgatgaaggggacagtgcacatgaatggtgacaagcaaatgactgccagagacacaagaaaaaagctttgcagatgcaagggaagctggcatcagaaataatgccatcggcacaatcttcctcaacaactcaactgtgtgggtgtgtgaatttgcagcatgcaacctgcacagccaagagagtactgattccagttccagcctcccctgccctgctgcacacacataggggtttcggaaggatttcccaccctttgttttctcctgaaattaaacacagaagttcatgattgctgacctgatgggcgaggagtggatactaccagctggaacattgccactggcaggggcagacaagaaaacaggaatgctcttaatgtcctcccaaagaaaacctttgatggacaaaagagtggttgtatttttaccctctcccttcatgctgccaggcgtctttaaatagatcctctagcctagggacttgtatggaataattcatattaaaacccaagaagtggtagtggaggggaattggttctttcttctctttctttccctttcttcctttctttttttcttcttgtcaggctaacagggaaagactcattttaattcagctgctttaaatttttccttttgggtcctttaatgaattttagctaatttgaaaaagacgaccaaagcccccagaaaaagaaaag

SEQ ID NO: 7200 - DNA, 1228 bp, artificial
  synthetic oligonucleotide
tttaatcagagacgttcccccatgacaacaacaattttgaaattctcaagattctgtggatcgactgggtgtttttctgatctataggatgtcaactacatttagctcatgggtgagctgcagtgttgactcatattaattctctaatcctgctataacaagttatcacaaattttgtggcttaaaaaacacagatttatcacctaacagttctggaggtcagaaatctgacacaggtgattctggtctaaaatcaaggtgtcagcaaggtggccttcccttccgcaggagagagaggctgctcaaattccttggctcatgacctccttccattttcaaagccagtaatggctggtcaaatctttctcattaagccatctggctggttctgacagagtctcctgcctctctctttcccttataacagtccttatcctacaatgggtccaccaaaataatccaggatcacctctccatctcaaagtcagctgattagcaaccccaatcccacctgcaatcttaattctgttacatcaggacctgctacataatctgcaaggcccagtgcaaaaggaaaatgtgaggccctttattcaaaaaggtgggggatcttacttttttgagaatatcactaaagttactttcttatgtggtgtctctcttgagttgccatagcattttttatttgcaattcgatgtcattctaaattttcaaaaattctaaattattatataaattttactttttatattgtgcaatagcagttttaaatgcacatatagcagcatctaattcatatgtgaaatcaccatactaattcacatttcacagcttgttaaatgtatatgtattttcttcttaccagaacagtggaaatgctgctcaaaattaacatgtaatataaaatattcgcaggttccaggaattaggatgtgaacatcttcatgggccattattctctttaatgcagccagaataccttgattcttctccacgtggctcactcttattctcctatcagcttcctgatggcatagtgatctcagaacagtcaggtcttttatatggtggttgattggcgtcttagagtgaactttccaagcagaaaagcctcaatgtgcaaaggtttatcaagcctctgcctgtgttgagcttgagaatgttccattggccaatagaagtcatatgatgaagcccagggtcactgtggaaagggacttcatagag

SEQ ID NO: 7201 - DNA, 950 bp, artificial
  synthetic oligonucleotide
atgccattctgagcacaattctaagcattttacatatattatctcgtttctttccactgtaaccttgctagataagtgctattatcattcccctttcacagatgagaaaagtgagattcagagaaggaaaatgaatcagcccaggtcacagaatgagtgaggagtaggactcagacccagccttgtggaactacaaagtacatggtctttacacaacctgtttttcctccttggtatctgggtttctctgggaaatgaggaggctccttatttctctgttccataccccatttccccagcccttcactttggagcctcaggactgagcccagcctaagaaggtttgggctttgaggaaagaatcccttgacttctgcttactaaaagctgccaaaggtcaacaaggcccagatccttccacgggtagtgccctgctctgggctcaagccacctagtctggctgcctgccaaagactttccatccccaaggggagactgcccaggagagatggccatctgggaacaaccttcctgatgttcctttggctacgcattttgctgatttccttaagtgtgttttcttatggggttactgtttcttttctggcttggtttgtgatttgacttcacttctgtttatttcttattatttggcccaacacacttgttttcatttgacttttttcttctcagacttctggcatacatgacctgtggctcattttgccatacgatatgccaccctgtctgtgtattttgtctgaagttcttggaagccaaaacttaaacatcatgaaaataggatcggggaggggggaattattcaagctttttgacttaggcaaagatcatcttgtgaatgaaatacatagctgctattgagatcatgttacctcagtggttcagtactttcataatggatgaaagttgccattagaaatgtagcatca

SEQ ID NO: 7202 - DNA, 1812 bp, artificial
  synthetic oligonucleotide
cttgttctcattttgactcttagaattatgggttgtaatggaaatattggcataatctgaactttagctgtggactgtacaaggggaactcatggctgtaattttaatttttttacatataatctgtcaatacatacacccataatgtaaacttacttggtttaggtttataaattgggtgtttttgacaaaatctaagaccctcagggaagtcactatgtcactaacaagtcagtttatttaaggagccattagtgaaagaaaggatgggagagaagaagctgaacttgtatctttcttccaagtctcaatccaagaaatacaccttcttcagatggtgagacctcccttctgtggacagtcattcaccaaatctgtaagaaaacatcatgagctgtttccaggctgaattagagctatgacttcatgcagctgcctcactttcagacaagacagtttcagtcagatgatcttgctggccagaaaaggggagaaactctcctatcaacaagctactggccattggccaacctggtcatctctcaatagtgacgcaggtttagagctactcctggaaaagcagctgtcttcaaaggatatgaaatgagctcatgcatgaaataagacttgagcagagatgtgattctgtttatgtaattgctttaattaataccctctccataagccattccagtatattttgcttatgaaaattaatacttttaatgttatgagataaaatcagtaaaaaacaactttccctttcaagaggaaatggagatttaaaaagggaaatgcccaatcaaagtcaatctttgccccaaagattaattttaacattctatgatactaacaatgggtattgtgggtgaccatcatactcacttctactagaactgtcttggaagaaactttcccattgattagtcagttccttttcgagatttattcattcactatttagaattcttaactatgtaaaatcttattattttaaattgtatatggatgtattggaataatgttcttcatagggagatgacagtagaaataaatgcttctttccttgatcataccatacttgtgatcttgtgttaattatctactcctgtgtcatactagtgaccttgtgttaattatctactattgggtaacaaaacccccaaaacttagtggcttaaaacaacatgtattatctcatactttctgtgggtcagaaatctgggtgtggtttagctggatcttctgactcaggatgtctcacaaggctgcattcaaggtgtgggccagggctgcagtttcatccgaaggctctactaaagaaagtctgcttccaagctcactcacatggttgttgacagaattcaggttctcacagattattggattgaggggctccagtaatcactggctgttaatgagaggcttctctcagtttcttgccaaatgggcctctccagaaggcaaccttcaacctggcagctggcttccccaagagcaaggtctccgacagaaaggaggtgtataagaggtcacaagcaaaaaggaagtcagatttttgtaacctaatctcagaagtgatattccattacctttgttgtattctgagaagcaagtcacaaagtccagccccactcaaggatgtaaatataagacagagatcattatggggcagtttagaggttggctgacagctcttttagccatttaataaaatacagcttgagataaagaaaaaaatatttatacaaacatactagaacttagaacataaatatatggttcctattgagctaggcaatttatgaggct

SEQ ID NO: 7203 - DNA, 1669 bp, artificial
  synthetic oligonucleotide
cctagagggtgagaggccagcttggatgtttctcacctaagcaagctcccagatgaattcagctacatgtgtgacctcagctatatgatgtgaagcataaggtggcctgagctgagcctcatcaaccctgagaatcattagaaatggtaaattgttgcttcacaccaagttttagagtgacttgttatgcagcagaagagaagtcaaacacttccttctcttccccagcagcaaattaagaaagtggaaaacaattgtctttacatttgaaaattgattgcttggttttaagcatctgaaggcctgagatatgttgtttcatctgcatttcaaattgtggattggaagatgaggttatttggggaagcatgtcttcttatacaggtataattaaaggaggacttagttttctgcaacttctagaattccactctgggaagcagccaagaagagaggatcccttactccttaattcatctctttctcctttaccttttctactgaccaggatccagcctttatttcccttaacactcactcagttgattcatccatttagtgttttctattgtgttaaaagatgttctgctgactattttctcagtttgctcttccagttccatgtttctcctttctcattccttctctgtgccctgggttgacctctgtggtaatgcagcacctgggttcaccagaaccctggtttctgattgagttgggccaaggggcagcactcgcaggaaatcagaggaatagaggagagtagtcaggaagtgcatcctagccccaccctaccttcctacaagtcacagtctcccttatggacaggtaatccctctcccacagcaagagctctctctaggttctagtaacggtggcctctccctgcccctttaaaccttgggtggtaatggattcctacttttgttagtccctggcgtgcatcaccaaccttggtggttccattaaccctgtccacaattctataaaaggatctttttctcatcaatcaccccttgagtgtgccatctgtaacctattggtcacatctgtttcctcaaggaccttgactgataaaaatgctaactaactaattatacttattgtaaagacattttcaatttcttactagagacatgcataactgttaataatatcttcttacctacataaagccaagagccccgttgctaagttggtatcattccagtgaacagcagaggagggctgggtgccttagctcacacctataatcctagtactttgagaggtcaaggcaggcagatcacttgagcccaggagttcgagaccagcctggaaaacatagtgagaccctgtctcttaaaaaaaatgttttttaattacccaagtgtagtggcacatgcctgtggtcccagctactcaggaggctgaggtgggaggatcacttgagccctggaggtcgaggctgcagtgagctgtgatcatgccaccacactccagcctaggcaacagacaagaccctgtcaccttccctcccccaacccatacaagcaaaggagcacaatgaggtagaagttacaaaatgaccacttctttctgtttcaaggagtgaagaggacatgcctctatctctgagatggagtccccaggactgggaagaggagtgggatttatagttccgtgaggg

SEQ ID NO: 7204 - DNA, 931 bp, artificial
  synthetic oligonucleotide
cgcccaagtgctgatacaactctttcccgctcagtcagtctttgcctcaggcatcaagcctaagaaattgtggattccttgagaatccaatagcatggaacactaggaccatcaacacgttgagaatgttctctcccttgatttcagacagacttattctgctattggggttacgtgagtgcacttatggctcacttaaagtgattcagagcagtaaatgtgtgtgacattgattgtgtgggtgggcaagaaggacaagaataataagcaacaaaaaattcccatttaatgttatattgtaacttaatattctctatacaaaaaaataaaatgttttctcttaaaaatatagaaatattttcctgaggaaatttctaaccaaaactgtcttatgctcataaaatgttagtgagtggctggttcatatcctttattgttttaaaatatccttatcctttttaatcatggttgaagtgatatatgcatgaactttgcaaggcataagaaaacataatttacttgacatgatttggggagagaaaaactgaaatatattaaacaaccctcaaccgcattatttagaaagaagaaaatcagagacactaattgcccatgatggctatttatacaacacaccactggaggcaagggatactggctgctcttgaaataggcagtttaaatctgatccagcaggcaaccagtggagccagtaaagacacataatctgggaggtgacatgttttctctgttaaagttcagctattgagaaggtaaagaaacaagaacaggccctaagtctaattttgaaatctcaaacgaaactgcagagtgggaaaactctgtcccctttcctatctcattcacctgcttgatgcccttcctgtagatgcccaccatcctgaagatgacccctaaatgtcccaaactc

SEQ ID NO: 7205 - DNA, 2173 bp, artificial
  synthetic oligonucleotide
agagattttggataatatgcaaaagcaaggaaaaaaaagaaaagaaaaaccatacacacccctgccaccgaaatataaccaagtaaacatcctggtacactcctctgcagtctctttactatgcatgggcatttgtctttttcttaataggtgtgaacatattttcatctttttcacttaactaatacatttccatgttattacagactattctgaaaccaaaatgctaaaccatacttctgttactagatattacacattttttttccaaatttttatataaataatgccataatgagcatctatatgcataaacatttgtctgtatttacaattattcccttcggatggtgttccagaagtacaattagtgaggcaaaacaaaggaacatttgaccagcttaggcaacatagcaagaccccgtctctacagacatttttaaaaattagctcgacattgtggtgtgtgcctgcagtcccagctacttgggaggctgagaggcaggagaatcgcttgagtccaggagtttgaggcttcagtgagttatgatagtaccactgcactccagcctgggtgacagagtgagaaagtgtctcaaaaatgaaaagtaaaataaaaatttaaaagaaactaacacttaaaaaggtcttgacacatagtactaagctgcttttacccttccatcagcaatgagtaagagcccacagcaatggaatatcctttcaaaaagtgtttcctgtcaaacatggagacagaagtaaaagaaaaaaaaaagtgttttttttttttctttctttaacagagtctcgctctgtcacccaggctggagtggagtggtgcaatctcagctcactgcaacctctgcctcctgggatcaagtgatcctcccacctcagcctcccgagtatctggggactgcaggtatgtgaggtatgtgccaccacgcccagcaattttttttttttttggtagagacggggttggctttttgttttgcccaggctggtttcaaactcctgggctcaagccatctgcctgcctcagcctccccaaagctgggattataggcatgaaccaccacgcctggccataaaaagtgtttcctaattcaacaagtaaaaatgatgtctcattttaatcaataataatttgattactaataaacttcaacatctcttccccttatttgttaagaaatatttcttctattgtgttctgtctgcacacatcccttgtccatgaatccattcattcattcattcaataaacactgattaaatattaactttatgtcaaatgatggagaataatagaggaatggaccagatttgacccccaaccctcaatatctacatcctagaattaatcacagactagagggaaagccaagtcaaggaagcagaaaaagtgctacaataaagatatgtccaaaagctccgagaaagtacccctcatccagtctgacatgtgtatacatatagcgagaaatccaggaaagcttcacagcagaggtggtagcagagcagatcttgaagatgaaaggcaatctgccaaccagagaagtgggagctgagtaagggaaggaggctgagaggaatgggagaaagaatcatatcctcaaagattcaaagagggcaagaagagccaggtgcagtggatcgcacctgtaatcccagcactttgggatgctgaggcaggtggatcacttgaggtcaggagtttgagactagcctggccaacatggtgaaaccccatctctactaaaaataaaaaaaaattagccgggcatgatggtgcacacctgtagtcccagatacttcggaggctgaggcaggagaattgcttgaacccgggaggcggaggttgcagtaagctgagattgtgtcactgcactccagcctgggcgacaacgaagcaagactctatctcaaaaaaaaaaaaaaaaaaaaagagggcaagaagatggtataatacatctgagaagctgtacaaagtgttaataacaggcacagacattatcaagagctcagggtatgtcaaacattgatctgcttcacacacatagactcatttaaccctcatgacaatcctttcagtaggaacttggttcccattttactgatgaggaactaaggcccagagagctttaacagattgcccaagggcacagta

SEQ ID NO: 7206 - DNA, 513 bp, artificial
  synthetic oligonucleotide
gaacagctttctcttctcccctaatggtgttgtgaaggaagtgatctgctcacggcaaggcgaccaaagggtttgaggaaaaagtcaaaggcacaggagagtttactcataccagagcagcacctgaaaggatacaagtatgccacggaggagtgagagacccagccaatgttgacatgcagagggtagaaagctggtaagtcacaatcaataactacacgctaatggcatgtttatattcaccactgccagcaggttagacagcctaaacagtagcatgcagtcttttgaaaagctaaaggcaggcagtatataaaggcaggagtcagaagtgaaggaaccataactctgctttaaatagataccttgaagtaatccactatttttcacctctggttcatttacttgaattgtgtcatcttcagggtagaagtagattttatagtatcttattctgtagttggtttggcttttatcaagtacttcctcttccaaataggcatcaaaagataa

SEQ ID NO: 7207 - DNA, 183 bp, artificial
  synthetic oligonucleotide
aaggagatggaatattccatcaaaggaggcacgagggcattttagggggtgatggaaatagtctttatcttgattaaagtgtgtttgcatttgtcaaaactcatttaactgtgtgttttagatctgtgcatttcaagtcataaattatatctccatttgaaaataaaagtaaaggattttaaa

SEQ ID NO: 7208 - DNA, 370 bp, artificial
  synthetic oligonucleotide
gatgtttataagggagtacacattggaagcaggtatacgttatatgatttataattgtttttcttggatactatctaatgccttccattataataattgactaaatagaactagccaagatacatttttccatttttgctgagatacaatggagtgatattttaaaattcaaacaatatattttcctaaaatactcaaattgcagtaatgcatgagatgctacaaaatgtatatgagtttgattaatcgttttatgaataatcatcacataattacccagatttatcactttaaattaaatgaaaattatttgttgcaagtttgtacaactatggaagtgttgacttttgttctcatttgctcagtttga

SEQ ID NO: 7209 - DNA, 2398 bp, artificial
  synthetic oligonucleotide
aaaaactatagttcccattctcattttctacgaaagctattggaggatgtgtccaccaaaacaagagaatacatcaagacataggataggccaggtgcagtggcttacacctgtaatcccaacactttgggaggccaaggcgggtggaatgcttgagcccaggagttcgagaccagcctgggcaacatagcaagacctccctattatacaaaaatacaaaaattagcgggcatgtggcacacgcctgtaatcccagctacttgggaggctgaggcaggaggatcccttgagcccaggaggcagagtttgtagtgagtgagattgtaccactgcactctagcctgggcaacagagcaagactgtctcaaaaaacaaacaaacaaacaaaagacataacatacaagaaacaacccaaaacaaaaagggaatatccagaaggtattgaagagagatcccagggtgagagccgtataccaggcctagaaagcaaacaggacagatgactctgggaccaagtttgcccagacggttaaactgatgaactatttgatacatacgacaatgaaaggtgatttacacaactagtagttgtctaaagaaataatactgggccaggtgcggtggctcacacctgtaatcccagaactttgggaggccgaggcgggcagatcatgaggtcaggagatcgagatcatcctggctaacagagcaaaaccctgtctctaccaaaaaaatacaaaaaagttagccgggcttggtggcgggcgcctgttgtcccagctacttgagaggccgaggcaggagagtggcgtgaccctgggaggcggagcttgcagtgagctgagatcgcaccactgcactccagcctgggtgacagagcaagactctgtctcaaaaaaaaaaaaaaaaaaaaaaagaaagaatcctggctgggcgcggtggctcacgcctgtaatcccagcactttgggaggccaaggcgggtggatcgcctgaggtcaggagttcgagaccagcctggccaacatggtgaaaccccatctctactaaaaatacaaaaattagccaggcatggtggcaggtgcctgtaatcccagctacttcggaggctgaggaaagagaatcgcttgaacccaggaggcggaggttgcagtgagccgagattgtgccattgcactccaacctaggcaacatgagcaaaactcttgtctaaaaaaaaaaaaaaagaagaagaaaagaaataatcccggccgcccgtggtggctcacgcctgtaatcctgtaatcccagcactttgggaggccgaggcgggtggatcaataggtcaagagttctagaccagcctggccaagatggtgaaaccccatctctactaaaaatacaaaaattagcggggtgctgtggcaggcagctgtagtctataatcccagctacttgggaggctgaggcaggaaaatcacttgaatccgggaggtggaagttgcagtgagccaagattgcgccactgcactctagcctgggcgacagagcgagactctgtctcgaaaaaaaaaaaaaaaaaatcccaaacttcctagtagaaataatggccaaaaccttcccaaacatgattaaagacataaattcacaggctcaagaagttcagtgaactccaagtaatcaatctcagtgaactccatataatgaatgatctaacacaattatgaaaaaagggaagtaactacactcagacgattgagggagagggaagaaagcattcaggtatgtgagatttggggaagtatagggaaaacaaaacaggtcaataaatgacagctaaattttcccattccataatgggaagccaatagttcacacctaaaactgaaagatcaagaaatgtccaattaacttgtttagggaaaaagagattactaccttaagaatcagttaagagtgcaaactggatgtctcaagggatggaaaaatgggggtagtgagagaggtggaggattactctaatctgtaacaagccttgcacaagtacttggccctttgaattataaggatgtataactccaaaaaattaaaacgaagagactgtgtactttaagatggcagtgtaataaatatctattggaaaacacttgatattgttactagaaaagctttaagttctaaataaactaatatttacctttaaatataagaaaggtcataaaaatatgaaagtgggcctaaagaatattaggcaattagcctaaaagccatttgttactttatttcccctttcactttccttctactgagttttcaaggttagtcgtatttgtgggaaaaactggtttgatgcagataggtcctatgttgctctgccttaaaaacttcaaagactacgtgtactaaatgcggaaaagtgg

SEQ ID NO: 7210 - DNA, 2243 bp, artificial
  synthetic oligonucleotide
taaatctatgtaagatgaatttaaataagaatctaagaaaaaacgcttatgcacaagttaagtaccctcactaactccaaaatttctctacagtcacgaacattttcaaaacagtcaaatttgtttctgccccttgttatctggctagtttttttattataagaacagaattagatccacagtagccattgtgttatcacgtggtctgaaatgttaactggtcaggctgatggttattaactacttcttaatggactccacaatattatcaagtaagcaatcagacctttaaacacagaattaacgttctacagctctttttcaaagagttatcataatctgaacgagcccacaaaaaacagaatcatctgtatcatcaccaataattcatactgagcattttacactgctctgtacagggctgacaatactagaggccagttctaccgtgggagtttcttaggttttttcagcagttagcactgaatgaaatgtaaaaatttacatataattaactcatatatttcttcctatctactatcactgaatcagatccacgacatttgctgaacatgagaatggggaaattatataaagaatcaaaagaaggatgaggagggagaagaggaacagtggtgggcatgggggaggggatcgccaaaactcaacagggagcctgggaatgtagattacatcaattttaactcagagaaaagcctcttctggaattaacagtgtagacctactgcctgtgcacggtgattcttgcccatgtatgaaaggacagcagtgtcaggcccccaaatgaaatttaatgaaaaagacgttgttctcaccagccagtaacgccacccattacaatctgggtagctactgagtatttttctaccataggtcccgaactgtggccaaacactcgattccaccactggtgtcttcttgcatactcagttaaatccaacacttcataagagtcgtcatcactttcatagtcttcaaaatagcaaaatgcaaaaaataaatgtagagtcaatcaaaagtcagaaatgttctatacatctttttaaaaatctgttacaactcattagttctggcctacagctaaaaatgcccacatagaaactactgactttatttaactcaattcttgagaccagggcctcaagagtaaaggaccctgcaacaatgacccccatctgctttcccaaaggcccggggaccagcctggggtcacgaagccagggccaactcagaatgacacagtagtgaggggtcacccccacctccaaaccttagtagggtcaaggtcagagcagggtccattttcatcagtgggaggaatgggggtggggaggggtcctcctgagagaactagtctggagctcagcgaaatcacttgagtccagacgtttaaaaaaagaaaataatacatttgaagatgggagatgaagggccggaggtgaaggtaaggcaggaggcaggtagggctgtgctgggggtgggggtggctctccgcttgagttccgcagagaggggaggaaaaagtctagctcggagggggtgctcgaaggggctgccttaaaaaaaaaatggagctcgaagaatcctagggcaggggaaggaagaggtgccataggagcaaggtcgagagctgtgagccgcgtcccagataccacttcgggccctggccgctcaccttggggaggggggttccgggtcgccatgataccgccagcggccaattctggagtggtccccacccgccctcctctccctggcactttaagggccgctctaggccaggatggaagtctatggtctcttttttcctccttctcctactccaggcgcgtagtcctgtctccgcccccttctctcagcgcaggaccttctgccttctgcgcaggcgcgaaactccggaatgtggggagggccgggcggatcatagccccgcgagagcgtaggggacttgtagtccgttgccttccgcaactaggaagggggagggaccgcccctcctagaatttccgtaacttgaatttgattattttgttttaaaagagccttaagggctgaaggaatggggtgaagggcgccacatggtggtacaaagggagaaccagctgggtattgacaaagactctctccttgaccaaactttagtcaggaggctcctctgagctgtttttgactgggtctcctccttgggtcgtctttgacctgcctagtccatttgtggtaag

SEQ ID NO: 7211 - DNA, 1179 bp, artificial
  synthetic oligonucleotide
aaaaaaaaagcatgaggaaggtctctgtattagtttattgtgactgccataacaaattgctataaatttggtggcttaagacaacagagctttattatctcacagttctggaagccagaaaaccaaaatcaaggtatcagcagagttgattccttctggaggctctgaaggagaatatgttccatgcttctctccttgcttctggtggctgcctgcaatccttggcatcctttagtttataactgcatcactctaatctctacctccatcttcacaaggccttcccctctgtctcaaaactccctctctttttttttttttttttttttttttgaggtggagtcttgctctgtcacccaggctggagtacagaggcacgatcttggctcactgcaacctctgccttccgggttcaagcgattctcccgcctcagcctcccgagtagctgtgattacagtgcgcaccaccatccatggctaatttttgtatttttagtagagacgggggtttcaccatgttgctcaggctggtcttgaactcctgaccttgtgatccacccagcttggcctcccaaagtgctgggattacaggcatgagccaccgcacccagccaaaactccctgtcttttctcttataaggacactcccaactggatttagggctcacattaatccagaatggtcttgtctttttttttttttttttttttaatttttgaggcaaggtctggctctgtcgtccaggctggacttcagtggtgccatctcggctcactgcaacctccacctcccgggttcaagtgattctcctgcctcagccttccaagttgctgggattacaggcgcgtgtcaccacacctggctaaatttttgtatttttagtagagacggcatttcaccatgttagccaggctggtctcaaactcctgacctcaggtgatccgcctgccttggcctcccaaagtgttgggattacaggcgtgagccatagtgcccagcttaagattcttaccttaattacatctgcaaagactcttattccaaataaggtcgtatcctcaggttctggatacatcttttggggaaaaaatgtaacccactacagtatataataataccaattaatttccaaaatgtatcattatgtctaaaaagcaaggtgcaaaacagtgttgatc

SEQ ID NO: 7212 - DNA, 430 bp, artificial
  synthetic oligonucleotide
ggaagtcaatagtttatgggactattctttatagtgtcctgcagtgtacaccaaagatatgatgctgaagcacagtccaataaaagtaactctacaaaagggtaaaacgacacaatttgggtataaatctttctagtagtctcccctagtcctgggctaacagagcgctgtaaggaatggccaagagcactgtaaagaatggcctccccaagctgagctgctcacacacaagctcaggtacggctgtacctgagcaggacgatctgggtggcagacaagtgcagacacatggtctttagtgtccgctgagcaggcgatcaagctgacacagcttgtggaaattgaggagcttaatgatgacaaaacacatttcacatttatgagctattttcttgtgccagtcattgtcccaagggtcttagaaatataa

SEQ ID NO: 7213 - DNA, 384 bp, artificial
  synthetic oligonucleotide
gtaactgtactctttctcaaacttactttatttccagaaattacactgaccccagggctcacattttaactggcagtaataggcaattcttgggctggtccgtacaattccttgaacaggcaagagaatataaagctttcagtaataaaatgttaaggtgcttttaaagtcaaattaacttgtgcccttagcacttttagaacctacttacaagccttcactggcatactccctctatgccaacgtcacattcttcccagaacagagagttgcagtagattttgaatgctcagagattattttttttaaatagcaggcaaattggtcatcctcagtggataatcactgtgccaattcacaatcaagaaaacccgacagagctct

SEQ ID NO: 7214 - DNA, 1472 bp, artificial
  synthetic oligonucleotide
aaaagaagtttaacatttttgattggtatttctatctattatttctatttagtaatttggttgagtaagcaaagatgtctttgattaatacagattgcaaataaaatcattgttaattaatgccttttgtttggtcaccaaatcttaaaagcgtaagttaggtcctttgaggaagatggaggagaaagggcatatatatgacaaagggtctttggtactaaaaagactggaaaccactggtccacaagattaaggccccaattccttggcatggcaattaaagaccccctgccccatatatcccttcaacctcctcctctgtcatgcctccacatacaccccatgctctagctaagcacctctcacttcttcccacacctttgcttaagatgttacttccaccttaagcccttcacttcccgttacttttcagctcatcctttaaaaggctttgctcagaataccttctcctggggaagcccttccccagttcccatttggaattaatggagctcctggaggtcctttacactgccctgcatcagacaaagccttattattattatttataacatgacccccttgtcctgacctccaggaaggcaatgaccagagttatagttgctgtcaccccagtacctgctagagtttggctgtggtaaaggctcatggactgtgtgttgataggcttaaattccaagtgtgatgccattctttgctgagagccatgtgcattgcaatttactaagctccagttttcctctgatcaaggcaatctctcacaacagaaagctggctcagaaactttggagcaaaccgtcctggtttgaattccacagctgctacttattcggtggtgaccttgtgcaagttacttaatcttttttaaaaaataaattttattgtgtatatttaaagtatacaacacgatgttgtaagatacatatatatagtgaaatgggtcccatcatctcacagagttacccatttccccccactgaagtcactttatctggctatgtctcagcttaccacctcaataatgggggaacaccattaactctcacaatgatttaaaataggtgtcacattgtaggctttctataaattttatttcccgcccactgtgagaaatgaacttgataaactcaacagtcccaggctactccattcataggaaagaaaacttcaagctttcagttcaaaaggaaatgttggatttagcatttagggctggaatttggcttcacatcttgccctcttacccaccccaacttcagaccattaccactctgattaaatggatttgtttcagctcccacccatattacatcctgattccttttcaacaaattcctggacatcttcacaagaagggaacagaattttgtgattcagagttatttgattgatattctgaccttatttcttctttaaagaacttcttgcaaatagatgtcccgatgcaggca

SEQ ID NO: 7215 - DNA, 1186 bp, artificial
  synthetic oligonucleotide
tgagggtgagcagttggggagcatcttttaaaggttcacatctgggctgtcaattgagttttggtggtgatagggtgtggattgtgtgttcacgcacatgcaggtaaaattttcttttaatgaatattttgtcagagccttcactttcccttttattacccttcagtggatacgttggggaacatatactggaagaggcttttgagagctgtgctttgtgggaatattcttggcaagccctgagtgtagacacggcctcagctgatgattctccagggaaacctgggtgttcccttcattttcaggtgggggatttggagacaacacagacctctacatgaaggactgatgcatgtgtatgttcaggagggggttggggaaacatttgggggtgattttcctctggtcccttatggctttggtggtacctcctgtcttcctttgtttctccccatctccctgaccactgtctccctagcccccatgccagattgatggaggtagcatcttttgtgatttattttcttttaccctttcctaaaacctagctgattgaagacactgccccagtcatttccaacatactctgctgcctcttcagcctgtcatgggctctcctgattcagagcagaggtggatactggcaagggacaggcagcccctagatgaaggttgagctgatggtggctgcttttacatagtttggagaacaggtgagagagaggagggcagcagtctctggtacagagccctggaggggacaaaggagcagcagccacagcacagcctgtggggagggaaaaggagaggggattgtgaagctgagcatctagcttctagccaacctatgaactacagagctggctgtaatcagctccatacacactgcttcttcttagagaacatacaaagcaaagcatgaatgtaagttgatcatatatataattatcaattatgtatttagcatttgtttatgtatttaatgaacacacataggattgactgtatcctaggcgttatcctaagggctttataaataataactcaccgaattcatcacaactatatgaagtagtactaacattatcttcattttacagattagtaagtggcagagccagatacaaacccccaagaataatgtactttgctacattacgtcttttgctagcatgtcaatgagaaa

SEQ ID NO: 7216 - DNA, 1907 bp, artificial
  synthetic oligonucleotide
agacagtctctattcattctgacattatctctccagtaagtcctactctggttatcaaactttctgtagtctggagaacaaacaaatccctaatatggtcattcttttcatgctgagagatcaaactcatcctattactgggatcagtaatagtaaatgcaaccctgacaccgacaggagagagtcgtcaggtacattaccacttttcttcacagctgcccctatgaatgccatgaaggaccacggaattagggatggaataaattcgaggatttgatgaaaaacaaaacaaaaaaatagggctccctttgattgtcatccttagacaaaatttgatactctttgcactaccatatgattatatcccctgattttctaagattaaagtccattagagttagaaattggaactctcaagccgaagtcaagaaaacaaatcatgtctggttttagaggtgccagaatgatacaatggactttggagacttcggggaaagggtgggaggcgggtgagggataaaatactacaaattggggctgcgcgtggtggcttacgcctgtaatcccagcactttgggaggacaaggtgggcggatcacaaggtcaggagctcgagaccatcctggttaacacggtgaaaccccgtctctactaaaaatacaaaaaattagccgagtgtggtggcgggtgcctgtagtcccagctactcaggaggctgaggcaggagaatggcatgaacccgggaggcggagcttgcagtgagccgagattgcaccactgcactcctgcctgggtgacagagtgagacttgtctcaaaaaaaaaaaaaactaaaaattgggtacagtgtatactgctcgggtgatgggtacacccaaatctcacaaatcaccactgaaaaacttactcatgtaaccaaacaccacctgttcccccaaaaccaacagaaattttaaaaaatttaatttaatttaaaagaaatcaatatatgaaaaaagaaaaaaaaaaaaaaaaaagaagtgccagtcgggacagacagagaactctcaggaaaactgctcattttgccaatacatcaaatagttatttaaaaaaaaaacaaaacattttctaaagtgtgttagagggctagtgaagagagaaggccatcgaaaatgatgaagaataaggaggagagatgtacaggcaacacaaccaaggagaaaaggaggatgccagacatgggtcaatcttgttagctaagtaaacctcaatggtatctgcctctaagctctgtttggtgagtctctgggacccaactaatgatggtttagtgtcctttaaagaagaatttaaaataatccagtacataggatttcttattgtgcaactttccaattctgaaggaagctatagggcaactaatgttaactaaactgctatgtctccctgttgggtttgcaaagccactcagtactgtgtcatcagtaacccaggaacaaagagggcagtcacacagtaacatcaacacccactgggtacacagagttgcccacttttcatgactcttccacgtgtaagggtcacaaacttgggaagctggtggctgtgttattacccatttagaaacggggaaacagaggattagagggaattatcatcttgaacatctcatatttttaaaaaggaactctaataactacctgacaaattggtgagtgaagagtcttagccaaacactcaatgacaatagtttgaggaagaagcaaagtgtagtagttagaatggtgatttctgagcaagaagatgggggctctgtattcctggccaagtagcttggcttctctgggtctcagtttgctgccaaagcaaacgaggataatactgatcctacctgtaataggaccattgaaaggatttcacaggatg

SEQ ID NO: 7217 - DNA, 6659 bp, artificial
  synthetic oligonucleotide
gaatatataatgtacgtgaaatttatcagttgtatagtattacataaataccaattcttattagcatctctactttctattggtaaatatttctgtggtgaatatttcacttaaagtgtgtcttcccattcacagcacattccaagaagcctgtatccctcaccaccagactaagatgtgcccctcaggttaagtataattattttagcaggagtttaagaaaaacatagcaggaagataaatgctaagcaaaacagaattttttaaaaatttaaaacaaattctattttggataatttttttttttttttgagatggagtctcactctgtcgcccaggctggagtgcagtggcgccatctgggctcactgcaagctccgcctcccgggttcacaccattctcctgcctcagcctcccgagtacctgggactacaggcgcccgccaccacgcccggctaattttttgtatttttagtagagatggggtttcaccgtgttagccaggatggtctcgatctcctgacctcgtgatctgcctgccttggcctcccaaagtgctgggattacaggcgtgagccaccgtgcctggcctctattttggataatttatgcctttcattttcttagataattaggagttaattaccagcacacaccgtgttcagcttatcatgataacttggagagatctttactagaaggaagtgccatttaactggtacacttgactttcccccatatcccaggtggttattttttttttccagctagccaagttattttcatcatatttcttttcatcttaagttcacataacccccagaacctgaatctagggcaaaagaagagagatcagacctaacactatcgattcattgatgtgggctccgttggttttgattttagaaggtcaatgccctatgggccaaatttgttcaaaggacaaacacacaataatgatatggtgcttcctgcctttaaaaatccaactaccactgtttaaatatagttaagtattagtgggaaaatgtaacgtatactttaaaaagtaagtctctgtgtggtttagagtcattctataattatgttttaaataaatgatgaccttttaaaatatataataataatattgttgatacttcagataaatggttcctgtttcatttttaatatgtcattaacttaccattactaaaaattcaaccatgctttaaaaaattttcagatggaaatgagattatattagtaatttacaatagagcaatacatttccattatgcttatttaatagcacatttatatcatgcaaattcctttagatgtaaaattgccatctggttttactggggggttggtaggaaataagaaaaaaaaatccaaataggagttttgaggaaagatgacaaatatgcaaagcagagtttcttcctatcaatagcacagtaccttggggaggaggctttaaaatatattttggaaagaagggctaaaggaagtttgtgcgtgggtgtattgtgtttaaaagaaaaataactcctaaaatatagactgaaattattcttcaatgtccagaatgttcatttatttaaaaaaaaactcagggccattacatttaccaaccagctaaattcacttcaatgccactccttacaggtatataatgctttagagttttattgttgctatagtttgagtacttgacgatccaaacctcatgttgaaatttgatccccaatgttggaggcggggcctagtggaagatgtttgggttagggagatggatccttcatgaatggcttggtgccattcttgcagtaatgaatgagttttccctctgttagttttcgcaagagttccccaacagctgattgctaaaaagagcctgagaccttccccctctcttgcctctgctctctcaccatgtgatctctacatgccagctcctctttgcctcccttttgtcttctgtcatgagtggaagcagtctgagtttctctccagaagcagatgctggcaccatgcttcttgtatggactgcagaaccatgagccagatacatttattttctttataaattacccagcctcaggtgttcctttatagcaatacaaaatggactgagataatagtatacagaaaatgtcacctacagctaccatgatagttgaaggcctagctgtagatgtcatcatgcagatgatgctgtgtctctgttttcaacattggcttacaaccaaccttaccgtgtgaaaatctgaaattgtcctgggcttcatgttctttccaaagctccctacctactgtatgatctagtatgatcttttatgttgattttaaatttcatgctgattacccgtttgccaaatgttactgaagttatttttatctccttatggtggttccttaaaaccactttgttacttgatttataaaaagaagtggaccaaaggacacttatcccagaaggtcttagcctggaaagcttcaagcatcaccaactctcagaagtttcatatttgatttgcatatctgtatgccctattctagggagagggttcctagtttttgttagagtgtaagagattagaaaactgagaggttttcagatccactgcaagatgaagccaatggcagggccagaggcagagcaagaaaagagggcaaactgaagaggcaaaaggagagggagggtgtgaaagttgtcacaataaaagtggagttattgtggtttgctttaaaaaaaaaaaaaaaaaaaacagctgggcctggtggctcacacctgtaatcccagcacttttggaggctgaggtggacagatcacttgaggtcaggagtatgagaccagcctggccaacatggtgaaaccccatctctactaaaaatacaaaaattagccaggcctggtggtgcatgcctgtaatcccagctactcgggaggctgaggcaggagaatcgcttgagaggtggaggttgcagtgagccaagattgtgcccctgcactccagcctgggtgacagagcgagactccatctcaaaaaaaaaaaaaaattaatttaattaaattaaattgaaaaaaaaaacaaaaaaccgaaaccctgacaaatagagccaaggaaggccatagaggattctcatgtataagcacttgataacagaaactaccatgaaaggctctgcaaaaaccacaaccttgcacaaaggctagtgcaaccttacacaaaaaatatatctgttagtatatcttctcagcaactgtctctccaaccctggactggcaccacccttggtgctcatagccaggaataattatctcaaaataattatgtaatcctcctcatttgtcctttaaaaacctggtcttcctttatctccctgaatacccatatagcttactatgacatgcatattcttatggcaattccctatgcccgaataaatatcattttcttttagagagcttctctccatttgttatttaggttgactagggacaagagaaaaacaggagaaagaaaagttagaagaaagaagcaagaagaacagaaggaacagagaagacaagaagttgggagcaaagaaaaataaaggtgagtcagagaaggaaaggaaaaggaaaagaggcggataaatttaaaaaagaagaagactcatccttcagccttccccagggctcagggcaccaggaaacttccccttccctcagccaggtgtcccccagcaggtccagcttctgtctagctatggcgcctttattctttcctatttgtttgagtcattctgtgactattgactcaaacacaggtttccacttgggcaaaggtcccatacaatgaattaaatgatggcttcaaatgcgcattagaagaatgaagattgttcagcctcacagtgaatacactcctatttgggtgtattcaaataggctaacctaaatgaatagtcttgagcagcaacttggggtctaatgaacattagacactcctaccgacaatgagaaagaaacctgttgtctagggtgaaaaacatagcaaaatgcaggtccttcacagagttcaaaagcttcaggatttcagggaaaataaacttttatatgaaaaataaaattggaaataaaaaatagaagtcctgaatttacattaaaataatgctttaaaaaaaccactgggttctaggagtagacttttggagtggaatttgaatgatcaagagattatattatttaaaaccaagtaaacagaaattccccatagtacttgaagtggtgtagtggagactactccacgaagatacccttttcagatattaactttggtactcataaacacctatgctgaagctctgatgttgtctcagaaaagcacggaggaacatggtagaactgcttaacatttgctaataagactaaattaccattaaactgttccaaatggcccctatttatagagtgaacatatgacttatccaaactgggagattttagagagtagaaagaggtgtcattaacaaattaagccagggcagtagtcataaattgacactgtccctgggaaattggggtgtatgatcaactctgtctctacagaacttctcactgcttggaagtgaaataaaacaaaacaggcaaacaaacaaataaacaaaagcaaaataataggaacgattattaaaatggtaatgggccaggtgccatggctcacgcctgtaatcccagcactttgggagaccaagttgggaggatcacttgagtccaggactttgagaccagactgagcaacatagggagaccctgtctctaaaaaaaatttaaaaattagctgaggatgatggtgcgttcctgtagtcctagctactcaggaggctgaggtgggaggattgcttgagcctgggaggtcaaggctgcagtgagccgcaatggcaccactgcactccaggtgtccaggtgacagagcaagaccctgtctcaaaacaaacaaacctgtaatgaaatctggttccatatggaacccaaagaaattcagggattttaactaccaaatctcatcacttttgtggctaccatttagccacaaaagtgttgtgtaaaagaggtgtaaaataaggcataaggcatttggatactttctcaatttaaatgaaagatcctggctaacatgcaatttaagcattgatgggaaggagcctcctgatgactgacagtggccactttccagcagcagctgcaggtgaagggagtatcgggaatttagtcccaatgtaagggaaaactttctattaagaatatataatattttgtaatatacaggagttggctgtattttattggatgactgtctcttgtctttttttaagtctggtttttttttttttcaatcttctgatgagtcaaaaaagccttgggttctgtcctgaattcacaaggctttctagaggccagaagagacgggcagaaatgaaagcttttcatcagtcttctgggccattgcaacacgatgttaaaaaatacatacatacatgcatacaaaacaacctctcatttgttctgattcattcctgaaccaacaagacagtgggatagacattttagtgggtggggtgaggagccttcccagaatgtctcccggaaattggggcaatactcactctgcttacttctaaagataattctactataatggttaaccgaatatatcaacttgactgggccatgggatgccccgacatttggtcaaacattattctgggtgtgtctgtgcttttggaggagggtggttttggatgagattaaaattggtagactgagtaaagcacattgccctccctaatgtgggtggccctcattcaatcaattgaagatttaaatagaacaaaaagactaagagggaacttcacctgactgcttgagctggtacattggtctttttctgctccctgactagaactacaccatcagctcttctgggtctccagcttgcccactgcatatcatgggacttcttagcctccataattgcataagtcaattccttatagtaaatctctatctatctatctatctatctatctatctatctatctatctatctatctattctatctatccatccctctatctctctatatttatatctatatctatctcctattggttctgtttctttggcgaaccctgacaaatagtcctaccttagggctatctgagtccaacagtgccttaagttacagccaagaataggtctgtgatccatttaaagttaaaaaaaaaaaatctcacactgtatatcccatggagaatgatcagaaggggcattggcctgtcctggcaccaaccacagctgtaaacataaagcaggctgggccaaaatcaatgggtcccctgactttcaaatcactgctctgcattgtggaaggcccctgatacttgtgtgtcccccaaagttccatcacctatctgacactcttcatatttgcagtctaacccttaggaacaaatccaggactgaggacaaagtttgaattctggggctacctgcttgggagaggccacaggaataaccaagggatcaagaacttcaaccaagcacttcacagaaaaagcagcaaaccatgagatgaagaaggagtatggttgaaagctaacttagtcaatagatcagggatc

SEQ ID NO: 7218 - DNA, 2049 bp, artificial
  synthetic oligonucleotide
gcaggatatattaaaaaccaaatcttcatgaaggatcaccatgagaatctaggaagtagtttatctaactggagcatgtattagaagaccctggagggtttatggctagacaccacctcccagagtttcggattcagtggtaagtctggaccagttctaacaagctgcatttcttttttcttttcttttttttttttttgagtcggagtcttgctgtgtcgcccacgtccagcctggagtgcagtggttgatctcggctcaccgcaacctctgcctcctgggctcaagcgattctcctgcctcagcctccccaagtagctgggattacaggcatgcaccaccacgcctggctgattttgtatttttagtagagacggggtttctccatgttggtcaggctggtctcaaaactcctgaccttaggtgatccaccagcttcggcctcccaaagtgctgggattacaggcaccgcaccctgccacaagctgcctttctttctctctttcttttctttccttttcttttccctttctttccttctttcttttcttttctttctttctttctttctttctctttctttctttctttctttcttctctttctctctccctcactctttctttctttctttcctttttttttttgacggagtcttgctctgtctcccaggctggagtgcagtggcgtgatctcggctcactgcaacctctgcctctgggttcaagtgattctcctgcctcagcctccccaagtagctgggactacaggcgcacaccaccaaacccggctaatttttgtatttttggtagagacggggtttggccatgttggtcaggctggtctcgaactcctgacctcaggtgatccgcccactctgcctcccaaagtgctgggattacaggcgtgagccactacgccaggtccacaagctgcatttctaacaatgctgccaggtgccgctactggccttggggggatgagggcggggcacggatacttgagaactgctgttctggagcagtgtctctcaaactggggtctctgactgagaatctaagcatgtttaaaaatgtacctgggatttgtttaaatcaggtatggcaaggtgacagacactgagacaactgccttacaattaggcagaaagagtgaggggtcacaatgggcaaaagccttttgttttttgcaggaagaaatgggcagggcaaggtgagcagtttagggttggctactttaaataaataatttcagtgggcgctgggctataggcatagtctctagttcagtgcgtggtcctagggtgctttagggcaggcttggtgtgtaaaagttagataagggaggtagtggggaggcggaggcagcatgggctatgaattgttagtttgcatgtgaaaggtgccctggaaggcaacttgtttgctatctctaggaattagctggcccccacaggggcagtctctctgggattagcaaggccccaagatatcagtatcataaaatacagaaaaattaaaaacatgattaatacaaagagtaattttcggccgggcgcggtggctcacgcctgtaatcccagcactttgggaggccgaggcgggcggatcacgaggtcaggagatcgagaccatcctggccaacacggtgaaaccccgtctctactaaaaatacaaaaaaaaaaaattagccgggcgtggtggcgggcgcctgtagtcccagctactcgggaggctgaggcaggagaatggcgtgaacccggggggcggagcttgcagtgagccgagatcgcgccactgcactccagcctggaagacagcaagactccgtctcaaaaaaaaaaaaagaataattttctattctgtctttattgtaataataatcttttttttggtactggttgtaaagaccaaatttttttcctggtgataattcccaatttaaagatagtttcacaaaatgaaatttagtttatgaactcattgtctttaaaactgtggactaaggaccctcagaaatccaaacatatatctttacatgtccaaggga

SEQ ID NO: 7219 - DNA, 1244 bp, artificial
  synthetic oligonucleotide
aaacaaagcacagtggtgaatagtatttgcctatgtgttctggtaatttttcaccagctgagctagtgtaatcatcttgctaaagaaaagttctacagttctaagtaatcatgttgatttgaaataccacttacgcaacaaagttgaattgtacatcttttcttcccccagcagatggtgacattttatagaatatggaaaaattatccaaatggatgagtgagctatataactgaaatataatcgtctctatttcatttctcatttatctacatcttgaattcatttacaaaaaggcattcatcaggaagtaacatttaaagactatgctttcaggggtcatttgtttttcttttcttttctttctttctttttttttttttttttgacagggcctcactctgtcagccaggctggagtgtaatagtgccatcatggctcactgcagccttgacatcccaggttcaagcaatcttcccacctcagcctcctgagtagctgggactacaggcacacagcatcacactgggctatttttaaaatttttctgtagagacagggtctcactgtcttgcccaggctggtctcaaactcctgggctcaagcaatccttcctcagcctcccaaaattctgggattacaggtgtgggcccccatgcccagcaagggatcgtttctatagttccttcctaggaaagtttctctgaacatgtagagcatgttttttaaaaagtaacatttatgaaaagaagactaagaacaattaaaaaataacatatagaaagtagaatttttcaggccaggcatgtcatgccagcactgtacacctgtaatcccagcactttggaggctgaggtgggcagattacttgaggtcaggagttcgaggccagcctggccaacatggtgaaaccctatctctactaaaaaaatacaaaaattagccgggcatggtggcaggtgcctgtaatcccagctacttgggagactgaggcaggagaaccgcttgaacctgggaggtggaggttgcagtgagccgagatcgcaccactgcactccagtctgggcgacagagcaagactatgtctcaaaaaaaaaaaaaaaagaatttttcaatgtcttcaattcttagtttgcacagtgtttttactagatattttctcatcaggtcacatcagcctacctatttacaaaaataaaatagtaaggacaaaatgctaaagagggcaaatctgtctttaatta

SEQ ID NO: 7220 - DNA, 2838 bp, artificial
  synthetic oligonucleotide
aaaacagaagaggcagtgaccttctccgggtggggtctatggccctttactgggtacattctgtacacacaggcccctcctttgcctgaagtcattgatgaagacttcattacggagggtttggggaaaggtgggggtctggctgggtaagccggcgtcccagccccgctacagccccgcccagatctggcagagccgtgggcgaacccaggcgggcagaaaggcggggcgggcggctgccaagccggccaataggcggctctccggctgctaagccgagagggcaggggcgccgtcagtagcaccaccgccttccaagtttccccttgtggatgcgcggccccgcggctctgctcctcccggcgcagaggggccgggagaggccacaggagcggacctggcacgggatttctgaggaacgggagaagactggcgcccgacccgctctggagggtcggtgaacgatgaagggccggcggcggcgacgccgagagtactgcaagttcgcgctgctgttggtgctgtacacgctggtgctgttgctcgtcccctccgtattggacggcggccgcgacggggacaagggcgccgagcactgccccggcctgcagcgcagcctgggagtgtggagcctggaggcggcggcggccggcgaacgcgagcagggagcggaggcgcgggccgccgaggaagggggcgcgaaccagtctcctcggttcccaagcaacctcagcggcgctgtcggggaggcagtgtctcgcgagaagcagcacatctacgtgcatgccacctggcgcaccggctcgtccttcctgggcgaactctttaaccagcacccggacgttttctacttgtatgagcccatgtggcatctatggcaggcgctgtatccgggcgacgccgagagcttgcagggcgcgctgcgcgacatgctgcgttcgctcttccgctgcgacttctccgtgctgcggctgtacgcgccgccgggggaccccgctgcgcgcgccccggacacggccaatcttaccacggccgccctcttccgctggcggactaacaaggtcatctgctcgccgccactgtgtcctggcgcaccccgtgcccgggccgaggtgggcctcgtcgaggacaccgcctgcgagcgcagctgcccacccgtggcgatacgcgccctggaggccgagtgccgaaagtacccggtggtggtcatcaaggacgtgcgcctgctcgatctgggcgtgctggtgcccctgttgcgtgatccaggcctcaacctgaaggtggtgcagcttttccgcgacccgagggcggtgcacaactcgcgcctcaagtctaggcagggactgctgcgcgagagcatccaggtgctgcgcacccgccagaggggcgaccgcttccaccgtgtgctgctggcgcacggcgtgggtgctcgccccgggggccagtctcgcgcgctgcccgccgcgccgcgcgccgatttcttcctgaccggtgcgctcgaggtgatctgcgaagcctggctgcgcgatctgcttttcgcgcgcggcgcgcccgcctggctgcggcgccgctacctgaggctgcgctatgaggacctggtgcggcagccacgcgcccagctgcgccgcctgctgcgcttctccgggctacgcgcgctcgcagcgctcgatgccttcgcgctcaacatgactcgcggcgcggcctacggcgccgaccggcccttccacctgtcagcgcgcgacgcccgggaggcggtgcacgcctggcgcgagcgcctgagccgagagcaggtgcgccaggtggaggccgcctgcgctccagccatgcgtctgctcgcctaccctcgcagcggagaggagggcgacgcggagcagcccagggaaggggagacgccgctggagatggatgccgacggcgccacgtagcctcccatccctgtccccggcacggatccgggtaaggtggcccggggcaaggcagggaccgggactggtcttccgggagcctggaatggcctggggagggggaagtgtaggggggagggtaccatgctggatcccattctatcagatcaggtccaagaggatgggaaagtcctgctcgtagaatttggtagattcatcggaatctccagcttagcctcgcgcctccttagagggagatcctgagatgagagaggatatttaggcgtgactgaggtggaagccaggtctctgcattcccattcccctgtatgaagtaggaggtttcagagggctgaggagagtagagaaggtttgaaacagtcataatgagccgtgagactgggaattgacatgtggagtataggatttcggaaaccatttgaggttgatgattatggagttatcttgatgccagtttgtcctgtgaggagactttgcaatggtgtttacaggcacagagaaagccaaaagcagagagtttggtggaaaggcattgattctaaccctacctatccctaatctttctgtttcatgtttcttctctgtctgttttatgcgcaggctccagggcttttctcctgaatttccaaacatgcaggcacagtccagcggctcttgcaacacttcttgcacattgtgtgtctcaggcgcttgtgtagtgaatagacttgctttcccctggctcatgtgcgcctctctgtctcccctccccctccttccctctctcatttcccctctccctctcttcctcttcctcccccttcccctcctcctctcccttcccccttctccctgtagctggcgtttgcaggatatttgaccatatcccattcacatcaggtcacaaaagctgcctggtcagcttcctctagtg

SEQ ID NO: 7221 - DNA, 500 bp, artificial
  synthetic oligonucleotide
tggtcttcatcatattcaagttattagctatccattacatttttttggttaatttcagaaaccttgtttttaattttcaagaattttttgtttgatttactcctttttctaataatcttctctagtatcatgactgaaaaagcctttcaactctctaaggattaatcaaaaagtacataattgtttaattagtccctcatgtctctatttagtttttctcttcatcaggcaggtacagactcctaccatggccaaagttgggtggggagtgactctcaagagaaaaatctttgatgccctcaagatctgtttctctaccaagccctctccaggtagtgtctctaactttctttaggtatctgtggcttgaagaaaaaattagcagctaccaattgatctgttgacacaggaagtacctgttgcagctgttcttaacattctttaataaaatcatctggacaaattggctcaagacttacctttgtcttacattacagttt

SEQ ID NO: 7222 - DNA, 2104 bp, artificial
  synthetic oligonucleotide
tgggaacaatcatgaagtggctcgtctatttcgtgtgaggatgccaattcaggggctttaacaccactgaattacattcaaaaagagaatacctgactccactttggagtcatgggcagggcgaggggggaggcagggggcacagaagaggaagagggatgactcagattatggctgacatccatgtaataaagggagatttgtactgaccactgtgcatgtaacacactgtgtaccattaaatctagaaaaggatggtagcatcagcccacccctaacaacaaaagatggctgactccggaattaaaaccacgacttttccccttcatacattcggaaatgtatctcaaactcactccctgttaccgtcttaggaatacaaaagctcctcttcgtttgagaaagcaagtaactgggtataactttccactcgggacataagagcaggaggcgtgcctgtctcctcgtccaggcctgacatggtggtgccacccactctgggtcctggaccactgctcacctttcaccacacttcatgctctgactttatcattaagagacctgggaatgtggacctcaggagtgggtacccacccaggctgaccatggatgtggcgtccaagaggccccactaacccatacccaagcaaagacactttcagacttcgtccccactccctactgtggcctgtcccctgaggtgatgcagtcacctgggaagccacccacctccagccaccacgcaggcacacacaccctatcgagctcaactggagcgggaggtggtgggtaagaggtttgcaacagagaccgaacggggcagacggaaccggaccacctctgtccctttcattttcctgggttcccaatgcagaaacgtggaataggggtggaattgtttttaacggtagcagagagccagaaaatgcagacagttgaccttgggaaccaacaccgtcgcagcgggaaacgtaaaagaaacggaacacgttggcaagtgaagggggagcaccgcgcggcgccaggaggagcgcggcggccgaggggtgtggagggcggggggtgtaacaggggtgctcaccatagatcatggccagcccggtctcgtgcagaaagcgcacccggcggtgcttgaagagccagatggtgaggatggtgagcgtgagcagcaggatgaaggtgagcaggctcacgctgtcttgccggtggctctcctccgcctccttctcagtagcgagctcctccatggcgctgctgtcctccgccgccgccccagaggaggaggccgaggccgcggccgcgactcgcagcccccaacccagcagcagcggcagcagcagcagccgcggcggcggcgccccggtagcccgacccgagccagggcgcgccgcgtcaccaggctccatggtcccggggccccccgcgcctcctccgagcggggaccagcagcccgcgccgtcggcgggttctggcagcaccgcggacctgccggagtggccgtggccgctgcagctcctcctcctactcgcgccgggccggggctgcgcccggggccgcgcgggggaggggcgcgcgcagtgcgcaggatccccaagcaccgccccccgcccgcgcacctgttcgtcccccggccgcgccacgccgcaccgccccgcgggccaaccgagccacccaggcggggccgggtgttgccctcgggtctgcgggccggccgccggctgcttgcctctctgcgcttctcaccccgtcctggcgcacctgcccaggcagtctggggtcgtggggccagttcatgggcagccgccgccgcacttccgaaaggggacgccagaggtcgccggcgcctagcgggagcatcggcttggagtgactagccttgcggtctcgagtcccgtctctggcgccacggcgaagtgtttaatctcaggccagtgtgcagccgccctgggcccagtaaagtgggggctgtcagtgaaccgagcagccccgaagccacgttagcccctacacctctctttcctcatctctcaggttgcccttccagccccagaatctgctaggtttcattcaaacctctgttctcatcagactcaaatgtgaggac

SEQ ID NO: 7223 - DNA, 1292 bp, artificial
  synthetic oligonucleotide
tatagacttgattcacatctacaaaatacctctcagcaccacctagattagattttaatggaataactggcttatgttagccagttataaactagggactatagcctagctatgttaacacataaaactgaccattacaggccaggtgcacagtggctcatgcctataaccccagcactttgggaggctgaagcgggcgggtcacttgagaccaggagttcgagaccagcctggcctcaaggctggtgaaacctcgtctctactaataatacaaaaattagccagacgtggtggtgagtgcctgtaatcccagctacttgagaggctgaggcaggagaatcacttgaatccagcaagtggaggttgcagtgagccgagatcacaccaccatactccagcctaggcaacagagtaagactccgtctcaaaacaaaacaaaacaaaaaacaaaactgaccactacagtgatgtttggtgtttcattttgattttaacttccatcagtgaacattttgttctttgtgaaaataaatcacaagctaagataggcttctatggagagagtgtcaatattacggatccatggcatcagttgtaacatgtatttggtctatgaaggtcattagccatctggtaaaaggaagctatactgattataactcactcattgggtgtatgctattacctaattccactaaactgttttccgttcattgatttaaaaagttagttattcaattcaattgaagttaacacctgagaaggatttcaaagaacagatgtgtatttcatttgtagaaatcattttctcatgtcacaaatgtttaatgaatccactctcccttgagttagaaatggtaggtgctttgaaatacttgaacctacacaagagcagaaagcattttattttgaagtgtgcctactgtccagtaataatgttggacaagttattttctctctgagccttagtttgcttacctgtaaaatgggaaataatgattattgtcttgagggcttgggaaggattagatgagaaaacataagttagacacttgaaacacagtagatgttccacaaatattgattttttttgcctccttctatgaatacagacttcataagtgaagtcctatgagttaaaagtcctctccaatttttttgcagattctatctagcagcactattttggatatcactgtgtagcgaagaatcaagtgaggtttccagtgctcattaatttatcaaattgactataaagattcactgtaggtggctttgtatttacttatgtg

SEQ ID NO: 7224 - DNA, 5395 bp, artificial
  synthetic oligonucleotide
tggataaggtctgtggactgtattaatgttaatatctatattgtattatagttatctattaccattgggggaaactgggcaaagggtacatgggaccactctgtacatttttttttacaacttctgatgaatctataattatttttaaataagtataataaagtgagataagtctgaaggactacgaatattttagaactcacgcatttccatattatggaatataactagatctttaacatggaaaacagacaaaatacaaaagagcctacattattgttcatcctagaaatgtaaacgaaaatagcccaggacagtagctcatgcctgtaatcctagcactttgggaggcccaggcaggcagatagcttgagcttaggaattcaagaccagcctgagcaacatggtgaaactgtctctaccaaataaataaataaataaataagttgggccatggtggcatgtgcctgtagtcccagctacttgggaggctgaggtgggagaatcacttcagccccggaggtggaggttgaagggagccaagaggttgcagtgagccaagagatctcaccactgcattctagcctgggtgacagggagcccagaggttgcagtgagccgagatcgagccactgcattccagcctggcgacagagtgagaccctgactcaaaaaaaaaaggaaaagaaaaaagaaagagaatgagttcatcatagttgcatatagcacatttccaaacccagagaggtaagccaaaaaggtttgttgcttaaacatctatattaggattcaaccaaaggatcagaaccagtaggaaattatatatatatatatatatatacacacacacacatatatatatacacacacacatatatatatacatacacacacacatacatatatatatacacacacacacacatacacccacggtgcccagcctgccagaagaatgcgtggtgggaatatacgtatatatactccctgttcattcatttcttcgaagctattgtcttagacgattatggtggccaagtaaatccaaaatctgtagggcatacagtcaggaagggaagatcaggagcaggctggaaccaatggacataggccaaaggtgtcatccataggggaaattctctttctctgacgtactcagcaccctcagccctgattgaaaggctttccaactgattccgtcaggcccacctagattatccaggattatctccctaactttaagtcaactgattaggagctttaattacatcagcaaaatacctccagagcaacacctggattggcattcgatcaaataactgtgggcgatagcctaaccagtggacacatcgaaaaagccacacaacatcacaaaccacctgtgctggcaactgaataaatgaattatgttaatagccaccttggctttattattacaggtaattcaagcacaagcgacataaatcaatagcggccaccgagttgatgtatgagagtcccactttggaacttcagagttggaaggggccatgaaaagcttagtttgtatttcaacacagccgaggcatctgcacctcgtcctctctagcgctcggcggggctggggcgtctcgggcagtggcgcacccagctggacgggaggggagcccacctggaacgcggcgccgcgggtgcgggagcggcgagtgggcggggcgtcgaggcggcgggtggcgacggcgcccagcccgccagaagaacgcgcggcgggcagacggctgggagccgctccggtagggcgagcgcggccggcggtgggtgggaggagaggttgggggaggaaggaaagggaagaggcggagcgtgggagcgcacagtgtcaggaatacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggtaggcgccgcggaggccggacccggcgcgggcgaggttgggggcgtcgcaccggctgggcggcgggagcggcggcctccgggagtggaagcgggcggcgcggagcgcacagtcccggcccggcctcgccgcgctccgggtcgctccggttccacatcgtggtcgcctccggcgtccccggcgccttggggccgagagcgtgtgtgggctgaggtaaagtgcctggtggcccctctgcccgcccgggtagtgcctggtggcccgggcggggggcgggggcggacgcgcgagctcggctgcagctcccggctacaccgggcaggaattgagcgccataactgttgcggctctttcctccggtgccccctcctggcgccccctcctccgttcctgccctttgcctggcttcggggctgacggggccagacccgtggcgggaggacctgctctgtcggccgccaggggtcggatgctccagggagcgagggcgcgccctggctgtttagctgttggggggcggaaagaaccgagtgcctggagaggggagaacgggtggtgctgggtgcggcgaggcaccccgggaagcccgggtgcccacccggcgggagcgggagcgcgggcgcccggcgggctggcgaactttccctcccactggcggcattgttcgaactgcgggtccgtggccgccgagcgtcgggcggtccgggggtgggaaaatcgtgagggctttgctagtcttccggggaaattttcccaccgctgggcacggcaaagttaacttttctccagctttcgagttcgttttattccctccgccccgggggccgtagtttgtttttttgttttgttttgttttgttttttgtttgtttgttgttttttttaatagccttcaatctttttctcccgcttttcacagcagagccagtgcttcggtggagtctagctttaaattgcacagggcagcctgagtttgttatttgtgaggagggggtggcgggatctggagtgagtgaccacaatggtggtatgtggaggcatgtttcaaagtttttatcgctgtgcggccctgggacatatgtggctactagggatttggcaagaaacttgtttggccgcttctccgactttgagttgcaaggaaatccgtggcctcagatgtgcgcgagttgtttgtgtgtgtgtgccgtgaggtgcgtttatctatgaagctgaggatgagattcccccctcccgccgtctgattgtgtaagaagtcaaaaccgtgttgaaggtgattccagtggtggcctggagggaaaggcgacctcattccctgtgttcagtctgataaagtgaactgctgctctctaaacttgggaagtaatgaaaaataatttaggtaaaaactggttgcacaacgtctttgcttagtttaagcaacccacaatccactttcccagaccagttctcctgttaaatactttccctttagccacttcttgtcagcctaggctgggagggggaaagagtagggctgagagaggagtcggtctgaacaaagcattgtgtttttatttagtttaatacttccaaaacatctgtagacaatgggagtatgggtcccggccttcgtaccctttgagtagtgtggttctcatgcttttgtagcatcatgtgattactcttcggatacgtaaaaatagattttttttcttttttgtttaacctaagagtattctacctccataacatatcattttctctttcgtttaaagtgagctctgagcttaaatacttgaactgtaaaaggataataccctctcttcaaggattacctgagaccgttgagaagtgtttcagtgcccagcgtgtattcaactttcaatcgatgttagccaccatctttgccaccttttctccagttgtgctcttctttatgcttttgtttgctagagaatagcttttaacccaatattgttgccttgctttctgtccagtcaattctggaatactcaggggtgcaagtctggctctagaattcacactttctctctcccctcttctctgagtcatgttgcttgccctcggcaatgcgatgtgaatctggtcataggtagaaaaaagtagagaaaggcttcccactcctccctgaagtgttgtgacccaccttcaggcccgtaggggagattcccaggagcaggacaggtgatggtgcagggctggcatcatagctaagaagtatggattggtgaaagttaaagaagaaagggtgttgaagacttgtaggtttagtattgtcctctcctttaataatgcttgtcttttccctctcttgtgttccaccaaccataacaacccattttttcccctaacctacacaaagccatatcttctttctgcccactgctttgaggtctggctggaactaggcaagtattttggaagaggtgggggaggtaggaggcatcaggtgctggtaaagacatggcattagggagggctcttacaagccttgatcagagttacagagagccagtccaaaaatgaagctgagcattatcaggggacataatgcacctacctccttgtggagcttacacaaaataggagctgagaagacagaggtaatatgctgtcttacattaagaaaatctctcattgaggtatgatttactatgatcttgacttgtcccacaatataggtgagaagtgagtgttaggtgacacctgtctggcactctcctaacatggggacactttaatggctcacaagtttctgttgttccagttacagtggctgggaaagctgaaacattctggtttgtatggtggggaggatctagggtgaatgggtaaaagtgatgaacaaataaacgggtactagcaagtaagtggtcattacaaaccaaataactaccactttgagttttctgatttctggaatctttatgactccctcatggttatttttgccttgttcctgtaggtctttccatagataataacaacaaaattcttaccattagaactgcctctgtgcttttcttgggagaaagtaaaaaaaaaaaaagggtcctgggaaaaacttgcccgatttcatagctaggcttgtgaaaaggaaggtgataagtcagaagacagccgactgaataaaggacctggtgtgaggaaatagtactggggctttgaccaataggaaacacctatgagttcatcaatgcttttcaagcagcaaataatttaatctttgccaaaacccagga

SEQ ID NO: 7225 - DNA, 186 bp, artificial
  synthetic oligonucleotide
ttggaattgtatagtgatttcctttgatttaatcactggaaaggatccctggtgagaaaggatggtgtcgtgcatggggtaagatgctatggggcagagctcagtgctctttggtttttgtaggcaccatggctgaggaaacagctccagcagttcttgagcggcaccagggggccctgtactccc

SEQ ID NO: 7226 - DNA, 5569 bp, artificial
  synthetic oligonucleotide
taaaaggtactatagaagggcgaagaatcgttcaactgtcaatcagcctcttgattctttgtaaattgccagggtgggtgggtacatatctcttcttgattctgcatttcatacttaactatattaaagcttcaaggaacaataaatagtaacctggtaatgacctattatgttcctttttattttcatcacaatcttataaaatataccacaatgctaactaacctacatagatatttcatctcctatatgttattttacaaactaaaatacggctggagggttagactcaaacatgctgtcaaaatccatggttccagctgccacctactggatgtaaaagtaatatgtctctttggaaagaatacttattttaaaaatagctttattgagttataattggcctgtacatatttaaagtgtataatttgacaaatttgtcacatatatacattcatgaaaccaacaccacaaacaagataatgaatctatccactaccccaaaacttttcttgtcctgtcataatccttttcttcagcccctctgcctgcctgtcccctgctcccaggaaaccactgatctgctttctgtcactataaattagtcttaaaattaggtagtgtgatttctgtaactttgctctttttcaaaattgttttggctattttaattcctttgaccttccatataaattttcaaatcagcttgacgatatctacaaaagaaatcaagctacaattttttaattggaattgcttttttttttttagacaggatctactctgtcacccaggtcggagtgcaggggcacgatcatggttcattgctgcctctacctcccaggctgaagcaaccctcccacgtcagtctcccgagtagctgggctgagactgcaggtgcgtgccactatggtcattttttcgtttgtttggttggttggttttttggattttttgcttttcagagacgaagtcttgttatgctgcccaggctggcctcaaactcctggtgatcctcccgccttgacttcccaaagctctgggattacaggaatgagccaccgcgccaggcctgaaattgctttaaatctgtaaaacgatttggagataattgacttctttactattctgagtcttatccatgaacagggcatgtctctcccgttatttaggccttcttcaatttttgtcatcagtgttttgtaggtttcagcatacagatcttgtacatgttttgttagatttatatccaagtatttcacttttgggagctattgtaaatgttattattattattatttgagacagggtcttgctctatgggccaggctagagtgaagtggcacgatcatagctcactgcaaccttgcactcctgtattcaagcgatccacacacctcagcctcccaaagtgctgggattacaggcgtgagccaccacacccaaccttattattattttttggatttgtttccagttgatcattgcttgtttatagaagtgtgattggcgtttataggttgactttgtatctgatgagtttgctaacctcactaattggttctaagagtatttctgtagcttctctgagattctttgggtgtataatcatgtcttctgtgaatagagacaattttctttctttctttccagtttgtatgtttttatttttcttgcattattacactggctaaaattgccactattatgttgaatggaaatagtaagagtagacagccttgtcttgttcccaatctcaagagaaaagcatgcagtcttttattattaaatatgatattagttatatgtatttttgtggatggcctttctcaaattgaggaagttcccttctcatttacttttctgcatgtattaatgtgattatgtggttttccttctttagactgttaatatgatcaattcttgcattcctgagataaacctcccttggtcatgacatattactacttttatgtgttgctgaattccattttctaatattttgttgaggatttttgcagctactatcttttgtctgtggttgacatcagggtaattctggccttataaaatgaattggaaagtattccttcttctactatctggaaaagaaaatgtataattattattcttctttaaatatttggcaaaattcatcagcgaaaacatttggacccggagatttctttttcagaagctttttaacattccttaataatgacaaggccacttggttgccttacttaattttggtgaggtctgttagtttgcggcttccaaggaattgatccttttcatctaagttgtcaaatttatgtatgtagagttattaatagtatttccttattatccttttaataatgcctgagaggtttgtagtgatatccccttttttacctgctattggttatttgtgtcttttttctttgtcagtcttgctagaggtttatcagttgcattgatctttcaaagacctagcttttgatttcattttttggttgtcaatttcattgatttatccttttatctttgttattccttccttctgctttattctgatttattttgctctttttctagtttcttaaattggaatctcagattatggatttgagacatttcttctgttctaaaataacatttaatgctatacattttcctctcagtactgctctttctgcagcccacaaagtctgatatattgtattttcatttttgttaaattaaaaatattttctaatttccttggagacattttctttgacccatggattatttagaagtgtgtttaatttctaaatgattggagattttattattatctttttgggtattgatttcagatttaattctattatggtcagagagcatattttttatttcagttctttgaaattcaagttggatttgttttttgtttttgttttgagatggagtctctcactctgttgcccaggctggagtgcagtggtgtgatctcagctcacttcaacctccacctcccgggttcaagtgattctcccacctcagcctcctgagtagctgggattacaggtgcccaccaccaagcccagctaatttttgtatttttagtagagatggggtttcgccatgttgactaggctggtctcgaactcctgaccttggcctcccaaagtgttgggattacaggcatgaccctttctccttcatgttacaagtgtattatatattctgtatacattgaaaactcatcagtgttaaaaacttttgctttgaactgtcaaacatgttttaaagaactcaaaaggagaatagtccattatatttaccaagatgtttaccattcctgttcttcttccttcattcctgatgttccaagtttccttcttgtatcctttttatagtttacagaacttcctggctgggaacggtggctcttgcctgtaatcccagcagtttgggagcccgaggcaggtggatcacctgaggtcaggagttgaagaccagcctggccaacatggtgaaaccctgtctctactaaaaatacaaaaattagccgggcatcatggcgggagcctgtaatcccagctactcaggaggctgaggcaggagaatggcctgaacccgggaagtggagggaagtggaggtcgcagtgagctgagatcgcaccactgcattccagcctggaaaattcgatttaaaaaaaaaaaaaggaacttcctttagcaattcttttagaacaagtatcctttagcaattcttttagaacaggtatcctggctatgaattcccttagttttcttttctttcatatgagaatgtctttatttcactctttcatatgagaatgtctttatttcacatgaaggctattttcactggatatgcaattcagggtcaatagttcttttctttcagccttttggcactttaaaagtgtgtaatttccttctgtctgtctgaatctgttttgtattgctatcatagaatacctgggtctgggtaacttacgaagaaagagatttatttggctcacaactctggtggctggaaaggttaacagcatggtgctggcatctgcttagcttctggtgagggccacgtgctgcatcacaagatagcagagaaggcaaaggggcagcaggtgcatgcagagaaaccaaacacaagagacaacctcactttataacaacccgctctcataggagctaatgcatttcagagagaactaatccatcagaactaatctagtctcacgagaaagacattaatgtatcttaacaacctaatcatatcttaaaggcaccatctgccaacattgttgcactggaaactaaggttccaatgtgagttttggtgggtatgctcaaaccatagcactggccttcacggtttgtgatgagaaatccatagtcattgaaatcactgttctcctacaggtaatgagccatttttctctcactgctttcaagatattttattttgccgttagttttcagcaatttgattatgtgtctggatgtggatttctttagctttatcctattgggggtttgcccatcttcttgactttatgtcttcacctaacttggaaagtttggggccattattgctttaaatatgtatattttttgagacagggtcttgctctgtcacccaggcctgtagtgcagtggcacaatcacagctcactgcagccttgacctcctgagctcaagcaatcctcccacctcaacctcccaagtagctgggaccacaggcaaatgccaccacgcctagctttttttttattttatttttttattttattattattattattttagagacagggtctccttatgttgctcaggctggtctcaaactcatgggctcagatgatcctcccgccttggccccctctgtagtgccgaaattacaggcttgagccactgccttcacccggcctcaaatattttttctgccccacactcctctctttctgggactccaatagcttgaatattagactttttgttgttaccccacaagttcctcagactgttgttgtttttcaatctttttttctctgtgttgctcaggtttcatattttttattgatctatttttaagttcactggctcttcactctgtcatctctattctgctgttgtgcctacccagtgattttttaaaattttatctttcagtttcaaaatttccatttgattagtctttatgtctcctcttttctattccaatactttccattttaatatttgtttcaaggatgattgctcattcaatcatttttataaagctgctttaaagtgcttgtcagattattccaacatctgcatcatcttattcttggcatctactggttgttgttccccatttgaattgagcatttcattattctttgcatgctgagtaattttggattgtatcctggccattttgaatattgtgtattcataatacataatatgggccttgtttaaatcatatgaagaatgttgatacatttgttttagcatgcaatctatacggttaggttcaggccacaagttccatcctgccttctgttggtgtgggttttttttc

SEQ ID NO: 7227 - DNA, 3022 bp, artificial
  synthetic oligonucleotide
atcacacgggtgggtaaccgtcagtgctgcctgatttcacagcgtctgctattaatacagcacagcagacctggtagccctaaattcaaataccagttccacctccaccatgtattcagttatgtgagctagggcaatccacttaacatctctgtgcctcagtttcctcatctgtaggatgagtataataatagagcccacctcgaaatggggtttgtttcgagtataagatgagctaatgcatgtcaagtgtttagaacacagacggggcccggagcggtggctcatgcctgtaatcccagcaccttgggaggccgaggcgagaggatcgcttgagccaggagttcgagaccagcctgggcaacatagcgagatctcgtccctataaaaaaaaaaaaaagaatgcagacggcaacgagcaagtgccatatcggtgtttagtattatcgttgtactatactgcttctaacgtgttttgagcgctgtccacttgaggtgtgatttctgtctgcaaaataaaaccaatcctgcctctggccctggaacgaagataccgagagacaaaggaggaacacaaggtaggcaaaattcccaagtcttctaggctttcgccggccgcgcagtcctctactgcctaagaacgtcctctacagcgccccatctgccgatcccggactgaccccttcggggttccgtccccactacccccccccccccccccgcctctcaccttctcatacaagttttcgtcctcgggttctgggtcctcttgccacggtgtggtcggttctgggggccgctttcccgccacagcggacggggcgaccacagtcctggagaagctagattcccagcggacgcgggcggccgggagccctcgcgtcgccgctgccgccaaaagacggcgagcgctcaaaccaaacagcccagccgccatgacagatggtgctgcagggtctcaggggcggggaaagaaatgcgactgtgcgcagctgcagtgggtgcgagcgcgacaatcatcgccccgcctccgccacgctatataggtcccagatctgatttggttttccaatgaggcggggcgttgagcaaccctctttgcctccagttgtcgtggcttcgtggggccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggttgtctgcgactttgagtttgtgcataggagaggggatgctgctctgtgttactctggtgtttatcggtccatggggaaatattctgtggttctggtctctattcctgggggatcggaggggggatgtgactctggtctttaccctttgagggggggcggtctgtgactctgatccttatccatggggcggggcttgggggacgactgtcttttgattgaccctaacccacttattgggtgggaaggggcatgcagggaatgtgtgtgtgactcattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaccgggcttgagccctggggagggaaccaccttaggaccgggctgcacataagagacagggctcagggctgagccagttgctgtgtgagggccaa

SEQ ID NO: 7228 - DNA, 1271 bp, artificial
  synthetic oligonucleotide
tattataatacgggtttgtatgtgaaactataattttacttattgttatgtttatggtctgtgtatcttgctagaatgtcagctccatgagcccaaggaagaatttccagcacctggcccatgtcaaatgaacttttttggccacctgagtctcggtctccccatctgtaggatgggtgtgcctttccatgtggaggcacccacacgttccgtttcctcttcccaccctacagagcacggctccggcaattccacagctcaggcttacattttcccatattctggacgctggtgcccaccacgtgcaccaggcactggccagacagaactaccacccccagcatgccgcgcgcatttgggccgtaccacaacctgtagggtcatctgggtctgaaacgggcaccagcgacgcgggagcagggactgacgcccctctagcaaagcatctgtggtacatcccagacccggggctctccaaggccccgcgcttccgagctccgcgcaaactctggcttctcttgtacgacagaggtggtttgctcttccgttgccccgtggcttcagctcatctttggcaggaaggcgaggcttccgcccggcacagggggtgagctggagcaccgtgcccccaagcctctggacagcatttggaggagggtgcttccctaatcccaacttcggggaaacccctcatgggcgtatttggagcctccgggcccggggtgatatttagggggcgtctgcttttgagacccttaaggggtgccgtttggggacttcggggtgggatttgggagtctgtttcggggagcacccctcggaggcagggtttggggggctttggggagattcttagggtccgtgtatgggcacccttgtccgtggagcaggatttgggttattcttcaaggggagaagcaaagcttgaggttactaaagtcaaggcgggactgggggagggcttgtttcaggacggggtcctggtgacagaacaatcgggaccgacgtggcattgtggaggtgtcaggcctttgtgacctctggttttgtgatgaggtcctccccgcgcctggaggctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggt

SEQ ID NO: 7229 - DNA, 1750 bp, artificial
  synthetic oligonucleotide
gacgagggcctttactcccggcagctgtaagtggggccaaggccgggctgaggggtgtggaatgggacattgagaggataaggttgggtggggcaggccctgacctagagtaccccctaacctggcaggtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccaggtacctcttcctagcacccttccccctttcccccttcccgaggcaccactgttcccggtgccacagccatttcatctttttccctactgcacacccttacagttctacctgcgggaggaggacatcggtaaaaaccgggccgaggtatcacagccccgcctcgctgagctcaacagctatgtgcctgtcactgcctacactggacccctcgttgaggacttccttagtggtttccaggtatcttgggggtactacccagccttctgcccagttttctcagagcccatctctggtttattcagtagtgttcaatattgatttaatgggtcggcctgaatgtcaggttttgtgctgggggactagagtatgcaggcagcagttagcccctggccctgccttttcttttcttctttttttttttttgagacggagtcttgctctgtcgcccaagctagagtgcagtggcgcgatctcggctcactgcaagctacacctcctgggttcacgccattctcctgcctcagcctcccgagtagctgggactacaggcgcctgccaccacgcccggctaatttttttttgtatttttagtagagacggggtttcactgtgttagccagggtggtctcgatctcctgaccttgtgatccgcccgcctccgcctcccaaagtgctgggattacaggtgtgagccaccgcacccggcctggccccgccttttcaagtggggaagatgtgtacagacagtacagcatagtggttgtgggcacagactgtagagccatactgccttgctgcaggcctccagccttggtagtgtgacttcaagcaggttgtttcatctcctgtacctttgttttcctgtttgtagtcagtgcgtggtagcagcactgacttcatggactttttgtgagggttaaacacgtggaattgcagctggcatataaggactggatgggtgtttgttaattaaaaagtccaggccggaaagaggtgctctggaagctgagagttgtccctggagtatcccaggttgccagggcactgcagctaaatcctgatggaggagtaggagctcaccctggtggggaaggatggacattcaggcagagagcaaaatcccaaagatcatggcggagcaggcgtcgtcttgagaattggaagcaggtgggtgtggtaggagtgagctcagactttggctggagacagagttttactccagtgtctcacagggcatggcagacagacagcagcgggtgtttgtcaaataaatgagtcagctcttctccaaactccctcctcccagctacctcttcacctttcctggtatagtccaggggttcattttcgacccccacagagtctgatacacagtaggtgctatgtgtttgtgaaagaggctgacccagcaaagcctggatgtgtttgccttgaggactgcctgagtcctcca

SEQ ID NO: 7230 - DNA, 3309 bp, artificial
  synthetic oligonucleotide
actgcctgtcttgggtgctagggatacagaggtgaacaagatgcacaaaacagacaacttcatcttgtcttcagttgtctctcctggagactgttgtccctcctgggagagtcttggtttttttgtctttttgctgacaaattttcattttgcctaaaatctagagtctttactgtggcacacaaagcattgtgttatcagaattctcccccctcattttgcattcaaaagtcattccccagaggctttccctgatgggaagttacagccggtatgtgtcttgtctagcagtggcttattagagtaaaagtccacgctccatacctttttttttttttttttttgagatggagtcttgctctgttgcccaggctggagtgtagtgacatgatcttggctcactgcaacctccatctcccggattcaagcgattctcctgcctcagcctcccaaatagctgcaattacagccgcgcgccaccacgcccagctaatcacactccacacctctgactgggacacaagttccttcattctcaggccactgctgacagccttggcctcttcatgcatttacgcgtcaccccttcagccctctcacacctcagattcagaacggtttacatgtggatctaccaatggcttcccattatcttaagtaaaatcccgggctctatccccactgtccttgtacccgtcttgggagtctcctctgctctgttgcagacgctacgtgaccaaacccaactcagatgatgaggacgatggggatgagaaaggtgagggggctaacagtcagtgggcgggggctctgggttaggtctgacccacgtagggttcgtctaggtgtgcattgcagcttagcacttgaggctcacaccttcccatctctgacatcctcctgtcctagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatggtatttcctttggctatcagcgagggctggggaggctggaggggagatttcctggcagcaggatccatgaccacctctccctcacccccagcccagccgtacattgctatcgactgggagccagagatgaagaagcgttactatgacgaggtagaggctgaggtaaatgagatcccagggatggggggtacttccagctcttgcccctcaactcttcgtacatcctccccacaactcctctagctgggaacagagccaagagatccaggtcaagcttggccttggggcctgaacacctactgagagctccagggcctgaggttcctagcttcaaagtcggtgctctgacccactcagtgtgtgtctcccccgctgggcccccactccccatttctccatctgtcctcacagccggccatctggttgtctgttcacccaatcctagggctacgtgaagcatgactgcgtcgggtacgtgatgaagaaggctcccgtgcggctgcaggagtgcattgagctcttcaccactgtggagaccctggagaaggaaaacccctggtgaggggccagagcggggcctgtgtgtgggggtttcattggatggaactactatatttagctttttttttttttttttgagacagagtctggctctgtcaacccaggctgaagtgcagtggtacaatctcggctcagtgcaacctctgcctcccaggatcaagctgttctcctgcctaagtctcctgagtagctgggattataggcacccactaccatgcctggctaatttttatatttttagtagaaacaggttttgccacgttggccaggctggtctcgaactcctgactaaagatgatccacccgccttggccttccaaagtgctgggattacaggcgtgagccaccacacctggcctatatttagctctttaagtataccttcctcctccctcctccacactcaaacccttcttgccaacctggccaccaatctcctgagcagactcctaccccagagccttggcctgtgctgttccttctccaggaatgttgttcccagtgatctacaggacttcactccttacgatgctcaggtctccgatcaaatgtgacctcatcagagagacctcctctgactaccctgttaaaaatcacccttccccaccatccctctccatcccctctctgctcttttcttcctagccaagcattactttctagctcagcgatgccacttgatgtgatgtcctgtatccacttttgtgttatttgtcatcttcgttagagtcaactcctcgagggtgaagacttaagttcactgtgtgttgcttctacctgtttataatagtgttgagtgttcggttgatgctcagtagacacttgcagaataaacaaaaagagaaccaaaaccacactccctagtctcagaaataagagcagcatgtccgtggagcagaaatggaacagaaatacaaaatagttccaaagggttaaacaagcaatcaataaatactggggagtgaatgaatgactaaaatacgaagagaggaaactagaaggatagaggtgggctctaaaataagactagcatctcatggaacagaaatcaaacaaaaatacaaaaaatagtatgagcacatatacaaaagatagtaagcacttgacgagtgagtgaaaggattttaacaggaacagagcaaactagaatactagatgggctaatagtaagagcagtgtttctgtgagccagacatggcacgtgagaggcagtacaaagggcgcacagtaggtgctcagaaaaagtctgttttggctgggcattgtggctcatgcctgtcatccgagtaccttgggaggccgacacgggtggatcacctgaggtcaggaattcaaggccagcctggccaacatggtgaaaccctgtctctattaaaaatacacaaattagcagggcatggtggtgcatgcctgtaattccagctactcgggaggctgaggcaggagaatcgcttgaacccaggaggtggaggctgcagtgatccgagatcgcgccactgtactccagcctgggcaacagagcgattctctgtctcaaaaaaaaaaaaaagaaaaagtccgtttgctgactcgggctctgtctgtaggtactgccct

SEQ ID NO: 7231 - DNA, 1018 bp, artificial
  synthetic oligonucleotide
gagcttatattagtaatggctgctgaattgcgttggatgcttttttggtgtaagttaacagcagagtgtttccctctgtaatttgttgatgtaatacataacattaggcctggtgcagtggctcacacctgtaatcccagcactttgggaggccaaggcgggaggatcacttgaggtcaggagttcgagaccagcctgaccaacatagtgaaaacccgtctctactaaaaatacaaacattagctgggcgtggtggcgggcgcctgtaatcccagccactagggaggctgaggcaggagaatcccttgaacctgggaggcggaggttgctgtgagctgagatcgcaccattccactgcagcctgggtgacaagagtgaaactccatctcaaaaaaaaaaaaaaaaaaaagaaaaaatacataacattattaagattgaaccatttttttctggaaagaagaggctaaaagcttcccagtaaaagaatttaagagggatatttcatctaagagtggaaaaaaacaaaagacggcagaagaaaggaccagccgatttcctttcatttagattatcagctttccaggtttcctgccctcacagtcacccaccaggtccccttgaacctgcccaccccatgggccttaagcacccttaagcactgccccagttctacttctcctaaacccagatctgccttgaacttgaactgaggtgtaggctggctgagtagcgagtgaagcacctggtagagccactcaagaagggaccccaagctcattaatttggccccaaatttgatcattttgtaatccaccttgactcatgctctggggatgctgaacattgtggcgtgaatgtgggatgacactgatgatatggatactgtccttttaggatttcttggtgtctctgtggagccattgagccttaccccttactggaggctgcaggaccctctacacacagacagctgtccagcacggaaggtgggctgaggcccagggtgaacatgccagct

SEQ ID NO: 7232 - DNA, 1828 bp, artificial
  synthetic oligonucleotide
atcgggattgattaaatgagataatgtctgtaaaaagactttagaacagtgcttttttttttttttttaaatagagacagggtttcaccatgttgcccagactggtcttgaactcctgagctcaagcgatctgcctgcctcagcctcccaaagtgctgggattacaggtgtgagccaccatgcccggccaagtgctttcttaaaaaatagatttaggctgggtgccgtagctcacgcatgtaatcgcagcactttgggaggctgaggtgggcggatcacccgaggtcaggagtttgagaccagcctggccaacatggtgaaaccccgtctctactaaaaatacaaaaattagccaggcgtggtggcgtgtgcctgtaaccccagctactgaggaggctgaggcaggagaattgcttgaacccaggaggtggaggttgcagtgagccaagatcttgccattgcactccagcctgggaaacaagatcgaaactctgtctaaaaaaaaaaaaaagatttagaaggccgggtgtggtggctcacgcctgtaatcccaacactttgggaggtcgaggcaggtggatcacctgaagtcaggagttcgagatctgaccaatatggtgaaacccccgtctctactaaaactacaaaaattagctgggggtggtggtggtgtggctgtaatcccagctactcaggaggctgagacaggagaatctcttgaaccccggaggcggaggttgcagtgagctgagatcgcgccactgcactccagcctaggtgacagagcaagactcttgtcaaaaaaaaaaaatagatttagagggtacagctgcagttttgtgacatggatatattacatagtggtgaagtctgggcttttagtgtccccatcaaccaaatagtgtacattgtacccattaggcaatttctcatccctcacattcctcccacccagaatagtgctggatacgcagtaagcactccataagggctgctggtagtttttgttgtgttcttgttattgggctatcatccctgagttaatcaaacttaattagcaagggagtatggtgagtgaatgagataatttatacaaacactttagcacatagtacacagaaagtgctcaataagtggctgccatcatcactacaattattattattgatctatcctcctcgaattaaggatgttaatcagaaccccagggaaggttcctgcattgtcagaaagctggtgggcaaggattgccccaccccaccccccaccaggggtacaggtccatggggagggggcagggcaggatggggtggggattagttttctactgacccactcacttgcttctttcaccatcattcatggccacccccttcccaatgctcattcattcacccgcaccattccctgcttgctaggacggtgccactcctgagttacaaccctggtgccaggtagcctctgtttgaatcccggccatgccctgtgatcttaggaaaattctacagttcctctacgccccatatttcctcatccgtaaaacgggaataagaaccggtacccatctcagagatttgttgtgagctttgagtgagataaactatgctgagtgcctggtatacagtaggtgctgtataaatgccggctatttgcctgtgttatttgagaccctggctttggctcctggccacctgagttccagtctcagttctgccatgtattgactctgtgatcctgggtaagtcacttaaccactccgtgcctcagtttccccattttgtattcctcccctttcacctgccttatctccctccactgctgctactta

SEQ ID NO: 7233 - DNA, 2031 bp, artificial
  synthetic oligonucleotide
agacaccagagggtgttacactgacctcctggctagtccaagcctgttccctgatggctcctgatggcctctgagcccagtgactatcttgaagccccactggctattcctgtgcttaaactccttagccgccaaccgggtggggccccttactactgccagtttttccctgtcctttgggacaattccacaggcgacctgcctgactgacccccagggcctattccccagccaccattccaggacactgatttactggcttactgttacctttcaggacccagtgacatttccctcaatgggaggggctgtcctggggtatgtacttaggtggggtgagagcaagtctccccagcggctcagtgttgaaagctgaggagaggaagttctgctccacgggggaggcagggagaagccctcagagatgtttccctcctcccttccaggtgtttccctgtttatccatcccctgcaaactgcagagtggcactcattgcttgtggacggaccagctcctccaaggctctgaaaagggcttccagtcccgtcaccttgcctgcctgcctcgggagccagggctgtgcacctggcagtccctgcggtcccagatagcctgaatcctgcccggagtggaagctgaagcctgcacagtgtccaccctgttcccactcccatctttcttccggacaatgaaataaagagttaccacccagcagacactgtttctgtgtagtgcctgggaacaaacccatgttgctgatgacctggtgtgagcaccctgggaccagtggggatgagggatgccaaatgttgggtttttatattttacttaaattctgatgtactggtagtaattctcaacattggcattagcactgatgatctgcaacagcagcaatggtcactgaacctgcattatcaaccgtaacctctgaataatttctccagccaatactttaaaacattttcctatactgattcctaattgctatttgcccagggctttctagttataaattatcccacagctgacaaatcactgccttactggaaattccccattcacacatcttgccagctgacagagtcattgacaaatgccctaccaattggcaaatgactatcattgcctcaagcacagtcctgatgttgtccagtgaggatgccccatccaaacacgtgggtgttactgtcctcatcctcaggttttgtaccatgagtctgacttgagtgaaaggggacccagggcacccagagtcccacagtaacccagctggggacttgggaagaaggggtggccctggctccccagccatggctgcaggacattccttggaagggactgtttggggcagaggagaggtgggatggagagaaggtatgagctaaaaatccccaagctctgccatcctccctcccctacttctcccctcactcctctgaccaacttggaaggaaatactgacagcaatgaaatgcaggtagggttcaaaattaagaccagccagatatgctggcccataccctccacacacctccctcaacccaactgtcccctcacccaaactagggtctctagactcgaccctcacctttatgaatcatcctttctctagaaaaactgagtgagagaacctccaaatactcccctctgaggccttcctgcttccacagcggggtccagtccctggctcctgcccctcatactccaaaggtcttgactcaagtgaggcccttgggaactagaatttcagactggtgcaaacattcaatggagcacctgtgtcctcctgacctgaacgtgcttgaaaagggccccaatatatctcctttggtaaagaaaaggacccccaaattccctctcatcagagtacccactgctcttaccagtaagaacccaggtctcctccagggcattctaggtcaccaagcacagccccctggatcttctgtggtcctgtcccagagccttttacactcctgggaggttaccccacggcccaaattatgtcccggatgggaatgggcaga

SEQ ID NO: 7234 - DNA, 1572 bp, artificial
  synthetic oligonucleotide
gtcactgcagaggagagggtgaggaggcctcattattaataccactgtggaggttgaagctaaaatggtaagaaaatgaagtaactaacagcaattagacaagaatattaaaaatactggtataaatattgggagggggcctatatcaaggctggctttgctgggtcacagagcatgtttggggtttttcaggtctggtgggtctcagagatgacctagtgttcccagagggcagagtgagatagcctcattactaatattgttctggagggttgagctcaaggaataaaatatgaaaatggaataaatgccataaactatgaagggtgtgcagcatatgaccagggcagttctgggagtgtggaggcactagggcattctgtggaagtcttagtgctggtcagatatgtcacagggtgggcctgtgtttctcggaagaggaataaaaagggatattcatgaatattgtttgggaaatttcagtagaaggattaagaaaatgaaataactggtataaatattggggggaggagaaacccagcagtggcctgggggtctgagagggcaggatgggggaaattttaaattttagctgtaggaataagataatgaaaacaattgatataaatattggggtagaccagtgctcctctgggaatttaagaagacagtgtgtggaagttggcattaaacatgttgtttcagaggttttagcttaaggaataagagaagaaaataattagttaaaaatgttgggagtcccagaggacgaagtaagcaaaagttggtataatactgtcagggaggttttgattctaggaatatgaaatattctggaataagagaagactatgaaataactagggaagcccagcactggtccaggggtttcagaggacagaatgaggaccagccattattaaccgtgttttcaagatgttggctataggaatacggcaggaaaatgaaacgttgtgcatggcagggcagcatcactttggggatctcagagtgggagtagaaagagtcagtattaataatgcagtggtggttttcgccaaagcagtaagacaagaaagtaggtgagatagtgtttaggggcccaatactggtcttagggtaccaatggatgggttaaaaactgataaattttaacattgctttcaaagtcatagctatggcaattaaaacaaaataaaatctctgatataaatgtcaggggggggttccagccctggtctgagagactgtaccttgtcatagtagtaccgcaaggcccggctgagcttgtcgtaattcatgttggtcttgttcttgcgtagcccccacagccgggccacctcctctgcatccaccagcttgaattcaccaccatcccgtgaagtccaggagatgatgtggccattgccttgctctctcagcagctgcagcagaaactgccacagcgtcacagatgggtccatcgctgggggagtgctcacgccatcccaggggtacctggagagcaaacagctgagttgagaggctgtggacataggaggggcagaggtcagcgggaggaggattcctttt

SEQ ID NO: 7235 - DNA, 1045 bp, artificial
  synthetic oligonucleotide
aaaactcaaaaccactgcatggggaaggttccagaaaactccccatttcacagaagagtaaagtttatagggcacagaaaggcgaggtaggacgtattcacaaggatgaagaatggccgagccaggattcgaacccgagaactgtggctccagaaaacaagccttaatctgttaaacatcggaggccgcgcatgcgctgacacgcccctgctatgaacgccacgtcccagccaaactgcaccccggatgtcgtccccacttctcgctccaaggagcgcggggccggactctgaacgcctcgcccgccaattcaaagggttggccctaactttgaacgccccacccaccacgtggaatgttccaaacgccccgccccccgcactgtcactcaccgcaagtcccgctgcagcacgtcactgatgaaggtctcgtagcgcagcactttctcccccgtggcctccaccgcccgccgcttagggggcgtcgccatgatgggctcctggggagtggggagggggaagaccatgttgaccgatccagtttggcctcacacacagttcatctctaccctctcaacgctgggaatcggcttgtccggctcaagctggaggttcagccttccgcccctcccaactcggggacccgaccacccagggacacccaagcgcggcctttacctcaggccgccagcaataagaacggttggtaggaaccgcggcttccgggtggcgcgggtgaatgacgtaagtggcaagcgcgctggccaaccaaatagccagttggggaggggcgggcctgagtggaagaagacgggccaaaggggagaagagaagggcagggcttcacggaatccgaggagatcaaagaagactagggcgtgcgagcaggggccgtctggcaataaaccggccaatgggggactgcaaaagcggcgcctggagcctatggagaccgtgtgtggctggtgggggtgggatttaatgggatttggcgggttctaaggtaggcgcgacgcacaggtggaggtagaggaagtgaagagttt

SEQ ID NO: 7236 - DNA, 1233 bp, artificial
  synthetic oligonucleotide
tgagctccctgatgaacacagtgggcccgaattacatactctttttaatactattacgataaacattattaatatcaatgggtaaaatatatttctggttctttggtcttctagaaaaaaacatatatagaagttttttttttttttagtttgaatttcttttttaaattttttttatagagatgggggtctcactatgcatcccagattgttctggaactcctatcctcaagtgatccttccacctcctgcctcagcctctcaaggtgttgggattacaggcatgagccactgggactggctcattgaaatttttctttctttctctttttttttttttctgacaagatctcgctctgtggccgaggtaggcagcagtggctggatcatggtcactgcaacctcgtactcctgggctcaagtgatcctcagcctcctgagtaactgggactacaggcacaccaccccacctcgctaattttatttattttttgtagagataagggacagggtatcgctctgttgtccaggctggggtgcagtggcgtgattgtggctcactgcaacctctgcctcccgggttcaaacgatccaccagctgtggcctcccaatgtgctgggactacaagcatgagccaccgtgcccggcccaaatttctgacgttactacagagttcctaggaaaaatcccatacctgaaaaagttagaaactgacaggaaggatttgagatgacgacctgcttcatatacactacttattaaaactggataacaaatgcaccgcgggggggtggggagggataggaaaaaaatggaaagagaaaatcagcacatgagtactctgattttggaagaatctaaagagaatatcagagcatgcatactctgaacttggagtagccaatcccaggggacgctttaggcgggaaaatcagagtctccacccccactttgagaaggttgtgtccctggagcctcaactgatagaccccacatcaccttcgctcctcccacctactgttctgacttctgattggccaaatggagttcactaactgccctgattggtccatcatcctggggcagtgacattgcagaatattttctcctcctccaaccacactttgtcaccaactgctgccgacctcgccaccactgctttgtctctgaggtaggttctcttgaagggacaccctagatgggctaatgggggcagatagaaaaggaggaag

SEQ ID NO: 7237 - DNA, 2145 bp, artificial
  synthetic oligonucleotide
tcctaggccttcgatgatattgccaaatacttctctaaggaagagtgggaaaagatgaaattctcggagaaaatcagctgtgtgcatatgaagagaaagtatgaggccatgactaaactaggtaacagaaagttctaggaacagacaagtctggggacacatgagcatcccttttcctgcctaggctacttcttagactgcagaaagtaccccacgttttccttttgtgcagggaaaaatggcaaggcagctcctgggtgttctgctcttctgtatcctgtcagggctgagggcagggactggccacagtggagctcgtacctggatcctgcacgtttctttcccataggtgtctgttctgatgagcccagctgtctctgtggcatcacagcacacctcccaccctaccttcctcctctggtcttgtccctctccgtctctctctctctctctttttgagtcagagtctcactctgtcacctaggctagagtccagtagtgcaaccatagctcaatgcagcctcgaactcctgggctcaagcaatcctcctgctcagcctatggagtagctgaggctacaggcacatgccaccatgcccaactaattttattttatattttgtagatatgggggtctctctgtgttacccaggctcttcctgaactcctggcctcaagcaatcctcccgcctcagcctcccaaagtgctggtacgacagacatgagccaccgtgccaggcctaagtttgtcccttaaggaataaacattttgcttctttctaggtttcaacgtcaccctctcacttttcatgcgtaataaacgggccacagactctcagaggaatgattctgataatgaccgtaaccgtgggaatgagggtgagtagatgggaagggactggaaagggtctcctcaagcccaactgcttttcagctcagctacctgggaaagatcctcaggcatttgttctctcatacacaacagggctgagtgaaaaaaaattgcaggcggaaagttaactacagaggccattcatataaaattttaaaacatgcaaaacaagaatatatatttttatggataattagtaaatggtaaatgcatgaaaacatgaatgtgaataaaaagccatcaaattgaggagactggctgtaaatggagaaggagcaggggcagggattggtgagtgctgcacaggcagcttcagtcatgacttgttgatagtgtgttttgttttgttttgtttttgtttttgttttgaactggagatttgctcttgtctcccaggctggagtgcaatggcacagtctcagcccactacagcctctgcctcctgggttcaagcgattctcctgcctcagcctcctgagtagataggattacaggcgcccgccaccatgcccacctaatttttgtatttttagtagagacggggtttcaccatgttggccaggctgttctcaaactcctgacctcaggtgttccacccactcagcctcccaaagtgctgggattacaggtgtgagctaccgcacccggcccgtttatagtgtttctaacattctgaataaataaatcagatctaacatagtcatggggtaatgttgagatgcaactgaactcaatattattccccatacttttgtgtgtgtttgaaatatttcttttttaaaggacatgttgttcttgctaaacactgctaatgaatcaaaggacagttaagaaaatgttaaaagtgaaaaacagaaagaaaatgttaaaagtgtagagccgccaaaaacttccagagtttgtttcattaacagcatgtagatattggataaatatcttaagagagagggtgatgcacacattatgtaataaagatcgctgtttctctgtattttattaaaaccaaatagtcttctcattcccaaacaaccccgattctccgtgatgagcttggaagtgagtttgaaagagtgatccctcatccaacacacagagagctttcccacttgtcagtgagcagagataacacagggtgaaaaaaaagacaggttcttgggtagagagctttgtgcagttcaggaatataaaggggtcatatgtgtttcctggctcttctgctctgacaatacaatcataagacaaggtcagaatgt

SEQ ID NO: 7238 - DNA, 147 bp, artificial
  synthetic oligonucleotide
cactcccaagccactccttcccaggcaagcatagggaagggtgtgcaggattgacaaatgatttcctcttgatggcagtattgctccagagatgcctacctgcccttcccccaggtccactccctccaccctttgctgaggaaaaaa

SEQ ID NO: 7239 - DNA, 842 bp, artificial
  synthetic oligonucleotide
gaatgctatgtaatgctgcatttttgtttgattataattcaaaaatgttcctttaattatgaaaaggtgaattatttttggatgccaaatatcatatacaattccacttcatttccaaattgtgaacattaatttttcttgtatataaacctttcctcagctgtttcattgatttggatatcttcccataattccctaagagctggcattagtcattatgaagaactttcaagttccaaataccaattttctaccaataaatgtgaagaagactattatatgtaataacacatattaaagagcaaattttaaaaatgtaacatgctacttaagatctatatctttaattattgttttttattaatatttagaaaaacattttcttacacatcatgctctccagagaaagggagaaaaggtgttcaataaatactacctctcttctacccctggttgtaaacattttaggaaacaaaacagagacgcccagatattaactttattagtagtaaggcctggttaaagaatttggttttagacctcttatccaggtgggcctgctaactgatccccagaattaggcaaatttaccacccaatcttagaactggattggagtaagcctctccctgcaggtgtaagcaataataatctatggcatggaggaacagaagagaactcacgctggctgcagccaggcttgctccccaaagtaaaaagagaaaatttgagttaatcatgcccagctattccttccaaatttaccaatcacctgtctctttccatctctccttggacagcctaagtaaaggatgcagaaagaggtcaccagtacactatctg

SEQ ID NO: 7240 - DNA, 758 bp, artificial
  synthetic oligonucleotide
aaagaaaatggaatgtgaaagggtaaacattttttacatagtttagataaagtttgaaattcttgactttatcagctataattctagttttctctatattatataccattttctggcaattttggtgaaaatacagatggaaccttctagacatcattgacatagtattctgtgccctagaccagatcgtatcaaaccagaccaaatggcaatgcacaacaaaattttactccaggcctctaagcaagtggttggcaataataaagttctgtcatgatttcactgaagacagaatttacatgctatgttgcagttaggcctctcagccaaatgttgcaaactcccaatttccagcccattgtttccaaaaatactttaaaatgtttctcagaagcatggtaatatcttttctggattccagggtttttgatagatctgtctgcattgtctggcagcttctttttttgttgtcgttgttgcttttcctaattacctccaagtatgcttaaatttatgccattaaagaaagctctgactcacttaaactggcaaaaccacaaaaagtatagctgctcttgtgttttggggtctagcggtttcttcattttaaagaagagagagagaaaaaaacctgtcaaggcgccagagtagtctttcttaactattgttaattatgccagaaagccaaatacattaaacaaactgagcagtttaattacttaaatatccagcaaaaatccaaatctgccattgaatag

SEQ ID NO: 7241 - DNA, 267 bp, artificial
  synthetic oligonucleotide
ttgaattttaacaagaagtttaaaaatgtaaccatgtatgttgtttgataagaatagtagctctaaggttgtcattatagatgttctgatcttattaattgtaatttaagaggaaaaagtttaaaaaaccaaaatgccaaagtcaggtataataccatagatttcagaggtggtagagaaataataatttaatccaattctcattacttttcagtgttttttagggtaaaaaaaaccacaaaaaaccctgaggtccagagatgttaa

SEQ ID NO: 7242 - DNA, 387 bp, artificial
  synthetic oligonucleotide
tttaggcagaggaaatagcaagtaaaaaaaaagtcctatggtatgagaggaacacagtagagtccacagggtctggagaattgtgagcaagagaagagtgacatgagataaagttggagatatgggcagagaccagatcttcagtttaaccttgcgaccattgactattggaagctttttcactgtgtgttgttggtctccaaccccctagcaagagcctcagatcaaatgtcaggaagcccgtgttctggcattattctaccataaatttatgtatctcttttaatgagctacttatcttttccttccctaagttttctcatctgaaaaataagaggattaacctggactttctgtaaggtcccatcaagctccaatattctatga

SEQ ID NO: 7243 - DNA, 2073 bp, artificial
  synthetic oligonucleotide
ggagagagagctacttcatctggtgagacaggagaatttgtctctgcatattattctacggcttttagaaaggcattgattttaatctgtaagacaaagaaaagttaaactacccttaacttgatacatccaatactatcaagccataagaaaagtttatagattctcgtttttttttccagcagacactacatttgatcctgctcaaagatctgctacaatatcaatattgatgactttatctaattcatctttaagacttttgtatttgaaacctgatttgtctactttcatttttccctcacaccagtgtgacaaagacctttgtatttcaaacctaatttgtctgctttcatttgtgtctcacactgctgtcacatttaacgtttttaccaaaatttgaataatcttagctgatggagtagtaaacatatctacctacagaactttgctcattttaagaggtaaatgttgtaaagtaaaagcagctatcagcagaaatctccccaactttctaaagcattcccctcagctatggttttcagggtttcttccccccattttctgttgctctatggatttgtgaaattatgcttctgtggaatttgtaatggtagaaaggcaagctgttgatattttttcttccccagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggtattctatttcacccccaccctcccacccccgcttttccctccagttttaagtgtggttctgtatggcttctgagaatattttacgagttgaaggaaggcatatgacagttgacagtttgggttagtgggagaatgagaaacaagcatattgaatttattattagtctgagttaccagctcaagttagaaacctagtttcacaaaatcctcaggtataaacttgataaaaagctttatttttagcacttctaagcttctgatttgagatctcacataatcttcaactatgacatacttttcctaatttatgcatgtttctgtgataatctgttcaaactcaagttgtgctttgcttaatttatagctgaatcagaaataaacagaaaaataagttctattaagaagctcaaataaattatttgcttaactaaaataatgcattacattttggtgacttaagtgttgaaagagatgattaaaaagtaattaaaggtttagtattttaagttgcaatattgagttacatgtattccaaattggactgactatgtagaagatccttctaaaatgaaataatttagttcaaggattgttgttttattcctgcaaaaaaacactgtttataccttgtagatcattagggtagactcaattagaaaaaggagagaaaaatcactttgaggtgacacacaaagggaaacaaaatgaattgcacaattctctagtaatgtccaaacaacttttcacttacaccatattttatttactcgtaattacaggttctattagaagtatagaggtgacatgcccctatatttcataactgggtaccagtgagactgtgccactataattatttttcttagtataataggattttgtgtggtgatatttcaatcatatttcttattaattggttacattaaaatattcacagtggtcttcagagacttaagaaagaagctctgtttattaaaccgtttaagtgtcagtagcatgaattcccctatctagaagctgggtcatttagttgtcttggtatcgaatattagctggaaaatgcatcagaaatcacagttttatttccgtctctgtcctaaggtccagtgtggtaaagagaagcattctggatcattttgagcctcttgtaactcatgtttagaaaaagaaattccctgtgccttgacatcatacataggcccagtaattgccacaaatttctaggaactatattaaactagttttaatagaaact

SEQ ID NO: 7244 - DNA, 364 bp, artificial
  synthetic oligonucleotide
tgtaggttatttaggaaggcatacatgtaaagaaaatgacattgggcagagttaaatataagaatagcaaacaagattaactggggcagagggagatgcactagactgagagacccaggagaagactgctagaataaaataggcagggggcaataacagcccgattgaagtgtgcagcttgggaaataaagattgggggacaaggcaaataggagactctcccactgaggggcagatggaaagatgaagtgaattattatttcagacacttgcttctaacacacctcacagactctgacatgaatgaggcagtctcctgcagacattgtctggtcttttctgtttcctcttgctgccctgaatt

SEQ ID NO: 7245 - DNA, 286 bp, artificial
  synthetic oligonucleotide
atataccaatacatatatgcataaaaataaagagtataatgcaatggttacctctgggtgcccattaaggatgagcattattttcctcttgttttagcttatttgcatgatctgatttgtctacaatattcaagtatcatatatgggataaagtttataaactaaacaaacgtatttcctttaaatgtttcattaatctctagcaggtatgtgatgagtgaaagaaagaagaggacatgagggttatagcacatgccctaacaatacattttaaaatacccaatag

SEQ ID NO: 7246 - DNA, 1323 bp, artificial
  synthetic oligonucleotide
tccctctacccagttgccaattctcagatactttgagaatctgagtattctctttcccctggcctttactcttagctggatatcattatttccccaaagatatcaattgatgataaattctgctatttatttcctggagtcatttgcatttctttgaagactttgaaaggcagaaaaacatctgagagccaaatatatccatttttaataatggaagcaatgtaatttgcaggaagtttactgtaactccacccattttcatcccagtatcaggactgggagtagaatcctagatgggtcagaggattgaagaatctatacagtctactctgaaattatttgtgtgagtcagtttccccctacaaaaaggctagctctacctttgtgctagaagggctagatttcacagtaagttgcactttctggccgggcgtggtggctcacgcctgtaatcccagcactttgggaggccgaggcaggtggatcacgaggtcaggagatcgagaccatcctggctaacatggtgaaaccccgtctctactaaaaatacaaaaaattagccgggcgtggtggtgggcgcctgtagtcccagctacttgggaggctgaggcaggagaatggcatgaacccaggaggcagagcttgcagtgagccgagatcgcaccactgcactccagcctgggcaacagagcgagactccatctcaaaaacaaaaaacaaaaacaagtaagttgcactttccctcacttacctacattacttttgcaaacccagccagaaaaatgaattagtaaagtaaatttatttatttagataagaataaatcaaaccacagaactttcaaataggactaacagtaatttctagtaggcgtggctaaagagttcctagttcctacttaaaatttagttgggagtaggggaataggagggaatactgcttaaatgacaaccaccgggcattcatgtaataatactttgaacattatttataaaggacttggcatgggggctcacgcctgtaatctcagcactttgaaaggcagaggcaggaggatcacttgaagccaggagttcaaaaccagcctgatcaacatagcaaggccctgtctctatgaaagaaaaattgtaaaattagtcaggcgtggtggcacatgtctgtagtcccagctacttgggaggcttaggcaggaggatcactcgggcaggaggatcactcgaagcccaggagttcgaggatacagtgatccatgatcatgtgactgcattccagcttgggcgacagagtgagactatttcaaaaatcaaggggtttggatctggc

SEQ ID NO: 7247 - DNA, 1331 bp, artificial
  synthetic oligonucleotide
tctttagaagacattaatggacatccagtaccatattgctctctaattcagcaatgcccacagaagtcagaaaatgtccacaaaggtcagaagtacttaagcttctaatccccgtgctaaatagctccagattgctgtgtttcatgttcttttggctttctactgtgtttctgtcccctgcttttattttagttattacttattacatgtatcagagggtttgcatccagcagtcctaacctcttctcccacagttactactaccaatgcgagttgggacaccaaataaatataatctttagaaccattacaaagatgatagtaaaacaggctgtgaatgaggaactaggaaaattcagtgtagggaccttgtaatacttactttgattgctatggaatgaaatcagatatggtattctgtaagaaagtggcatactggcaaaatgtcctttatacaaaccaaacaaaaaattgattctgaggattttttaacctcaggaatgtgtgcattcctccatcaagatttctctcctggttagtttttgtcttttgtttctttacttaataaacttcattttttagagccattttgggttcacagcaaaactgagcaaaaaatagttaccatacatttcctattcacacatacacacccacaacctcctccactactgacatcctgcatcacaaaatccatggtgggttttttaaagctacgtaaacactaccaaagagacagcttaaattacctgtaacaccacagaactgtgggtattgctggtaaagatgcgtgtaggtcctgccttggaagactgcaaatgggatgagaggcccatttcgctgcctccaagggacaatttcatgtgttggtcttcctcttccacgagagatctgaaagtttttttacataagaaagaaggggaaattaaaacttgtacaatttacaatgagattatttagaaaaataatcagtcactattgcaatcatatgaccatgcaatatggtgaatattgtttcactatattatacgcttgtaccactctttatcttagaagaaatgtatatttgtaaaatggtttccaagtacagaatatacagatgataactgagaaatcaacttaaaaggtggttcaaaattatagtcacagagtttttaaaggccacagtaattactgttgatatgttactatttagatagcaatgccatcaaattatgctgcatatagttaaaattaatttggaacacctaattttgaaaagataaaaatgatagctaccatttattgaatagtcattatatagcaggtacttgccaataattttatacaca

SEQ ID NO: 7248 - DNA, 2891 bp, artificial
  synthetic oligonucleotide
tataaagataatactgaggggggttgtgttaggataattaaaacccaattcatatcatggacgctaagaagagttttcaattaactcttgggttttcctttgcatgtttttaatcttaatgatgtcaagtttacagaggaaaataaagaattgtaacgcacactcatgtccccatgtaaccatgcagggcgctggggctaaggaaggtcaggaatcatgtctcatttgttttctacctttctcttttctacttttctatttctttttcttttttttttttttttttttgaaactgagtctcgctctgtcaccaggctggagtgcagtggcacgatcttggctcactgaaacctccaactccctgtctcaagcgattctcctgcctcagcctcccaagtagctgggattacaggcacatgtcaccacgcccagctcatttttgtatttttagtagagacagggtttcaccatgttggtcaggatggtctcgatctcctaaccttatcatccgcccgcctcggcctccttaagtgctggtattacaggcgtgagccaccatgcccggccttctcttgctcttaatacagatttctatacacattagcagttcaataaatgttcaacaactgcaaaaaaataagtgtctaatcacattaaataagttcttaactgaatttcttacccccacccccacaaaagactctcttgtgctaaagaagcataggttggtttaaataacaacagaaaaacaaaaactaaactgctctgaatggtaccagatgagagtactaacagacgagtcttggctcatttcaattacatgaccctgccatatctattttcctatgacatgagaaccacacagccagtcctctatttacagttattgcatgagtaaatcagtatatatttacatggtaactattatgagcaagctattgggaaagataaagtagtttatttacctccctaatctccaccacccacagcaacaacatactatgtgcaaggccctgatttaagcagtttactgcaaggtgtacaatctcatcgaaaaatcttggtgccagatgtgtttctgaatttagaaatgtccagacctttagacaggaaatatactttatataccatatgttatgtaatacaccattagggtctatggtgcaaccccataaacatattagtaattctatagcaaaacaaaataaagatcaacattaagtagaataaagactataaataccctatgtcagtttaagtcaggttttgccaccacatgagttttggcatctaagttaccaaataaaatctttttcagttttcagagctttagaaatttaaaaattgcaaacaaattgtgggcctaggccgggggaggtggttcatgcctgcaatcccagcactttgggagcccgaggtgggtggatcacctgaggtcaagagtttgaaaccagcctcgccaacatggtgaaaccctgtctccactaaaaataaaaagttaggccgggagcagtggctcacgcctgtaatcccaacactttgggaggccgaggcaggtggatcacgaggtcagaagatcgagaccatcctggctaacatggtgaaaccctgtctctactaaaaatacaaaaaactagcctggcgtggtggcacgcacctgtagtcccagctactcgggaggctgaggtaggagaaccgcttgaacccaggaggcggaggttgcagtgagccgggatcatgccactgcactccagcctgaacgatagagtgagagagcgagactccgtctaaaaaaaagaaaaagaaaaagagaaaagaaaaagtgggcctagctaattcatgtaatctttgcaagtaccataagaggcaagttctattaccccttttttacatatgagataactgaggtacagggaggtttactgactcacccagtgtctcacaactattaagtctcctagctggaattgaaacctaggtggcctagctccagagcttgagctcttaacaagtatgctctacaacctctctcagaaaccacttcggaacaccaaacacgtgaaaagtaaaacagtattaaatgatctaacatcaaaaaattaataggagaaacatcacaagacagtatttattcattattcaataactatttataaagtgcataccatgtgctgggtgctcagaatacaacaatgagcaaaccggatgaggtctaggtcgccttcatgaagccagaggcaagtggggagatggccaggcatcaaataagcataattatgacacaacagggcaagtgtgtgactgctgttcaccttcagagggggagatctagttcaatggggaatagtgtaataggacctggaatttgaaatgacaaaaaagaaaggcatggcatccatttgacaagcacccactgtgcacgtactctatgccaggaataatgctaagcacaaaagttccaaactggggaaaatcagtttaaaccaatagagatttgtgaaagggaataataaggacatatgggaaagtaggctgggatcaaatcaagttgaccctgcaggcactgatgaaggttattttgcaggttattcccccacaatattaggatttactcctatggaatgtcaataatcatctgcattcctatttgggaccaactagacctcaaagctggattgctttcaaggaagggcttagggcaataaattcatttaagcctcaggaaacacagtaaccctaatctctcaaggaataaaggtatggccatttgaaaatgttggagaggcaacaggtaaaagaaaatgataagcccttcttaaaattccaaaggccctttctaaaacctaggttattcctttatacaaaataaaatttccaaccttccaaaggaa

SEQ ID NO: 7249 - DNA, 1801 bp, artificial
  synthetic oligonucleotide
gagcgactttatcccaaaccactaaagtcctctgactacattaaaacgattaacatcctagtttacaattagagaaatggagccaggcatcacaattcccaccaatcctctctctcaggcctgctcagcagccagggaagaatcagatttaggaccatgtacgaagattgcgtaccaacatatatacatacattttaagtggctattgttcttggactaagttaatgaaacctagaaagaaactttaaagttccctagttgatatttactaaggctatttagtgaaggaatgatctcatcactttcagtaaactgtagcctagactataagcctccaagaaaatcattagtcaactgtaattaaacaaacaaacaaacaaaaaagtcaaaatattcagagctgaagacattcagagctaagttaaaagcttcgaggaagaagaggagtgtgctcctgacttgggagccagcagaggagcctcctaagttagaagattctgaaggagagatggattaggaggcacaaagcagaaactgttagagggcaagagacagtagggccggggcgggcagcgggaccccagaccgtcagggcagcaacagcgaggcccagaggagaagatcttggagagatgacaaagaagcacaggaaagccgggttctggggtcctagaagaacccaggcgtccgacggagccagagggaccggcagaaagggatgcgaaggtgtaaggatgagggcgcgcaccagcacgcgggagaaaaagagggggcggcgggcaaaatgaagctgtttccctgctcctctgctcctctgcccctggtacagatcgcaactcctcgccgcgcaccgcgcagcgccgggtccgaaggcagggaagcggctgctggagcccctgtgacttcaggaccctgcctcaccttgctcgccgcgtcctggcgtcccgccgcttgtccgccgggtgctgcgctccgagggccaaagagggagtcgcgcggcgcagccggggctccctcctgctgcgaggcaccagcacccgcaccttcgcaccctctgctcgccccgaccacttcaccctgtcctggcgcaggcggagagcacggaccctaacccgaatgccgctgcagttattttcaaaagtccccgttccaggcttcccaggaataggagctgagctactgcggccgcagcggcagagcctccgcctgacctcaccagggtgtgggggggctgctgagggaggggggcgggaacccagttggggagggagggggcagtgggggggggagcgcgcgggcgggggaaacatggcggcgggggtggccccggcggcgcctgcgcgggaggcagggtggcggggagccggggctaggacggtgtgtggggtccgaacggaactcccaggctgtagcgaaagcgtgacagggccggaccctgaagctgaatgaccgctaagtggccctcacgcctcggaaaccgggaggctctggtgtgagcccacatggattctagtgccgggaggcagaaaaagtgaaaagtgtcaagtatccagggacaacagtgcagccgccccgggttagccactccaaggaggtccacccgtgcattctgccagccgtggcctcggcctcctcatagtcacggcggggcccgagcaaagggtgtgccctggaagcggtgccacctcacctcagtggggcccacgtctcaaaataagcctgacccaggctctcacacaaatatcactcttctagtgggataagcgcttcatccctccccctccctgctgcagtacacaac

SEQ ID NO: 7250 - DNA, 1342 bp, artificial
  synthetic oligonucleotide
tccacaactttccaattaaagtttggattattttcttcttttttaaatctcaaattaaaatctcagttttcacctatgtataatagagttagttaacactgaatttttttattaagtgcttttatgcaactggcaaatgtaagaggtaagcatttatgccattcagcatagttatatagcttttcagtaaggaccatatggcaaaaggtgctgtcagcattcacacagcaaacgtgtgtacttcatttcatggcagtttcagtatgtctgctatacaataaaccttactggcaacctcgctagacacccctgttagcaacagacttgcccagctgatccgattctgccagcactccagtcctggggctgaatgacacactagcttcttgccatgcaatgaagcattagatgacttagatgcctaggctgcctaggaataggtccaagcatccaggccccaagagactgtaatatcctcaagccagggaaagaccagctaagacaaggtaagtgaaagtgagcctcagagcagaggagagattcagcagaatgaaagaattacaggagccagccagaaaaggagactgaaaaggtggggagatgatcttctcccctgaagctggagggtcatgggcatgtgataattgtggcagcaggcttcatattcctttaaaaatcaacttaaaactattttttatacttttaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatt

SEQ ID NO: 7251 - DNA, 333 bp, artificial
  synthetic oligonucleotide
cgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccct

SEQ ID NO: 7252 - DNA, 331 bp, artificial
  synthetic oligonucleotide
tctttaaaatgatgctgcacatcagggagtagagtgtgttctggctcttccattagctttatgactttgggcaaatagcttccctctccctgtgcctcagtttccccatctgcaaaataagggattggacacaaagatatttcaatccctccagctctaactgtggtgatctcaccacctaatttacctatagctgtttctttttccctctaggcttgccgtttgtaggccattgtataatttcatttcacctccactagagggtggccagggaaaggagatgaggctcaaaccagctatttgtattctttgccggcaaaaaaccaaaaaa

SEQ ID NO: 7253 - DNA, 4348 bp, artificial
  synthetic oligonucleotide
gggcttgcggggtggagggacgtgagagttctccagccctcctgcgggcactgcagctcggaggcgggagaggagcactagggcgggagaggagcacgccccactcttggagacatttcatcacccctctctgttcccccaccccaccccgccctccccactcaagcggaaaaaaagaagcagcccagatctcccctcccggatgcggctgcaccagcaacatcagctgcgggcggagcccgagcggtagccacttcccccctcttccctcgtgaccctcgcccccacctccagttctccctccccctctacacacccttccccatcagacacaccctcctgcttcggctggtggcgatcggagctcgggccctctaggggagggagctgccgccgccgacgccgtggggcaggacagtgagcgggcgaagcgagcgagaaaaggagggaaggagggaacgagggaggagcagcgggtgggaggtgggagggaggagcagcgtgagccgcgccgccgccgagctgcgatgtggccggccggccggcgagtaaacagagggagcagcagcggccgcggccgccgcgggccggggcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggtgagtggccgggggacggggcatcccgggggacgcgctccaggcgggagcgacgcgggaaggggcaggaacggcgccagtgcggccgcttggtgcgccgcgcgctgtctttctccgctccagtaagttttcgcaccggcagccgccggccggggtccgagtcccaggcgccggctgacagctctccggccgcccggcacggcggaggcgtgcgccgggatggaagcagacgggcaaaagccgggctcggacggctgcggaggaggcggaggcggaggctcccacccagggtcggggccgggggtgtgagctaaagagctgacctcgcgctgctctggactcggcacaaagagccggggacaagggcacgacgagatcctgatcccctcccgcgagcacctgaggccgcctaggcggaaggatgcgatgagcgtttggcacacacactctcgcgcgcacacatacacacactgtgtacacaaaaaagaaccccacccagaaagccccgggcgcccaagctcgggctggcggtgagaacagaggaagcagagcgacttcctcctgcaactggggagagagggtggtgatgggtgttgaaggggtgctgctgcggaggaagggcattagaaacaacggggttctgcgacagagtgggcgcagggtcatccaccgcagggagagtgtgtccctcggggacacgcgagcgctccagaggcaaggggaccaaggggacggtgccgtggggatttgggggaagactgggtgtgtcagtccagggatggaggacctggggtcagagccccacagctcaggactgggggatggggattcgaaagcgcgctgactccctgggaaccctcccagagcaccctcagccttatccagattgtctgactctggagaaaggctaaagggtgctaacgggcacttgccccttctcttgttttcaagacactcgttgccagtttcctggacaagcgaacaaaccctgaataagcaatcggactgattaattagtgtttgttttgttactttgttttttggttgttgtttttgtttgtttttgtctccctcagctccattttacagcgagtcgtttgctgtgtttaaatttcaccgtttaagagagggctctttttgttaaaacaacttgtcatcggaagggaacttcacagcttttccttgtaatttttctgttgatcttgtagaatcagcaataaaacccagcattaaagggaggccaggggcttgatcccaacagtggagaaagttgacattagtgggagttctggaggaggatcaaaggtaaactatgtacctttgagataaagatctgatccctaatagctacaactgtgcaaacctaagtgactttaaagaaatctctttattgtggctagacccttgaaagtttaattctgctgtttagtggagctaaatccagacctttaatgttactttaatggacttggcttgtgtatttcagtctgattttggagtgaggacctgttgaggtcagattggagccttgcctgtcatcacagccagttaagagaggaaggcaagctgtgtgcagagcatttataccagggctctcatcttgggtgattgttaacacgtgattcaatctacctagcagagaacgctttcctaaattcagagaaaacaaaaaaccttccttgagcggggttggctggccttctaccacaacacgtgaagaaagctgtaggtggccagatttctcgagaataaatgggactaagaaaacttccactgggatttgatcagcacttgacctgccaccctagcagcaaaaagttaacattagcattctttcccctgtttttaggttttcaaaagaattttgtgcattgtaggttcagcggctccttcctgaccattgattctatggcgaaggaggaaaaactgttattggcaggagtcttttctaggagacgctggcagtggccatggttcccttgtcagcccagcttacttgggaccaaggtcattgatttttaccgtttacaccaggcaatgcagaggaatatttactcattactctagtatgtgaaccacattgagattttgggagtgagggagaacagattctagtaatctaaatcaatgaatatctattgagcccttacaatgtgccacacacaatgctagatgctctataattatgagaatgcaaatgatctttttcttcatttgttttcattatttacaatctgggttggttgtgtgtatgggaatgtctttgtcaataggacacccagattatgcacacaaatcaagtttagattcttcatagagccttagcaaatgctatttgtaagcagtttagtcaacgaaaaaataaggaaatagttcttacatggaatgtatgctcctaaatgactctctctcacaaagagctgttaaccaaagttagtaaaaccacgagtggctggagagtgaggggaccatgttgcagctgctgccataacttctgattcttttaagggacagctgaggtaggatttacacttgtgctataaacccaagatactcacattggggcttcaatatgagttagagccattaccgcagcaagtcaagctttcctctggtgtatctcttgttagaacatggaaaacccaccaagctgtacaaatatacagtatttcctgtttaggttttttttttattttttttttaaggattttggaattacacccttgttggcctgttgctaacatcattcagttttcctcactgtttgaaaaattcagatggctgggcctgggctatatatagcatgttgttgcgtattcaaactgttattcagttattagtacttccacgaatctattaactaactacataataaagcagacagagagactgttccactgttactgcattttcctataagttcagcatttttatgaaggtcagttttaacccagggaaagggataattacagaatcatcattgacagatttctcaagaggggattggggagaaacattataacctgagagtgtatgtgattaagagagaagtgtttacatatgtacttgtttaaaatgcagagttttaaatttttaaattgattttgttgtaattcaggatgtagctactggtgccgcaggggaacaaaggcattttgctaaacctgttgtattatggccgccctttagagaagccactttatcagcctggaagagtcgcctagtagctgtttaaatactgtttactgcggagcttaccctcaattccttgtgcgccaaaagatcgggaaagagttgctagatattaggggttgtagcccctggacgcgccgtaatgcacgcagcgtcccctggctggcatcagccagatttcgtataatagctccagtagagaaaagctctccagaagctgagaatggctgaaaagcgtctgcagctgttgactcccccaacccgccgctcacaactacctttgcatggaatgtttgttatgtttgcatttagagaagcgctgaaacggaaccactcctctgctccctcttcccaagggaatttgtgtaaagtaggtaatataggacaaaacccacagcc

SEQ ID NO: 7254 - DNA, 883 bp, artificial
  synthetic oligonucleotide
ctttagcaagagaatgtctgtgtgtgtgtgtgtgtgtttgtgtgtgtgtgtgtgtgtgtgtgtatgtgtttgtggtgtgtgtctagctatgaagactatttctcttgtgaaactgtctcaattaagtacttaaaagtatcagtaatcccttcctttgagaagtaatgtatctttagtacatagaaagttatttaactcttgtgagtttgatcataataactttacttttgtctcttataaaggaaaaggccaaagttgttgagcccctggactatgagaatgttattgcccaaagaaaaacccagatttacagcgaccccctccgagatctgcttatgttcccaatggaagatatatctgtgagttcacaaacacttctttaaagaaaaaaacccctatttttcaagccagttcttacagcaaaaatgttctttgtgttctagatctcggtgataggtcgtcaacgcagaacggtgcagtctactgtaccagaagatgctgaaaagagggcccagagtttatttgttaaagaggtaagaggctcaaaggccacagaagaatattcttcatatatttaaaatatatacagtatttatatgtctttatgtatttgtaacctgtttataaatacataaatgtaaaatatttaaagtagtcttcctttaatgtaaaggtaaaataaaataactaacattaactgtcctaaataacaagtttatatgctgttaacaagtctatatgatgataaagcttaaacatttccacaaggtgcatatgaccttagtgttttccttttggatttgaatactctttgcactgagagtcagagtattcaaagggcatatgaattgggatttattgccaccaactgggtaagagagac

SEQ ID NO: 7255 - DNA, 1059 bp, artificial
  synthetic oligonucleotide
gcaggattattggagggggaaatgggataatggacgtgagagtgctttgaaaagtaaaaacggtgtgaccataatgtaagaactcaaaggtgaaaatcttgcttgctttcacttcagttatacagattttttttttcctttttcccctcttctctaagtaattaagttaattgcttcagacctcgagattttctatggaaacctggcctgtgcttttcaaagaggcttataaaggaaaattgaattagatactaatataaaataggctgcagaatacctttaataaataggctacagatccctttatgaagtattaggtttgttctatattaaaatgcaacacaactccatgtttcatcgtgccaataactaagaaagccattagatctcatgatgtacattgtattccttcctcctattctgatacctctaatttatttaacaaacatttatatagtctcttggtagatatcaggcactgtcctaagtgctttacaaatattaactcactttttcattgtgaggctgggaatgagaaaggggagtgatctttttgaaacaatggaaatgttctaaaattggattgcggtggtcacccaactctgttgccgaatttactaaatgtaatttaattgtatacctgaaactggtgaattttatggtttgtaaattatatctcaataacttaaaaatacaaatatgaactcacttttaatcctcataatagccttatgatgtagatactgttattattcccttttgataatggggaaactggggcccacaggaggttaatgtcaaatagctgggcagtggcagaatcaggattgagatctaggccagttataagagaccatgattctagccactataccatgccttgaaatatactaaggaaagtgccagaaaaatcaaacaccattcagggattctggctgtcagtattatcattagattgttgttgttttgggttttgttggttttggccaagctgtaacctgctggttactttcttgagggttagcaggatagggctggagaaattaaccattgctgatt

SEQ ID NO: 7256 - DNA, 1075 bp, artificial
  synthetic oligonucleotide
agatctgtcttgtaaagggtagaccctcatggccagtttgaagactgtttctggaatggtaataaagtcctgaaatagaaccatagaggcgaaactgggtggtcgggggaggaatagatctgagagatgttttaccatctaatcagtgactgcaggactagacagtggatggggaactgggggtacgagatacaggaaagggagttgtcaagagtacatacttttagcattcatctctaattttggccaggcatgggggacagtgggtgggtggggaccaaatacaaaagacaacaaagagtattctagcttaggatctctctcacctttggcgctgttgtcatcttgagtagagtaagtctttgttgtgggggcggtcgtgtgcattgtattaacagcagcatccccagcctctactcactgcattccagaagcatgcccccgcttcagtcatgacaaccaaaaatatctctccatattgccgaatgtcccctgggatgtaaaattgcccctggttgggggccactgatccagaatcgggagggaaattccctgttttcaacttctcctttttctttgttttgcagtggtgtgaggttttgcttagaggactctttgtgagatttttgtctaagggaccagcacttttagctaagcccttggaatatgctggtgtctgtgtcccttttggactcaggaaggtgtctctaaatggatggaaggacacctgactttggaaagagggacatcattctttcctgccagacattttcttgcatatgcccttttcagcctccagttacagaaatggacgaagacttagtgagaagggcaaaggtcaaaacagttgagtggagtggcctaggtacacagggcagcgcagaactccagccaccccgggccaaagtgaaagaaaggccactggtagtctcgcacccaagtcatcaggactctaagggttaaacttgatgttgactcatcatgattttgatttacacaaagccaaactgaaagctccttgtctactgcagttcctggaaagccttctatctgtcttcattcttcctgcagacca

SEQ ID NO: 7257 - DNA, 987 bp, artificial
  synthetic oligonucleotide
tctaatttgacatttgactgtacattttcccctgatgtcttcaaagggcaaatatagcttccaaacaagaattgccatggatccttggataagggtggcttcttcaaagatatatgggacttgtgcttagtaaaattgtgaggttggtaaaatttgtattcgaagccttcctgccaccactaccatgatcctggaggcaggtcttcagcttcacatactcagaaacttcatttcctcagcacacatgcatctctcaggggctgattttttactttgttgtgaaaatggaatggtaatggtgaagcattctaggaagatttctgttagcataactggtgcatttcatccctgtcggcagagcctatatgggaagccaaatgttaagtaggtttcttggtgaggaatcagaaattagttgtaaaaatatacttgtctaagaatagctggaggccctactgagagtaaacagctttgccagtgggacagaaaaattcaatgcccacattcctgtatcaccctctttttcctgcctgtcaggattttgctcacagacatttctttttctgttcttccagggctgaccaactcccttttcagagtactgtcttgactggacctaagagctattctggttctataaagtgattttgtttttgtgtccttgctatgatttattcattgttgacttggtagttacttctcagaggccatccatatgtcctggttttgggggtatctcacagttgccctcatgctcagctggcagcaggcatgtgacatggcagaatagctctttagggtagcagatagaactaactgtggcaaattttcctcttcatggccgtcaacatgtagatgaaaggaaatactatctctgacttgagtcagaagctattgcaaaacaggaggtgctctccttggagctctgattaaaagcagctccattcttaattattccaactctgtcagtttgggaaatgttaattt

SEQ ID NO: 7258 - DNA, 496 bp, artificial
  synthetic oligonucleotide
tttgatcttttatctctccctccagttaggaatattagttagggtccctcagtgatagggaagatgttttctttgtatcaggaggtaagagagaaggttgtgaacaaattagatttgagtttcctccatcctgggtgacttctgggtaaaatggggtgagagatgaagcatttgctttctgacaaagcagcatgaagcactctcatcatccccatgccaaagagtgatttgctactttgcattacaaggaaagaagggtcttaaactcttggcctggatattctaggtgatcctgagtctgctgtgactgagcttcaatgcatttggcacaacctgagctacatgaagtgttcttggctccctggaaggaataccagtcccgacactaactatactctctactattggtgagtatgtacagtacaattactggaagactgattgtaattgtgttgggagcctttggatccaacctagtcaaaaaaaaaagaactgt

SEQ ID NO: 7259 - DNA, 1555 bp, artificial
  synthetic oligonucleotide
aagatcttatctgatgatatgttgtgtttatttgccctgtgtttcttctagcttagtcttcaattttgaaatgattattttcctttacttttattttgttttattttttgagatggagtctcactccatcgcccaggctggagtgcagtggtgcgatcttggctcactgcaaactccgcctcccaggttcaagtgattctcctgcctcagcctcccaagtagctgggattacaggcacatgccaccatgcctggctaattttgtattgttattagagatggggttgcaccatgttggccaggctggtctcgaacccctgacctcaagtgatccacccaccttgacctcccaaagtgctgggattacaagcatgagccactgcgcccagccttcttttacttttaattcttctgtgagttttgtcatccaatttctgagttgtttatattgacttttaatatattcttctacattgattactttttttatatcatgtaactttttaaatatacttcagctagttttgaaatattaggttgtagttttcatctattttgtggatatatcgttctgttatgttttaattctgtaagagtattattctgtggctcatttttattttattctttaattttaaacattttttattttaaaaataattgtcactttgggaggctgaggcagacagatcacaaggtcaggagttcaagaccagcttggccaacatagcaaaaccccgtctctactaaaaatacaaaaaaattagccaggcttggtggcgggtgcctgtaatcccagctacttgggtggctgaggcaaggagaatcgcttgaacctggaggcagaagttgcagtgagccaagatcacgcctctgcactccagcccgggcaacagtgtgagactccatctcaaaaaaaaaaaaaattattatttttgtagaggtggggtttcaccatattgcccaggctggtctcaaattcctgggctcaagcaatcctcctgccttggcctcccaaagtgctgggattataggcgtgaacaaccacacttggcttctgttgttcatttttgtatgaaatcagtttcctgaacttttagaaggaggcttgattgagacaagttgtttctttccctaattttatggctgtagagctccatcctctaatgaattacattctgaaatctcctggccctttctgtctacctttctgctttgatctaggctttcttttttgtcgctcttgtccctgtcctgactaatttgtaatccagtttcaccagtttctcctcagagtgcagctttgccctggaagggattaaggattagttttgagtttctggaggcccaggctgctttcagtctagaccacggactccttgcactcaatcactgtttgaaaatgcaaacccttccctttatcagttgttcataaatttgcttgctgaagttgagttattttacagttctcagatctataggatgccatgttgagtccgtttatatactcttccacagcttataccattttggtcctgtaactatctctaatttgt

SEQ ID NO: 7260 - DNA, 548 bp, artificial
  synthetic oligonucleotide
agcttaattttattttgtgcttttatttgtcccatttatatttctttcttgatttaaaaaaaattgaaaattttgtgttgattattcaactttttcccctccctactattgatagcttggaaatttacatcctgttactattattttaatagtcacatactattaattactagatatataattaccttatcagaatataaatttaataaatacctaaataacttccaatacgataccaggcccttagaaaagttgaaatccatttaagcccctcctgacgttttttctgattgtatgatacattaagtttattttttaaaaagaagaatagatgtttttctgatttcttcttctgccaatgttctcttacattgcccacgtactaccacttcctttgctcttcattccttcctgtatttatttcttttaaggtcatgttcctcctgaagtacatacttcagaatttccattagcttggtttgctggttacaaactctctgttttgtttgtctaaaaataactattttatcctctttttgaaaactttt

SEQ ID NO: 7261 - DNA, 1470 bp, artificial
  synthetic oligonucleotide
aagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcatctgccttaatgtgtctgtgctgttaggaagaatttttaaaaaagaaaatatagtaaaaaactgtaaaggggggttgtactctgaggtgggatttttaaccgcattttgcaaatgaaaaa

SEQ ID NO: 7262 - DNA, 1052 bp, artificial
  synthetic oligonucleotide
tggacaaatcgagatttcgagatgataaataacttttccatcatcattatcctgctggttctttgatgtccagaccaaagtaatgaaatgatgacctgtgaattctacattattacctccttccttgattaaaaatgacactgggacaggctgagggagactgctgtgcattgtatgggagtgaataatctggcagaggcagaactctatagttaggcatccctaaaaggcagggaccccagcatctaaacaatcctcctttgatatcctgtgtctggctgggcctttggcatctggcccagcgctcccagcagaaccctgtggtaatccttgcctacagagtatggggatgcagtgagcatttagctgccaagaatgttatagacaatagaaatagagaagtttcaagtgttccttcctagagtagcaagtgacagcttaggatgggagggagaatggccttctctatagcttaccaaatgagttagtgactatgaaagtggtttctaagtagtaaaaatatggaacacacgatggttattgctgtgacattataaattgcctgtgttgtttttcccccaaggtttgtaagaagaccacagagatctcaaatattgctacagtcatgagctcagcctcctgagtagctgggattacaggtgcccgccaccacatctagctaatttttgtatttttaatagaagtaacacttacagttcccctaggcacaatgcagagattctcctctgtggaagttagagcaaattccccaggctagtgttacccctgctttgtcagcacttacttcattttctgaaagaagaatctggcgtggcttcatctttattcctaattgttcttcccaattttctgtcattcaaagccttctgagctctagggagttgagtggaggacaggggagcttgaggcatggcctgatcccaggcttatattccatagtacagcatttatccccaggtcgggcctctggcatcctctgctctctgaaaatctgctccaaatctggatggaagaaacagtcgcaaactccc

SEQ ID NO: 7263 - DNA, 1947 bp, artificial
  synthetic oligonucleotide
atattgtgaaatgatcaaatcatggtaattagcatactcatcacctcaaacatgtatcatttttgggggttgagagaggatttagaatcctctcttctagttattttgaaaaatcttaattttataaaataaccacttattacttttgtaatcagaaaaaaaaaaatagctcttcccagatattcttgccacacagagatgcactgacttctggggaaagtgtcctgggatgaggttagggccaagggtcttgaggcaggaaataatacaaaatagttctgtcacccaggctagagtgcagtggtgcgatctcagctcactgcaacctctgcctcccaggttcaagcaattctcctgcctcagccttccaagtagctgggattacagacgtatgccaccacaccaggctaattttttgtattttttgtagagactgggtttcaccgtgttagccaggatggtctcaatttcctgacctcgtgatccacctggcctcggcctcgcaaagtgctgggattacaggagtgagccaccacggccagcctgtttattttttattttttatttttttgagacagagtctcactctgtcgcccaggctggagtgcagtgacacgatctcggctcactgcaacttgtacctcctggttcaagcgatcctcccacctcagcctcctgagtagctgggattacaggcatgcgccatcacacccagctaatttttgtagttttagtagagacgggatttcgccatgttggccaggatggtcttgaactcctgacctcaggcgatccgtccgcctccgcctcccgaagtgctgggattataggcgtgagccactgtgcctgacacaaaatagttttcttgtgctcagcttccccttctctgtgaatagtccagttttttcctaagaacattacctcccaactacagactagaaacttggctgcctcggtttggacccttgcttctgagcaagtagaatcttgctgaagaagggaatggcatgtggggcagtgacaaagggcaggaactacctgctttctgaatttcctactaaatttcctacttaaagccctgcatttcacactatccccctcatagctgtgggttatgcatcaggagttctgatttggtgcctcttgtttacttctctgccacctctgcctccagacccagggtcagggagcctccttttggctctggctgggcagccaccttggttagtccagaaggactcgtggctcccagagggtcatcatagcttggtactgttccatcgtatgtcagctactccaccttccacctgatcacaaccagtcttttcccaaacttggatcttttgaggaaagatgagacaagaaaatgtagcagactccatgtgaacccttctctagacctaggaaaacttattcaatactcctccttactaagagctaatcagtatatgaaataaagacactcaggaagtttgcctgaaggttaactcagagacctgggagtgaaacctagctctcctgcttcctaggcccctctgtgccatctatttttagccaagctgccctgagccttgtccatcttgtctgaaagccaaagtaggcacacagtttgctcataaacattcctgtgcttgccagctcatgctagccaaccatttagatgttggttttaaaactgcgagccttcccttgtacctacctcctaaggcctgcaaagaatacacaccaagggatcaatagcctgagtttttcccgaagccaagtgacctcagtcaaatgccctcaattgagaggcgtgtctattactcgttcatcttggcacagggtgcagcaaatgactccctctcagagccactgttcctggtcacagttctttgagtgtgctgacctactttctccccttcacaggaaaaacagaaaccaataaatgtctccagtgagtaatct

SEQ ID NO: 7264 - DNA, 3487 bp, artificial
  synthetic oligonucleotide
ttggggagcgggtggggcggatctggggaaggacattgtattgtttcgctgactgttttatgtcttagcaacaagacataacttagtacagcatcagagtccctcaggattacaaattacttgagggcagaaactcttttctgtagctccttcagctccctgtcgtgattctttaaatatttcatgtgcaaatgagtcaataaatggtaggaaggcagatagagcaggaaaattcttttccttcctattaactcttgtcccctactctttaaactcactgggctcggctctagacaatcaggtcaagtttatctttggcaccctttgctttagcaggcattccttttttccgagtgcccagtgtatcctcttacccagggttatttcactctcaaatcccagaaagggctatcttcccatatagtatctcatgcctcagacctttcctaatcctctaggagaggctctaggacctctaggcttccttgttatgagttctacttcttgctctctgtaaaaattttacagagttagcatcaggccacttagaggatgaagattacagagaagagagccttcaaactcttgtctctgcatgcaactggaatagaacactgcccaccatcgctcattgtatctaagcacttaaccccacccatgttgaacaacacttacctacctcccgagaccttttttcctcgaaggacagttttgtgtgatcccaggctcatttatttttaagggcaggtaagttacaaaaacatagggcatccttttcttgggttatcatatctcccactcctcatggctcaaagttactgtccttcaaatcgatatattgaaaaaagcatgagccactgccagagcagtcatttctctcccagtgtgtggttatcctggcctactttggctcacaggagtgaaggaaacaagctgcttgtttaaattatggagaatcaggctgggcatggtggctcacacctgtaatctcagcactttgggaagccgaggcaggtggatcacgtgacgtcaggagattgagaccagactggccaatggggtaaaaccctgtctctactaaaaatacaaaaattagttgggtggtagcacatgcctgtaatcccagctacttgggagactaaggtaggagaatcacttgaacccaggaggtggaggttgcagtgagccgagatcgtgccattgcactccagcctgggcaacaagagcaaaactgcgtctcaaaaaaaaaaaaaaaatatggagaatcagtactaaggagttactcctttagtttttcaaacaaatggtcatcatgtgcctgctatatactatacctattaacccactgtggtagattctgatataattaacttcttaatgtatcattttgttttctgtttactccttcagcaaaattctttagggaaacttatgtaactggttcagtaacaaaagcaaacaacactcaaacatacttaaaactcatgtagcttttaaaccactatctacaaatattttcagttttaaggcaaaaacaacttgagtaccaggtatgactacaaaataaagtgattattatcttttaacaacaaacataatagggtgtactcactcaaagatataatctcccctttaatgtagccaccatgagagtccatgcctttgttctattggtgtggcaacaactgcttgtcttttgggactaaaattagacattacttccttctttcaggaagctggccctcactcctaaagctgggtttcatgcccctcttctgggctcctgtgcttgcgtcagtcaaagcacttgtcatactggattatctttctccttcacctggctgagtgctccctgaagatagggaggatgtcttctgtggtttttgtacccctggggccaagcatgtacaggactagttgctcagtaaatatttgttagttgattgaaaaatatctctgcatcacatttttggaccatcttcaacaacagaaaattttcattcttttaatggagaatgatttttggaaaacaaatgttattcagaaacaagttgggcacataaggtattcatctagcttatttaaaaatgagttatgatcataatatattgaccacttttcttctctgattcatagactggctctgagaacaactccaaaggaggaattacaaaaggttctgaacaatagaagcttcccagggcaacatcttcggttttttgtttttgttttgttttgtttgtttgtttgttttttgagatggagtctcgctctgtcgcccaggctggagtgcagtggcgcgatctcggctcactgcaagctctgcctcccgggttgacaccattctcctccctcagcctcccgagtagctaattttttgtatttttagtagagactgggcttcaccatgttagccaggatggtctcaatctcctgacctcataatccgcccgcctccgcctcccaaagtgctgggattacaggagtgagccaccgcacccggccagggcaacatctttgaaggactacattcatttatatgtttaagttacaacatgtgtctggagaatagtcaaataaatatttgccatgataattattgaatacatactctaggcagcagagcatacctttagaggttaagagcattactctggagctggactgcttgggttcaagtcctggctgtgcaatttatttagctgtatagccttggacaagttactcaaccagtgggtacctctgtttcctcatttgtaaaatgtagattaaacagtacttccctcctaagatcgttgtgagattaattgagtcaaccacgtaatatacttagaaatagggcctggtatatagaaagtgttcagtataggttattattgttatcatcattacatttatcattattactatgtttgaggtactgtgttagtaatactaaagatttaaaaaaggggctgggtgcagtcacacatgccttaatctcaacagtttggcaggtggagacaggcagattgcttgagctcaggagttcaagaccagactgagcaacataacaaaacccctgtctctacaaaaaatgcaaaaattagtcaggcatggtggcaaacctttaatcccaactacttgggaggctgaggcaggagaatcgcttgagcccaagaggcagaggctgcagtgagccttgattacgccactacactccagcctggcgactctgtctcaaaaaaaaaaaaagttccttccctcagtaagttcacagtcttatgaaaaatatacacatgtgatttatcttataatacaacttgatgagtgcccttagaaaagtcaactgtcattgtggggagggatctagtagtggtaacatctcagtagagttctgtaagtactgaatgccctccactcaattcaaaacagtgtgtcccaggaatatgaatgtcagtatagccagatacctgacattcatgatagtgatagcagcagaaagacc

SEQ ID NO: 7265 - DNA, 1118 bp, artificial
  synthetic oligonucleotide
gaaaacttgcttcatgttgtctgtctttatttgattttatttggttgtttcattcaggagggtaactacaaaccctgttgctccatcttagccagaagtggaagtctccctatttcttaactggagaaactgagtcagctaactggcttgccaaagttcacatcagtcaggactataaccaatatttcctgacttctaatctgcagttgagacagaattgtttcttggctaacttccaggacaacttgatagcagaaagtcgattaatccggcatagaaaaaggaaatatgtgtgacttgacaatccctggaaggttcagatcagttatctgccttcccctcaatcaagcaagtatttgccacatacctatgcacaatgtcttttgggagacactgccgggaatagagaagtcagtgctagcatctctggcaacagggggatcaccatctatttgggagaaaaagctacacatgaaacatctctgtgactcaaatgactcaaccatgtttacctataatataatgacttactcaactatgcagtcaagagagtcaggaaaggtcacagtgtgtggccttttctcaagaaaggcttcccagaggaggagggacttgggcttcaaaagataggcagcatactctgtctgggtagggcagtaaaggcaggacattgtctccacaggacttatgtcaaaatgcacgaggcctcagagggttcttggctgtaaaaaacaaacaaacaaaaaaaaaaaaaacttgagccttgtggtaaggaggaaggaaggggatattgtcctgtccagaggacagacctagaggacagtcctagaagatttaatggaagttctatggtgaggaggatgacgaataaggcatctttatgcctaccgcaaaatcaaatcctcctaggtagacagttttcattgaaagcaaaaagtgtcttcccaggtcatgaagagcagggctgtccactcgaagctgcaggacaaacactctagactctactcattcaatcatgcagtgaacatgtattgagcatctactatacgcctgaagttgtgttaggggctggggactcacagttgcctaagacttgtggcttgccccagtttagtcta

SEQ ID NO: 7266 - DNA, 9948 bp, artificial
  synthetic oligonucleotide
taacctgccttttgtttctttttcctcccatgaccagactgctctgtctggtcctctagagcctccacattggtgagtgtctctgaagagggcagggcccaggctcaagcctcctgcccactctcctcttgggaagaaaatgcttactctgagagcagccagcgcaaattttactcataacaattaacagatggctgtgcatcccttctgttcccaggaatcacatctcacatcgggactaactgcactgtgcattttccatcactggtaactaattccaacagtgacgctgggcattgttattcatcggtgaagaacagacataaagagagaggggaagtggcttgggctgagtcacatagcaaagttagaactccaacctcccagcaactaaccttgccctgggctctgtcccacacacctggcagctcaagacttgctcctttttgcactctgggcgacagactccctggctaaccaagcgcgtctaacttgtcttgcagagaaattaagcgaaatcttccttgggatagtatcttgccatctttcttttcttagtggttgacaggccagtatctccactactgctgaatgaccttgtgcacatcattgaaagtctctggactctcagtttacccttcagtaaaatgtagggaagaattattaatgccactaccaggggaactgaggatgaggtagggagggaagaatcggggtaaactcctccagtgtattctgcatcatcctttacatgggtgaacatcaaatttaactgagcatcacaatcacatgcgtagcctttaagaatacaaattcctggctgggcgcggtggctcacgcctgtaatcccagcactttgggaggctgaggcggatggatcacctgaggtcaggagtttgagaccagcctggccaacatggcaaaacctcgtctctactaaaaatacaaaaattagccgggtgtggtggtgcatgcctgtaatcccagctactcgggaggctgaggcaggagaatcgcttgaacctgggacacagaggttgcagtgagctgagatcctgtcactgcacttgaccagtccagcttacttggaattctctttttcctgggccacctatcccccaatataaaggaagtcccctggtattgagccgcaggatggtctcacttctctatttaaatcctctccaacctagcttaaaagcaccttttccatgagactgcattgcagtctgtcccctttgagggcttccgtggacacactgttcccttaattttggcacttcttacagactgcctgttattttttaaatctttgtctcttgtttcctcagttagctactagaggataaggactgtgtcacatcctattattgccctacaaatgccaactccattagcacatagtatatgctcgataaatatttgctgaactgatgaaaatcttgtaggtgggaaatctgaaataatttcttacaataagtaataagaaggagatacgggagttcgaaaccagcctgaccagcatggagaaatcttgtctctactaaaataatacaaaatcagctgggcgcggtggcacatgcttgtaatcccagctactcaggaggctgaggcaggagaatcacttgaatccagtaggcgcagtttgcagtgagccaagatcacgacattgcactccagcctgagcaacaggagcgaaactctgtctcaaaaaaaaaaaaaaagaaggagatgttctgtgctctttagctttctgatcatatgaaaaaaaaaattttataaacaaagagatatgagccctagcttccaatttggctgtatcaaattcattatgacctgtggcaagtcacttgccttctctagtgttcagtggcctcatttgtgaaaccagagctgatgtgtaagctaactttccttccttccttccttccttttctttcctttttttttttttttttttttttttgaaacagagtcttgctttgtcgcccaggctggagtgcaatggtgcgatcttggctcactgtaacctccacttcctgggttcaagcaattctcctgcctgagactcctcagtagctgggattacaggcacgcgccaccactcccgctaatttatttttttaattcttagtagagatgggggttcaccatgttggtcaggttggtcctgaactcctggcctcaagtgatccacccacctcggcctcccaaagttctgggattacaggcgtgagccaccatgcccggctaaactttcttttagttgtgggttttggctactctgtatagcaaggagcggtcttgctttccatatcaataccattaatgtccatggttcctttttttccccctgtaaggactgcagatttatgggtcaccccagtttataaaatgagaatatcagatacagaacaaatgtgtgctttggccaagcttccaggcatagagtgtgtgcatgtgtatgtgtgtgcggggttgcttacaccttactacaggtctctggcttcgaatggactctttcgtcccagagttgctcagcaggcctttccaagtacaggactgtcaaccatttgttgtttgtgtgcccagtctctgctttgtgaatgaccacagtgcatggcattccaactgtttcctcttgtccctctgcacactcctagggccagaatgtccactggcatgttcagtaagatctgttcaagcactgtcctgcttatgtcactggaggagatataagacaccagtccttgccctctgaagcttctagcctacatgggaagccagtacaaggatgtgtgtatgtggggaaagatgcactatcataagtgagggagagcctgggagttatgtgctgcttttttttttttttttttttgacagagtctctcactctgtcgcccagactggagtgcagtggcgtgatcttggctcactgcaacctctgcttcctggcttcaaaccgttctcctgcctcagacttccaagtagctgggattacaggcgtgcaccatgatgccctgctattttttttttttttttgtatttttagtagagacggggtttcgccgtgatcaacccacctcagcctccctaggtgctgggattacaggcatgagccatcacacccggctgctgctttgatgtgtctccagtatctagaacagtccttggtatgtggaagatgcccaacaaatatatgaaaatgtgtgaaaattgctatggttttcaaacttgatattgtaagggacagcttttcttcaaagaaatcatacctggaggctcagttatgtgaaacagatggatacaatactgccctgcttgaggggagctagggtcaaagcctgtctgcttgtctcctctgagccccaaagagattcttgagagtccagttggaaaactactagttgaaaatgaggggcagctcaatccttgctctctcttcttggttaaccttagccacaaggtgatcctagcaaaataaatggaggtttaaagaaccttacactccaaagggaatatttgcacctgaaaaagatggtgttaatctcccccttcccctcattccaggggggctccaattagtaagagcagagggaaggaaattctgagtaggagacttctgaattggttcaacaatgtctatcaatgtaatggtaatatttgtttaacttaaacaaacaaagaaagaaaaccactgtgataatgtttttcagcattcaatagaaacccacttggtgttgtcctacaggcagtcttgattacaatgtaaaactccctgtggagtctggtcagtgagtagctggtactgccatttacaccagagtacctcgcattatccagactgctattcacattcctgaccaagttcacggtcaacctcctgcactggcagccaagagggcctgcctggagagagcttctcttctccatgcctgcaggactgtgactctctacctgacctggccctctcttagccttcctaccataacagggcaagggaggggaatcaacccaggggatattcccttgtcaaggtcatccacggagcaaagcacatcccagatttgcatctaggaaacaattttgggtaacagacatatatatatatattttagatatgtcaaaggggtaaagctcttgaattaagatggtttcatcattatctatctcatgaatctctaccttccccaacgactgtccttcctcacagatgcctgaaggggcaggcagataattagtgctggggacctcatttgatagtaggggaaactgagaggtgaaaagagctcccttcagttagatagcaactcaccaggaactccagtttctcccctactgcttggtatggccacctcctccacctcttagccagtcctccgacttctacatcttaaaaatctagctcaggggccaggcgcggtggctcacacctgtaattccagcactttgggaggctgaggcgggcggatcacctgaggtcaggagttcgagaccagcctgaccaacatggagaaaccccgtctctactaaaaatacaaaaaaattagccagctgtggtggcacgtgcctgtaatcccagctacttgggaggctgaggcaggagaatcacttgaacctgggaggcggaggttgtggtgagctgagatcgttccattgcactccagcctgggcaacaatagccaaactccatctcaaaaaaaaaaaaaaaatctagctcaggtctgaccccgactaaatggacaatcttccattgatttcccatcccctcaaccccggttcaagccaccatccacagcatttggactagtcatttgtacttaagtaactgagttagtatcatgaaatttggtcttaggatcaaagccactcaaggttagagctggagggaaccttggagattaagagaaactaaggtttggagaacctacctaaggtttcatagcaaatatgtgacaaatccaaggcttcaagccaagttttccaatgtgtccctcgtgctttcctgactacatctggagtttctctatttcttcttctccttctccttcttcttcattttttttttttttcgtgtgtgtgtcttttttcccctatgtgatgcttcctttctgccctgtgaccctctccctctgtcctgtcttattagaaagaggctctagagctggctgcatagtacctgttctctgggaccttggtgttgatctaagactggtttaactacctaaagagaagcagagacccgagggggcctgccataacccaactctgaaacatgacttaatcccaagtaagatcagctctaacatttgttcagaagcaaaaatgatggattctaaagtttgacttccccaaggtcatctggctaagaggtggctgcagcagggggcaacaataggtcttcaggcccctggggcggcaacctggcactgcccaagagcccgcaggctctgaaggccaactgagccagcggcaagcctagtccctgcctccctgcttggagcagtgcgactataccgttttctgtctgctcatttgtgagcttggttcccgtcctaaatgtgggggttcaaggcagacaaagagtgtgcagttggccaccccgctcgccttcaggaagtgtgtaggacaccgtcgaggccccctagccattgtaaaccaggcgctgaggctcgtgcccagttgtacccttcccgcgcagcgctcaggagcgacaaacctggaggctattcggtctgccactgggctgtgccgggattcgcggactttctcctgaatagcgctctcagctcgcgtcttccccctgccactctcccacgcccccagagtacccaccgaccccagcaggccgggtacatccctgccgcgcccatccggccagtggctccaggggccggcctggtgtgtctccagctgggcgcctaccgcctgccccagcgctagttctggcgttgggggtagagaggtaaagaggggagttagcggggcatctccctcccagggctgagccggcaagcgcatcttctccgcgagttcctcactgtccagcgagcgctgcccaacttctgcgccggtgggacccgctgctctgagtcactcttggcacagaacaccaagcaccctcagaaaccgaattcaccacctttgggaggctcctgggagaaggcaaggaacccaggcggggctcccagggctctcgggctgggactgggttgtgtgtgtgtgggggggcttcacggatacccctcccaacctgcttcctttccctgacagcagccatctcccccaagagggagagtcttaggcgtcccggaagaccctgcggactgtgcacctcgaggtaccagcctctcctgggaggagtggggggccgctggtcagcggctggcagaggggacctgtttgctggcccgtttggaggtgggatggagtggggtttggagactgagaagcccaagagaagacactgagtttctccccaccccacaaccccacttccgaaaaagaaccaggtggtgaggaggaataaggcgaagtgtaaacacaaacaacctcaaaaagaagccaagaaaagcgaagcccaaagaagcaagagcaacactgttacaaaactgtctggttttgtaacaatttccccgccgccggccaatgaacagcgtggcggcacgtcacgtggtaccgttttatataacactttgctgagacaagacagttattaggcggcgcggggcggccggcatggagctcccggaggcgcggcagggtcaggagctcggtggcatggcggcggtggctgccccgatttcctccagctgccactccttgcttcgtgtccccggtccctagacgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcagacgccttggcgtcccgggggcgaatccgtgaagccctcgaggtgtatagacagctctccgagcggcagcagctggtggctgagcagctggagcagctggtgcgctgcctggcggagaaagtcccgcaaggcgaggcgctggcgccggcgcccccggacgagggtagcactgcaagcggcaccgtggcggcggaagagacgggggccgccgcggctgcggcggccaccgaggtgtgggacggctttaagtgccggaaatgtcatgggtttctatcagaccccgtgtccttgtcgtgtggccacaccttttgtaaactgtgcctggaacgtgggcgggccgccgaccggcgctgtgcgctgtgcggggtcaagctctccgccttgatggtggccactgggcgggcgcgtggagcccggcgggctgggcagcagccgccgccgccgctgcgagtcaacgtggtgctcagcggcctcctcggcaagttgtttccaggcccagcgcgagcgtcgcaactccggcacgagggcaaccgactgtaccgcgagcgccaggtggaggcggcactgctcaagtacaacgaggcagttaagttgggtgagtccaacgcgctgccgggccggggctggggctcggtggctacatgagggagcgggagaacaaaccccgcagcgagaagggatttggaccagggcagaagagggggcgggggacccatggactgtggcggggtgggggaggggtgattctggggctgggtctctgagtttgttctgttttcactgcttatctgtgtttcactgtgtttgtgttgatctcggttgctttttgtcttttcctgctacttctgttagcttttgtgttcctgtctctcagtccccgttcctgtctgtgtctccttgcttctggttctttttctccgtctcttcgtatctttgtcactgtttctttctttttcggtgtcactgtctctgttcctctgactctccttctcccgctgcactcctggtctcctcttacacctgctcgcaccttcccagcgaggagaggaacttcgcgcgctcctcgcacttgcgcccggtcctctgggctgtagccagcaggagatgtccggtcggcgcctgcgtccgccgctcgcgccgccgggtgttgccccttccggggccgcggctccctgtggggtgggtccggcatggaattaggtcaggagagcactggttgcataagggccgcgagcggcccgggtcgggcgcccctcccccgcgcgagcgggcgggattgtgtaaccgctgaggtaactgaagtgggccaccacgctcgcttcggaaaccatcccacgagcatgtgcggggggagggggagcgcttgcgccccgctgccctgtgactcattgtcaccgcttcctatcacacgatcctcggctgaaatagatgcccccccttgcccgccccgccaacccgtagcctgtgccctcgcctccaacccctttaacctggccagcccggcgggaggccggcgcggcaactgcttggggatccctggggaccgtgggctggctacgaatgggtcacgcctctgtcccgcttttcagtgccgcctgggagggttgggtgggctttgcagcttcaagggtaacgtgggcagtcccccatctccagctagactagggcacccgaatttccccagggagccgctctctgacccaccacgcctggacccaggaagtggctgctgagccgccagccggtgttgcccagctctggcagtttgccaggagctcggccgtggggcgcggtgtctggcgaagcatgccggggaggaggcagcagggctgggcaggcagggccctgggatccgagggtgtcctggacctgactctgtggagtggaggaggggtgtgggccggagtctccacgtgtttaatctccactcaagcttgcaacaggtaatggggggaggaggaggaggaatgaggactgaaggggcaaggctggcagccggagaaggggacccttctagctcctgtctgtgcacaagcaaggcagactgtgagctgccaccaggctggagtgtgctgcagaagaaaaaagacagaaaagactaaacaatttgctaatgtcttaagagcaagtaatgggcacgcaagcaagccctgagcacacccctggggaaaaaaaaaacatcaaagcctgttgccacagaggaagctagatcccagatcttggggaagagcagggcaatatgaatgaggcaggtggaggtcacttaactctagatctctaaggcagattccataccttttagccatcccccaggggccaggaaagccccttcctgccctcacccttctcctctgttgccaccacattcccctggaagttcttccttgcatctttgttaatcccctcagagaagtcagggtgaaaatgtcaaggccagctttacccttctaagaggaaaggaggctctctgttctggaagatggccattgtgtccgtattattccaagtactgcacacaccttcagaaaaaggaacctgctccccacatcccagcttcaaagcttcaaagtctgaccagttatcagtgactgcccagctagccgtgtgaccttgagaaaatgccttcccttctctgggcttgattttcccatctgaagaatgggttgattgagccagataatctctaatagcctgtccagctctgacatctagtaattcagagtttttggtgagagccggcctcaccttattcccagaaaccttgtccaagttcatttacatttggccatttgaaatgagaggatgggaccatgtaaatgtatttccattttcttcaagaaatcttcata

SEQ ID NO: 7267 - DNA, 2880 bp, artificial
  synthetic oligonucleotide
tttagaagattagatttgagcctgtgctctactacttgcaaaccatggggaggtggcttcactctctgaaccccaagtatccttgtttgcaaaatgaagctattgatatctgccctgattgcctcgcaatgatgcaatgagggtcaaaagtgaacgtggccaagaggacattctgcaagctataaagcttcctggatgtagtgctctgtctctacacaacccaaggatgccttcctcagaaaaccaatgtatccaagttcaagtccatgatcccttatctgaatcttgtaagaccagaggtgttcagaatccagaatgttttatattttgcaaggaccatatattaggtctcagtgagctctggacagcttcctgtaatccaacacactattcagcagattccatgaaaattcacactcagtgggacaaatatttttaaacactttatatcagtttaggtcaggttttgccatctaatgaattttgatgtcaagcttatgaaaataatggattatcagaacttttttggatctggaaaccagataaagcatgtggacctgtgtactgtgcaatgaatgtcaggtgaatcttgtatgttctttcttgagaaggttttcatgagtgatgatggattcatttttttttctgagaaggttttcttgagtaatgatggattagtatggttttttttccccaaagaacacatttagtgtttaatacaagtcaccagtgtcttaacccaaaggagctttagtgggggcactttcagcctcccagtagtgcaagtcagggagctgcctaggagtaagaggacttgcaactctttccacctccaccctaagcctagatcctagggctaaggaacttgatagtgtggtgagaagcagagctgagaagcagtgaagcattttggatgaaatgggaaaagtgacttctccagtgaaggaagagttgatgaaagtattaaataggagtttcatttccccatagtgatgaagtgagaggtgggggcagtgatgagataatttattttcttggaggttaagagaagacgaactgatgcctataattcaaaaccacctcccaccctgatttgcatatttcccaacatttctatgtaaaatgccccaagtgtaggggtttatctggcagccctattctctattccagccatccaaccagagtgtgtggtactcagcacatcctgcaggtgatacagctctcagtggtgtgagctggttgccctgagcaggtagagtatatgggttggccgggcatggtggcttactcctgtaatcccagcactttgggaggctgaggcaggtggataacttgaggttaggagtttgagaccagcctggccaacatggtgaaaccccatctctactaaaaatacaaaacttagccaggcatggtgacgcatgcctgtagtcccagctactcaggaggctgaggccggagaatcgcttgaacctaggaggtggaggttgtagtgagccgagatccaccactgcactccagcctgggtgacagagcaagattctatctcaaaaaaaaaaaaaaaagagtatatggattgctacttgataatatgattagtgggatcacacagaggcctttccagtctcccaacacttctcccctctagctgccctgtgatatcatgcaagcctttcccaaacacccttggtaaacactgctgggagaagcaacaagggaggccatcaacatccatgtatcagccaagacaaggcttcagaaggagctgggggaatgcggaaaggtcttcaagaggtttggagcaggggccactgctcaagaaggcagcttcagggcagcctctgcagcgaggccatagcctgagggctctggggcctgcaaagaggcatgttagaaaggggggcaggggagtatccagcagccacaacctggatcacttcattcactaagttaggcttagtactgccaatggaggaggcaagggagcaggccactgggtggagggacgtcctagatgactcaagtgaaatgctcttcaagccaagttgctagtgtccacctgtctcaagacacacacagagggcagccctctcccccgctactcttttttcttccttcttccccaggatgttcctctgccctccctagagtgtctttcccagagcagttgggcttgggccctgaggagccataaacttctttatactttctaaagtatgtggtgagggagcagaagtgatccaggcccctaggagagtaagctcagcccctggttagccctctgaagggcagtctgctttgtggagaagagcattctgggagtcctgagactgcagttctagttccagctttgccactagcgacctttgaggtcttggagaggtcagatcccttctcctgggcctcttctgaaaactgatcagttagtgtaggtgctctttcaagccactactgaggactggttctctgcttgagagactagttcaaacgaacgcatacctgggcaggccctgaaagctggttagcatgtggtcaaatgggggttcttgctacatttgatggtcactccgtacaatggtggggcagagacaaggtagtatggcagagtggttaagaatacaggctttggtatcagtcagtcccaggttcaaaccctgattccacaatttaccagctgtgttacactgggcaagttaacgtttttgggtttcagttttgtcttctttataatggcattagaacagttgcccgcattttagggctgtagataagagagtccttttaaaatgtttcacacaacagtgagtgctgtgggttagttattgttagagcagtagtgttaataggctgaataaaatgggattgaatgctaatgtttcc

SEQ ID NO: 7268 - DNA, 1804 bp, artificial
  synthetic oligonucleotide
ggatactcaatcactttggtcccatgccggagaaagacgccgatcctcaggtatagaaaaatgtctatttttaaacgggttgtcccactagaagagagtgcctagtgtttgtgattagatgggtatgtggctgccattcagcacatcgaatgcagagaggaagatggatttaatttggtgttgtttggctgcacagtgagcgtcatgagtaagaccaaaaagatcccaagttagaatcggggtaactaaagtaaagcagtaggaacttggatccaaggcaggttttgagaactaagtaagataagagaatgggaacatagatatcaccaacagaagaaccttccatgggagtccagattcacaccatggtagtgttagggtgacaagttacatgcaaaggccaggacttaagagaagggtatcctgggagctgagaccaaaagctgctgctttcaggtaacttcataaccctctccctcattgctttgggaactaggggatagggccagctacccttataagattacaactgcaagaccacaaaaacttttcgtgcctcggtctatctatgcttcgccctgcaagtctagacccttgctattgtcctcaccagggctgaacagctctgttcatcattaaatactgttagttgagttatactagacagtagtttgttaggttctactgatcagtgttcttcctgggggataggcctatttgaaagatcaagctgcagatcagaagctccctaggagagtggagatggttaagtttcactaagctttgcttgcctggaataaatcagggaatactgtctttctaggataaggctggagatatcctaaccacatatttcctcacgaccatctcttcctatgctccaagctggctctcctacattgattctttacttatgctcatccccaactctgtcacaaaagaaaaaatctcaatatgcatattctgaccaaaagtctggtcctgcttacctcactagcagtatgaccttgggaagattcctttccctttctcaacttttgtcccatctctgacatgaggagggttctaaagccccctcttcctcttgcattctgaggttctaagacaccagtctgttccctaaatgaaatgtcttgctttcctcagaccacaaaggtggcttctttccccccccatgcaaaggcatcatgagttttcaagggagaaaggccagttagtgcttcctgtgacccagctcctggctctgggccacgatgagtcaggactgcagcatatacctctgagcaaactcacgatcaagcttaatgttccccttcaccttccgggaagcgttctcccttaggcaaaagatacagatcagcaatggtaacgggaaaacacagatgctacagtgtgattcataaaggctaatgacagagaaagttgaaatcttgggtttcacttccttttttcttagttctgttattatgttgctttggcagcagcagcaccagcaaaaaagaaaaacccatacccatcccagtttgctccagtcaatgctgcatccccagtggtcccacaaataagcatgttctgtcaggaggatgtttcttagaaactgccacaagtgttaataccagcttaaatatctttgttggtgatccttggaaagaaagttcagaacatcagtctaatattcagaactgatcataggagggagagcatattgccagcttcagggagggacaaaaaagaatgcaaatgaagttagaggcacaaagaagcaaagaaggcagtgagatttggtgacgatcagaggaaccaa

SEQ ID NO: 7269 - DNA, 521 bp, artificial
  synthetic oligonucleotide
taaacaaaacaacctcgtttcactcttttacagcagaattttagctaggtcacttctactaacagccatctattgggggaaaattaatgactatcaatttacaaaacaggattatggaaaacttttaaatgagagctagatagagaaactcttgggttaacgctcctcagtgacctagaagtatatcgaaaaaacaaaatagtgcatttctgataatgaaacatgacaaccgtacctaacctttttaaattaacagtggtgcatatatactgtgatcttttcaagggcagcaggaccacatttgaatcattttctccataggttatcttgaggaacatgatagtcaaatgtccctaggcatctccacccatctgggctttgggtcatgaattgatacttatacaggaactagctgccattaggtggagcaatttgaagtctaataggccatctagaaggatatcagatcaggaggtttaagaactccagatgttttaatttaggtgagtgcagccacaagg

SEQ ID NO: 7270 - DNA, 2014 bp, artificial
  synthetic oligonucleotide
cactctggtgatatttgttgtttggggatttgataggtgttggctgccaaggacatctgtctgcagctgcataaaccctctttgtccaaggatgtgggcaatagtatcattattaacacagacattttctctctacaggaagagaaaggcaactttaaaaaaatgattttttggccaattctattattcctttctggttctgctgctgaggaagaatgctgaaggggaaatcagtggttgtcctctcatatctgggctcactgaggaactcagcatgtacgttagcctcggagaggatgaaacaaattcacaaacaaaacacctctcttgttggaaattcatttacataaaataagaatccaggtatgatcctttacctgaaccccacacaagtggcaattgtattactttggcagtttagatggagaagcctggacaacattttctgcatataaaattgaaagctctctgaagaccaagggcagcagtcttgggtagttcttgggtatagctcctatcaacatagcactgtgcaatgaagtctgtcatacatgtttctgggtgagggtgaagatatgctaacctgcactgtccattcccagcttcttttcgttgatttcttttggtttggttatgctcttttcttcttcagaaaccaatggaaggtttggctcctcctcctttggttccacctgaaacaggaaaagaaagagcttgaatcctactgaagtgctttccaaccacgcctgcatggttgccaaagaaaaagcatcaggaaaaaagttcttgatgctgggcacgtaacagtacctttaaagatggacgttatttcaatggagatatttccagggatttcttaatggaattgtttccaccaagagatccttggggatcattttacctactggaagtggttcatccaggtttggagtttctaatgtctgagtgacacactgcagggatccctctaaaataccctggaaatgactgaaccacactggaaggccacgaatctgaaaacggggtcattgggcctgacaacaatcatgccctcggccatattgggattctccgatttgcttcaccagacctgtgagtcaaattcaaatcctttttggcttcttttcagggaatgtaatgaaagcatgaattatctctttccagatcaaaagaagaaaaagaattggggttttgttgggagggaaaggagaaaaagctgaaaggttcagcccttacactggatgggctgaagttggtttagtataaataaggttttctgataattacaatacagctctggaaatgtcagcatagcactgcactgaacagtgtccggaatttgcttagtgtaagcctttatggcatgcatgtaaagacaaacatgtaactctttacactcccactcaaagtgcctgtgcaaacagacacagctcataataatttatttttgagtaaacgtggtcagattggcctggattcaaaatctcttcatcatttacttgctgcgtgaccttgggcaagttattctctgaatcactgtgtctacatcaataaataagggaccaggagaaacctcctgtgggacttgtagatctaagaaattacagagcagggagaaagtggtagtagtccctgtgtcataaatgatcctggatcttttttatgttcatccacatgtcagagagagagtcacagggaagaagtggatgctctggccttctcagagggtaatgcccgggctttttctcaactaggctatacagaaagaagaaagttagaagggtcatactgcttccctcagccaaccttctccatctcccaggtttgtggtgaggtattcaggggataatgcatgtatagggtttggcacctagtaattggtcaccccttctttgacaccaaactaacaaggtactctcaaggccaccagagggcttccctctgccgccctgctcctccacctgttctttcaactcgtattttgtctaaaacctaaagtgaaattgagatgcct

SEQ ID NO: 7271 - DNA, 7051 bp, artificial
  synthetic oligonucleotide
agtaaacaaatctaattctggttatcaaagttttattgggttacttaccctcatcaccggcctccagaacatccagactgtcagaaatttcacttagtgattcagccattgtaggatgactaaaataaaatacaaagcaaaaaagcaaaatatcatcatttgatattcagggcgtaatgcaatcctttcaccctaccccttatccttcagttatattcttaaaatagcctagaaaaaatatacaaatggaattgccattacagagaattatccttcctttaaaaaagacaatgattccaaatgattccatttacataaaatgtccagaataggcaaatacgtagacacagagaatgtcttgctcagggctgggaggatgttttttgttttgttttgttttggtggggggggcgttggtaaagtgtacaagatttcttttttgttttgtttttttgtttgcttgttttttgttttttgtttttttacaggatcttgctctgttactcaggctggagtgcagtggtgtgatcgcagcttactgcagcctcaacctcccaggctcaggcaaaactctcacctcagtctcccaagtagttgggactacaggcgcatgccacaacacccaactaatttttgaatttttagtacggacagggtcttgctatgttgaactagaactcctgagctcaagcaattctcctgccttggcgtcccaaagtcctgggattacaggcatgagccactgtgcccagataaggtttctttttgagatgatgaaaatgttctaaaattgatcgtggtgatggttgcacaaatctgtgactgtatttaaaaccattgaattgtatactttaaataggtgacttgtatagtatgtgaattatagctcaataaagctgttaccaaaaaaagacaaatgcaaaaaacctgatctattgttttgtgggttggggcccattaactctggatgcctattactattcacgggtgtgcccagggagacaaaattgttttgataaacacacagagccataaagaaaagactgaaacatctgactacatgaaaatttcaggccgggtacagtggctcaagcctgtaatcccagcactttgggaggcaaaggcaggaggatcacttgagcccaggagttttgagttgaggctgggcaatatggcaaaacctcatctctacaaaaattttttttaatagctgggcattgtggcatgtgcctgtagtcccagctactagggaggctgaggcgggaggatcacttgaacccaggagattgaggccgtagtcagccatgatcatgccactgcactgtagcctgagtgacagagcaggaccctgtctcaaaaaaaaaaaaaagtgaaacttatggagaagaaataagtcaataaaagaatgacaaactagaaaacaatactagcaacaaatataacagatacaggggccaaatttcttaatttataaagagctcatataaatcaataaaagacaaacaacttggtctaaaagggacaaagactacaaagcagttagcagaaaaagaaatacaaataatcacatatgaagaggctccatcccactgacaattaaagagatagaaataaacatatcaaataagtattgtcatctatcagattgtcaaaatccttaatttggatgatattacattgctgacgaaggtgggaaaaaatagggactctcatgcactctggagtgagtagttctaactctctaaagagcaatttggcaatacctatcaaaatttaaaatgcacataccttttgatccaggaacatcacttctcgaacattaccttatagataaatagtcacacttgcacacaataatatacatacaagaatgtgtatcacagcattgtttccaatagttaaaaacgggaaacaaccaaagtgatcatgaaaaggatagttctcccatgactcactccatgtcatgcttctaaggaagcatgtcggttgataatcaaacttttagaaatcaatgctgacattatttttagagacagcgccttgctctgttgcccaggctggagtgcagtggtgcaatcatagttcactgcagcctcaacctccttggctgaagagatcctcccacctcagccttcatagcagctgggagtacaggcgtgctccaccatgcccagctaatacatatatatatatatatatatatttttttttttttttttttggagagatggggtctcactctgtgcccaggctagtcttgaactcaagtgattcccctgccttggcctcccaaagtgctgggattacaggcatgagccactgtgcctgtcccaatgctttcattcttgatgaaagtttgtgtggggggtgggggtggggtgggagggagatctgaggagcaccacaacccagagaaagggtgctatagtcatctgtgccagaaggccatagaaaggcaagcagagactttgtgcctatgataactctccttgaggtcttgatgtaactgaatgaactattgtaaagtggggttaagtagattctggaatccccttgccactccagatctgctcttttcccagacatagctatgctgccattgctgtttcatgggtgggcttcaggcccatcctgtcctgctttctagctgtaaacccctgatgtatctccagaggtggggggccggggggcggggctggtgaccacaggctctaaggctaaggagaacttgagagttcacatagccagagtgactgaagccttggagtgcaaaaggttccaaatcaccatgagaactgacagggctgtggtgtcaagattgcttcagacccacttactgagatgccctgtggttccccacaattccccctcactgccacaggtaataaacccaatttgttcaacgacaggtatgttcctggctgaaaggtattgatattttaagtcactcaacttttatgagttaatattacaattctgcctaaagatgacttgagtcccaggcccacacagtgatcaataattaccccgctcacacacacatggagacacatgcacacacacaccctctccactccaataaccataccgcctttcttatcatatgcagaccatcaggagagcccacatcaatggatttacacaccaatgcattgtcccagaatgaatggctttacccttggcattcctgtctctgctagttttccaagatctggagatctggcaggagcaaagaggaaggaaaattcaacatctgactggacacagtggctcacacctgtaatcccaacaatttggaaggccaaggtgggtggattgcttgagcccagggctttgagaccagcctgggcaacatggcaaaaccccatctctagaaaaaatacaaaacaaattagctgaatgtggtggtgcatgcctgtagtcccagctactcaggaagctgaggtgagaggatcacttgagcctgggaggtcgagggtacagtgagccaagatcatgccactgcactccagccagggtgacagggtgagaacctgtctcaaaaaaaaaaaaaaatattcaaaagctcttaggaaattcagagggagaacaggaggagtttgtgtcattggtaagttcctggccatcttaataaacacagcagcacccccacccctgccactttagaagcctttttagacattggggaaataaactatcttagagaagcctgtgggaaaaaaagcccgttaaccacaatgtggggccatggtaggctaacattgtcattgacctaccactgtcaagtgtagaagatagaaagggaaaaaaaaaacactaaagagaaaaatatgaaagatgagggagaacaaagaaagagggcatcttggctacatctgaacttttagagcactaatagaatcattgcatttaacccttgagcttagactgtcctgtctgaaattctttgtagcatacttgccttatttccctaaccaaatcctaaaagccctgaggcttttagcaggcactctgttgacaacaccaccatcaaccaatccagctggacatgtggaactgtctcctctcctaaacaacccagcaactacagcaaaacacaaatctccccttgagttcaaattctcttcctgttaccatcccattcctctgcatctctttaaagtaaaattctttaaagagttatctatacttactgcctttatgtcctcactttctattctcgtgagctctccaatcaggcttccaaactgaactgcttccaagccagtccaccaacactgcgcttgctgaatccaccagttcctttaactttcagcagcatctgacgtgattggccacgcccttctttttgaataattttatcacttgtcttctggaacaccacactcccttaattttcctcctaccttattggctgttccttctgggtcgcctttgctggatctctctcctctccctgattttgaaatgtagcactgcagggctctgtccttggctctcttctttgtctacaatcacttcctagaacctcaccattaaatagaaaagttaacctgagcagaattgcaagccacgtattttcaattttctagtagctacatttttaacaagaaaaaagaaacaggtgagactgcttttaataatatattttatttaacccaatataaccaccatattatgattatttcaacatatagtcactacaaaaataatattaatagtatattttacattatttttgttcacagtaagctgccacatcagctgcatcagcctcctgctccaaatccccagtggcttcccatcaagctgagagtaaaatcccagccccttaccatgggccttatgtgatgcaagcccacccccatgctccactgatcaccaaacccgctacccccctacttcatcccttcacctagcctcactggccctcctggtaatgccccctttcaatctcaggatctttgcatttgctgctttctctgcctggaggactctttccccacatagttgcatggctggctttcttgcatcattcaagcatccaatgttacttcccccagagagcacgtccatgatcatcctagttaaaatgctcccactctctctccatcccattattctttttttatttattttttatttttcatttattttttgagatggagtttcactctttatgcccaggctggagtgcaatggcgcaatcttggctcactgcaacctccgccacccgggttcaagtaactctcctgcctcagcctcccaagtagctgggattacagacgtgacacaccactccctgctaattgtgtatttttagtagagacggggtttctccatgttggtcaggctggtctcaaactcccgacctcaggtgatctgcccacctcggccccccaaagtgctgggattactggcgtgagccactgtgccaggccaattattctttattaacatcttcatagccctcactgctgcctaaaattatattctatgttaattactagttttttgtctatctcctcaactagaatgtaaattccataaggtcaggggccttgtctattttgatcatcattgaatctcccaggacccagaatagtgcctagaatgaaagaggcaaaagatttactgttggatcagatgtggtgtgtcaggggaatagcaggcactcaataaacgtttgttgaatgaatgcataaattcaataaaagaaaaaaaattcttcaattttttattgaaaaattcaataaaatccacctttgtggatttcactctgagcttgatggcaagtcactggggggtttggagcagggggctgatgcagctgatgtggcagcttagtgtgaacaaaaataatgtaaaatatatcattaatattatttttatagtgattatatgttgaaatagtcataatatggtggttatattgggttaagtaaaatatattattaaaataaaaagtggttcctatcaaagaaccacctttgtggtcagaaatttcttcagacacagaggcatgctatacggggcagaggaagacttgtcctagcagaagaacccccttgttttccagtttagcaagacctgtcttccctcccagccctgggttattcacctgtacagaatcaagcactcttggacccctctttcccttgatacacagatcccattcctagatatcctagccacgtgaaccgtgagtgtggagccccattcagctgggctaggtctggaccctcatggagaaagatgtttcaataaaagaaacgctgcctcttcctactttccagccaccaccttttctgtcctttttcccccacaagctgatcttattaaataatttccttcccaagtgtctccttttagaggcatcactgtatatttctttcacgtgcctcattatggctaataaaaatttaaaataaatttgtcccttaatcataccatgattcattggtagtgaccttggggctgcctcctctgagctatacgtttatttatgatatttagaaaaagctacagtcacctcacaatctcaaaaaaggcacagtgttctctctgaaatataaccatgagcctccccgcttaaacttgtccaccagcttcctgctgcctgcaagataaaagccaagttcttaacactcaaggccctctgcaatctggtgttctctgcccactggagggggtccagtctcccagcagcccacccctgactcacagccccatgctctgacctcccagaatcaccatgttcttttgttttctctgtgttccacacaggttgtgcacttggcttggaacatcgtctctctaattcccacatccttgaaattacacatatgcttcaagacccagctcaaaggtaccggccacccatgccccatgctctcagacctttgcgcatacctgttgtcatagttgatatcaccttgagaacagtgaccatgttttgattatctgagtattaccagcacctagcacaataccaggcacgcaggacgtgctcactatatatttttgtggatggatgaatgcagggggtgga

SEQ ID NO: 7272 - DNA, 3134 bp, artificial
  synthetic oligonucleotide
tccaaaaacaacactgtggacacataataagaatatactgcttgaatataataccccatcaagtaactgggagactgcatattgtacagcttggaataagtttagaaaattaagacaactcggaaaatttaaggtgattcttctctactcatccatgtttccctctctctttccatccctctctcggccttcctctcgtctctcttccacttcttggccccagtcccccatctcccttatctccctacaagatcatttattgtcagtcatgctagctgcttgctggctgcttactagtgccaaaacatcatgttctgatataattgaaccacattatttgacggaattattgctgtcagttatttgaatggtgttactaatcaatgaaatgagccttgtaaaatccaggtttgtgtggtgctttactttgagatgatgttggctaggtttcttgacacatagagaagctatagctttgtccagtctctctccctggtctgtctgttatataaacatcacccttgtgcagctctcccttctcagacttgagtcatttcttacaaactctgtcaaagtcaaggctgtaggagtgccacaaagtacccctgcaccaagtggtagggaatcgcggtgtgcagggcaggaagccccgggaataactaggtatttccaggtcagtcactgcagctgggccaagctcccccttggtgcttccctccttcttgcctttgtaagtcaaccaaagacaactgcaacagccttgggaatacgctcgacttccaatcctggcccctcggtccctggggcccaggtgagccaggtaggggtgccggccaggaaggagagaagcgtgaaaggcagagaagcctcgaggcgtccagccggccctcatttccccgcgtagagttgacctgtctctgtgtcccccgacctgccgagtcccagaagctgggttgaggactctcccgctgctgagctttcccactcacacgcacacgcacacctgcgcgagctctcccaggagggcaccgcccccaaccagcggggtgcacaggggaatgatgttgcaagttcgagcccagaggtgtctcgctgtcccccgcccacccccgggtcattcctcgccgcccgtttttgcggcgagagcaccatttgggcggttaggagcccctgcaaggccggctggcgttctgccaccctccactctgtggtgtctagggggagtaggtcggctgcgcccgccacttactctgaaatcttgaggcaagcatgaaagctagccatggtgctgctgagggagccgctggccggttacgtgccttgcctgctggggtgcatgggagcccgcgctgtgggcatgcccttagaggctgccacgtgggggcagctcggcacttcaagcgcccacccgcacgcagccccagacccacaggccgaagcaataaccagccagataaagtttcttctccaaggcctctcgctgtcttctgatctcagtccaaaaagggctgggcttgttccttacatggttaggaactgttaactccccttttccctctgtctccatcttcccgccacaacagcatccttagagcaaaataccagatgctctttcttagcctctctgtatccctgcagagctgagcgtgagaagtaatttggagatgaaaccctaaggaaagagtagaggcttttatccgagcaggaaaggacactcaagggctttgggaaggcgatgtaaataaatcgctttctggcattttagatggtgtgggatggagggagaggggagcagaggggagaagagagaggtcagggaagaaagaaaatttaagtagcaaggctgcaagcattcccatctagatgtgaacactgtttttgaggtgttctaagctgttcttgttcagtcttaaggaaaactatttactccctaagccagtctggggccatgaaccaaaaaagcaagaatttccttaaatttgtgaaatcttttctgccctcgagatgaaagtccctaccaaaggttgtgtgtacacggggaaccccaattataacatggcttacattacatggattcagagatgttgcagatcagattgtgtccacagaaaaccaaaagaactggagacagagacaacgagcaaaagtgtgacctaatgttgactgcctggaagacccagtagggcacctttcccaatctcagtcccataaagaggtgtgtgtccctaccttggcctctgagatgcacagatctgaaatattttgattttttaaaagtgcctagtgggagtgcgacacgcaaaacaaatgcagatgcaggcttttggctttttaaaatgacttttgaggaatcaagagtttcaaaagattgtgatttctcctgtgcatgtattcatgaggggcattaaacactgtctagctgggcctaatctgacaggctttccaaattgggtttgtccaaataagaataagaagaaagaagaaatttagctggggtcccttcagggggtcttcgcaagtctggtagcggaggcctgtttttcctttcagtctgaaataggcaacaccctgcttctggaatttcactgggtgggtaggctggggtctctggacagggcagtacatgtgaccctctcttattaactttggggaaaaggaacataactgagcaagaactagatttatgttgcagatgctaaagtctgacctgtggctagaatttctagctagaattcctttctaagtcaaatttgtggttagttctccattattcatatgtggctttgcttacccacttagtacatttcctgtaattgtgtttttaatcaaagaataacttctggaatacctacaccggttgtaatgtcagcaggctgttaagaaagaccaattttaatattggccagaaaagaagctaattagaaaggcaaatctatatcattcccttcccacccaaaaagaacacactttgaaaaacatgagctttggtgtttggataatgcatgctttgtgattctctgcctaactccttccttccattacttcaaataatcagaagtagagagtccacagaaaatccatcttataacccccaaactgcattgatggctccttctactgaaatctcatatcac

SEQ ID NO: 7273 - DNA, 830 bp, artificial
  synthetic oligonucleotide
ctctttcttcttagttctctgtgtcctccatggcctcatatttgtgtcctccacagttatctgtgtcctccatagccccaaactacaaaggttttttcattgactaacccctgggctgcttccccatgagaaaattaaaatgaataaagaaacccaacttaaagttagtctcagggcaccaaggaaaagctggccttggcagtggcagccttcctcggatgctgctttctgtctgattttctaagtgccaaggttatccttaaccaaaattattccacattggaagattatgtttcttaggatgataaagggtcatttacttggaccccctcagacatttttctcaactctgttttgggaagaaaaatgaacattccaaaacaaaacaaacaaatgaacgcaccaatgcatgaatacctggacatacactgagatcacagtcattttttttttttttgagacaaggtctcgctgtaaccgtagggtgcaggggcgcaatcgcggctcactgcagcctcaaactccccagagctcaagcgattctcatgcctcagcctcctgagtagctggaactacaggcatgtgccaacatgcctggctaatttttgtatttttttgtagagactggattttgccatgtttcccagtcgtgtctctaacttctaagctcacgtgatcctcccaccttggcctctcaaagtgctggaattacaggcatgagccacggcgcccggcttgaggccacagttttatactttgttgatttctatccctagcctgggcaatgattccagataatcaagaagatgaaccacctcacgaaggttcgt

SEQ ID NO: 7274 - DNA, 1688 bp, artificial
  synthetic oligonucleotide
aggcctggcagtgttgggatgctgcctgagacggcttccctccttccaagctctgagcttacagtgacctatttaaaggcagagaaatcagtctggggttagggcctctcccgagcaggcagtgcctctcacagatggctctccagagccttcccaggcacttcttccaacttctcctcggtgatgacagctgggggtggggtgggcagggaagctcacttctcatctgtccctgaaagcccagaatgtcctaagaggcttcccagggtctaaagagaaccaagttagggcctccctggaaggcaggctaaggaaaggtaacagctcccctccctgtgccctggccagggtctggatgcttttcccaggggccctatctctccactgctgcctccaccgaagctccaggatgaaactgaaagggaaatgtgaaaatgcaaatgctccttgggaggggaagtgtcagaagccatttgcttggattagttcatccatttgtaggttgccaacttggaaagcagagaggaccgctgaggccaggacgagacgaatggcagaggagcagggtttgaggttgcagtgagggctcctgagcatccagcctttcagtcagcaagccattcagcaatcccttactgagtgcctgccctgtgtctggccctgtgctgtgtcccaggggccactgtttctgccctcctattgccctcagtctagaatgaagggacagaactcccagaggagacatgaggcaagaagtatgaagacaagagcatatgctcaggccagtctgttttggcttccagtcatcttgtgggaccttcagcaactggcctaaccattcatttgttcgtgcattcattcacattaaccattccttctctgaataagtactcatggagtgcttactatgtgctgggcactggagatacagcggtgcccttctggagcttacagcctaatgggggaaaagacaaaggaagggagtggggaggaggtggcgctcctttagatagggtgttaaaagagacctctcattaccatgaagtcacactttaagagttaccccttaaagatccacagatgctttccagcgagcgctgccaaacctgaaatcgaacagcatcctgaagaaactgccaacattttgcagacatacaagactcaaaaatgggtccctagcacctcgtaaaaaccttcccccttacaaggcctctcaccagcatacagggaggtttgagtagggaaggagaaagggcgttggaatgacgctcttgaacatccagctgttcggtcagtgtgtcatttagtactggcttactccctataggtccaaaaatttcctccctgtcttaaaggcacagtaacttaggaccagtcagctttactttccttcattcatgtgttcaagaagaatctactaaacatccacaaagagctgacacttctctggagtctggagattcaggggtgaactagatagccatggcctctctgggagtttacagtctagtccataggagagacagagattaattaattgcatgaataattaataacaattgtgctaagtgctttaaaagagactataatagggagaacctcattcaatggaggagtcagcgaaggtgtacctgaggaggtgacttctgcagctgaggcctgagggataagcgggattaggccaggtg

SEQ ID NO: 7275 - DNA, 2534 bp, artificial
  synthetic oligonucleotide
cagaagaatccatcttcctgcagatttattgaatacggtgtcagcttccttcccatctatttccaacatatgcagacttctgtgctctggtgactctaaaggataaacaaagactgtggtcaagttgaggggagcagttaaatattgtgatgccctgaaatgcttgaaacatatttcctgcatcttagggtactgacctcagatcctagagctagataaaatgcaatgggatctgttttatagagtggtacagtaaataaaaccatttcaggacaaaagtgaaaaccataccatcctatatctcattcagctatgcaattttccttttaaaattttttatttttattttttactttttaaattattagggtatttctacatttcaaaactcaaaaagtacaaaagacattcagggaaaaacctccttcctatgtctgttcccacccaagttcccttaccagaggcaagcactattattagttccttctatatccttccattgatagtctatgtatttttctgttttattacctcctctcaaagtttggattgggatttttgggcagcatttctagtttgtttctgctagaagtgtttgtgcttcacttgtaataataggtcacaggacaggtcacagcctgctctgcaagacttagcatctcatgtactgcattttaagcatttttattccatcccacaagaactaatgctttgcatccttctctaatctctgtgagggaccccaagacgagtaaagcctttatcactgccctaaggatcttctttgttagttggggagacaagactacccatctgaaacaaatgacaggagcagatggagtgcattgctgattcatgggactggttttttgaaaactttaaatgccaggaggaagtttggctttgatactgttggtcttttaacctggtggttaaatgtttttggagtcagagtaaatcttggctccaatgccagctctggtgcttaatcaattctcttaagctctctgagccccagtttcttcctctgtgatatataagagtatcatttactaccatggattggaggagatgatgaagatgcagcacctggcatgaaatgggtgctcaataagtgggttgattgtgctttttgccggagaaactacatgaaatttggggccattaggacaccatgcatgcatgtgcatttgtgtccatttgtgtgtgggtgaggggaggaggggtattgacaattaagtctatgagctctaaggcacatgagcaagacagaggcagggagaaggaacagatggaaactctgctgatgcatggtagctgatgctgaatccatggggctgagcttcccagttgattgctaaggcaggaatgggatggggtatctttaacagcttctgagcatgatcatgacatgccaaaagtaatgtctgaaaggattcatctgggagtggtgtggaggctgatatgctaagaagcagaaatagaggcagggagtccagtaaggactgtcatcaaggtgatagattctcaaaactgatgctttgttgggtatgaaggaaatggatgagttaaaggtgaccatagagtttccagccagaggaaatggatctatgacactgcctttaagagaaagaacaagagaggggagctcagtttggaggggaaagaaagggcagtatgtgtcctggggacagcaaggcaactaaatgaaacacaacactccactggagcaggtagcttgagactgatccctgcaaatagaaggaatgcaactggaaaggtttcatatcttagggggatcctaagattggccagctccccaatttccttatccctctagcattctcaacagaagaaatctgccttaaaggagagagggagaagcagaatgtgactatgttgacttgagattagggactgtctagattgccatggtgaccaggacaagaaacgtgatgcttttaccatcaagcatatcttccagctgtattccgttatacttcctgctaacgaaggttctgagcagctctgtttgccccgtagtctgaattgagcaaggaatagacctggggctgcaccctgacaggctgtggagatagattcgaaggcctcagctactccgcactgcactaaccctgaggtctgtcccatgattgcatcatctcagatctgcctggtcactgaagcctagactgggtgacaaagtgataacctttgtgataccaacttttcaagtgctcattattctgggtacattcctaactcccctgtcctggtggcctcttctcttgtgcttgttgcctagaagatgatgtaggcaaaactgctcagaggacaacatagagagctcattactggagcatgacattcagataaaaaagactacatattttccagaataggcaaattcatagagatggaaagcagattagtggttgcccgggtccaggagaggaagaaatgaagagtgacagctaataggtacaggcttttcttttggggtgatgaaaacattctgaaattggatagtgatg

SEQ ID NO: 7276 - DNA, 3429 bp, artificial
  synthetic oligonucleotide
ttatacattttcttatcaatccaaatgatctctcaaataaatattaaccctttgtcatattagttgcaaatgaaaatattttataagtttattagctttctaaattttcttggccatacatgttaaaagagatagattctaactatagacaagtgccctcagtttgagcctgtttctccatgattaaattgaagagttttgacaaaagatttggaggggctgtttcagctaatcccaaatttagctctgagaaaaatgcctgggcccgatacaaagattgtttggctcattgcactttataatgatttaagaagatgtggggggcagggatggaagcagtttttgccagaaatttttagaattctgaggtaggaagccaatctttactcaagtctcttgcgtgttgggaggaggagtaagttatgtgcaagccaacagaacacttggtggaaaagtactgctctgggctgcagatgtgtgcacggcttggttttaattatttgtttccctctctatcctttcttctcctcccctccccccgccaccagaaaaagggccagattaggacgaggcaaccccttcctccgtggaggtctgcttctgtgcagcctgttagcacatcaaaggccggatgaaatacctaggaaaggaagggaccaggcctaggatccttccaaactcccgcctttgtctgggctccagctcagggttattgtgactgccaagggtagcctgacagactccaaatagaagaacgctgccaaacaaagaaactttcacattattctgaggggggaaaaaagagcaacaagagaacgttgcttgttaatgcctggtgactgagcaaatcagtaattgcaaaagggtttttcggagaacaaacccaaagttaactgggcgatcagattcgtttccccagataatagggagagttgtgcactgactttagcaatcccgggggtgtcggtcccacagcatctgggggagaattggggaagggccatcaaggagagcgaatgggggttcccaaggtgaaaatgagtcgtgtagggctctaacatagaaaatggagttcgaagaatgagtttcctgtctcctaagacagcttggagggcccgggaacggcagggggaagatgaggggcttcagaatgggaggcagggaaaagcctgcagcaacagaaagggagtcggtgtctggcgcgcatcaggtggcggaggggcgctcgcacagagcccggcaatgccgaggccctcccaacgggtcggtctgcgaggagcaaaaaaggggttcagaggagggcagcgcgtgcgtcgcgctcagctataggatggcgcgaggatggcgtgaggctgggctggggcctcccaggtagaactgaggggggcaccgcgcggccgcgggggagcggcgccggactctagaggctttggagggggcctgagggctgcggggcgggaccgagcagggcggggcgcttaggtggcctcgggggaggcggggcttggaggctccgcccctcaggccccgcctcctccccggctagtctttggccgccgccgaaccccgcgcgccactcgctcgctcagagggaggagaaagtggcgagttccggatccctgcctagcgcggcccaacctttactccagagatcatggctgccgaggatgtggtggcgactggcgccgacccaagcgatctggagagcggcgggctgctgcatgagattttcacgtcgccgctcaacctgctgctgcttggcctctgcatcttcctgctctacaagatcgtgcgcggggaccagccggcggccagcggcgacagcgacgacgacgagccgccccctctgccccgcctcaagcggcgcgacttcacccccgccgagctgcggcgcttcgacggcgtccaggacccgcgcatactcatggccatcaacggcaaggtgttcgatgtgaccaaaggccgcaaattctacgggcccggtacgcggccggcgaggggggcttggagacaaaagaagggggccccggcacggggctgggcgggagagaggcgaggcgggagcggggcgcccctgagtggagggaggaatggcggcgagctagggtaggcgggtaggcgggcaggcggagagccgggaggctcccggggcgggcagggaacaagaggcgctctagaggggctgcgggccagtcagggacgcggatccccggcccgcgctgacagcgctgggagggggttagagaaagaaggctgaggcgcttaagccgggggtgggtgggaccacgaagctcgaaggcgttgaggggggacacatcaaagcccaggctgttggggtagttttcgaaggtcctgggcttggggattcctggaaggaggagggggtagtgtcgggttctaggaaggaaatgagggtgttccgagggaggcatgggggagggcgagagtgagaaaaggtccagacctagagaagacgggaaggccaatgacaccgggagtaggtttgaaatatgagggtgtgggagaaaacgccgagacgggattagcagcaggtaaaagctttgtgcccggtggatagtgatgtgtgtgtgcactcgtggtgtgtgcatgcgcggtgtgtgcgtgtttagtgtatgtgatttatcaggggtgtgtgtgtgtggtgtgtgcatgcgcgcttgaaatgggtcatgcgtcaggtatgtgtgtggcatgtgtttggtctgtgtgcgcttgtgctgtgtgtggcagatggggaaaggctggaaggtgaacaaggaggaagggggctgtttgagggaggaataaaggctgaatatggtggacaatggtaacgtggcaagcttttaaggtaatatggtatttagtctatagcaggagagaaaggattagaagccaagaaaaattaaaatggagggagggagaagtgggaggataccaagaaacaaaaggagtagagctaagaagactgctgggtggggggatatcaggaaaagccaaccagagggaaatgaagaatggatgactgctgcactgctgagctgttggagaaggcaggcctgatgggttccttagaggcgaggtttttgcaaacctggttgcgtatcagaatcacctgatgcatctgaggaaaaatacagattcccagtctaaccgccagagctgcaaatgagtctcgggtggtccgggagtctgtattttaatatgcttcccaggcgaatttgaaaagcagccaggcttgcaaagtcctgctttatagaatacttggagatgaggaagaagaggttttggctcctccaatatggactcctctaaacacagggagcttagaggatgtccacatggacggtgctcattccacactggcctgagagagggaagagtacagaaggcagtacacaaactcaggcattcattttagtctcccag

SEQ ID NO: 7277 - DNA, 1690 bp, artificial
  synthetic oligonucleotide
ttccagacatcttaatctagctagttccatcattcctcattatttgtcctccctgacaaacatatttttttttgaagtctcttgttttcaacagttttgccattttggttttgtaacagcacagctgaaagactgtagctttcagtggcgttttccaatctgctccaattcttgccccccatctcaatgttatctaccaagtctggctgttcatccaaaaggattaatccataaatcaaagaaaaaaaatctttgttaaagttggtccacacacctttcagctacttcctcttctcttttcttttcttttttcctttcttcttctagttcttgtaattttagcctttcctgatttctcctccttatagctccttcgctgaagtgcttggtcgtatcagacgtaacctgctccaaaacaattcaaagtttcattagaaaagtttgccagctggctgggtacgtcccaggtcagagagataaaactaagatggtacatggtaattcaaaatcaattgaattcaaaacgtcctcactgcatcccagtattcatattcctactgcttctcagccaccagccaaacagtgctcgtaggcttgaggattttctttggcagaacccttgaataagtatatcaaatcatcaccttaactttacacaattttacttgtcagtcgtacctcaataaagctgtttaaaaaaaaaaaaaacctgaggagcttactttacatatggtcatagacaccatcacagtgccatcgtaggcacaggctgagaaatgtcaatatattacttctggttcgttaaaaagatcaaatgagctaatgtatttttttaatcatcagaaacaaaaataatcagaagtgtgtgtggtgcagggggagcaaagatgcacaaaaactaacctgatgagagagaagatctatcatgattagtaaacaacttttcaaatcttgaaataaagtgaaaattagattgagatactacagaatagtataaaataggttaaaatttttggttaaccaaatcacaagaaaattataaccagacactggacagcgggaagtggtctctcatcttgtggtaatgttttatttattatttatttatttatttatttttgtttatttgtttgttttttgagatagcttcttgctctatcgcccaggctggagtgcagtggcatgatcttggctcactgctacctctgcttcccggctcaagcgatcttccagcctcagcctcccaagtagctgggaccacaggcaagagccaccacacctggctcattttgtactttttgtagagatgaggttttgctatgttgtctcagagctcaaaatgatccgtctgcctcggcctcccaaagtgccaggattacaggtgcaagctaccgcacccagcctaattttttattttttaagctgagcagtggtacatgggtggtcatgacagtatttgctatatcatttgcctgactgaatagctcataatttaaaaatatacattttaacttagctagctacatatacacacatgcacatacacacatgcacacacacacacacacacacacacacacacacacactcatacactggaagcagaaagtccaaattcatgctaaagactgatttacagaaaaaggagagtttagttgcatcttttccactgctgggttaaaacttcaag

SEQ ID NO: 7278 - DNA, 1550 bp, artificial
  synthetic oligonucleotide
cgattgcactgcacaagtttacactctcaacagcatgaagttccaaggttagatcagacataggccggaaaacagggcgaaatgggcatgatctttgagatcatattctcaatctagaaaagacaccaagaagaggcccaaagggtaaccagtttcccatactggaacccagcgttccaatacacgtttgttacccctcggagttagcagcactagaaagttctgcctcctgtaatggtcgactttaaataaaaacacaaaaagcaggagaccaaaaggcggcacgggtcccaaggaccacgactatgatttcccctgagtgcgggtatggcatgcatatcctacagcatgggcctccccaacttgattcttcccctcgcctctcggcccaccaacccaagctcaggatcttgcatcccgaaagcgttgtgggtgagcaagccacagtcagattaaaacggtcttaatccaccccgccggaaacctcaagccgagactcagaatctcttgagaagtccctaaagccaaggacgagggtcatcagggggcggcagcggcagagccctgctaatgatgggcacttggcgtaccggtcgagcaggagagggcaccttcagttcccattagcgggatgtcactgccaacgtgcctcaggggaatgcctcgaccttcgcccaacagcggcctgggtgagccctcgagtgggttccggtgcgctccctggctcagcggggtctcgagtgaggggagagtggacctggaagagcctaggcgttactctggaaaacgtgactctgctggggcaagcggggaactcgggtctcttgcgcagcccctccccagtccctaccgaaggcccagcgtggctgcctcctctgaggacagagccgagggcatttaccgggagcttcaggaaccgttcgtctctactccaggatccggtaggataacgggactgccgccgccgtccctgccgctgccgccaacgtctatgccgccgtcgtcgcctccctctaaccgccgcagtcgcaaccgtcagcggtcccagtcaccccgtgcgactgtcgctcgcgaggccagctgttgaatggctcgcgtcgagctcaccgcgcgcagaagcgtcctcgctaagagggcaacgctggcgcgcgacccggtgccaacgccccgtgacctcctcgatcccctgaggctctggcgagctcaccgcggctgcctagtagctcgcgactgcgggttcgtctgcccgcgcgcgggctgccctcagagctctgccgccctggcggctcgccctgaacttgcaggcaagaccagtggcaatgatggactcttcccgccccctgattcccccagggccaatcgccttctcctgaggagcccttcaagtaaccccgcccctctcctgctgcaaaggccgagccaaagtttaccccaaggcgccgctactcccgaagatttcgaggctttgatcatgctactcccccgtcaacccctacgaagttacagtgatttagaggctgaaactcacttggcctactaacccccacgcg

SEQ ID NO: 7279 - DNA, 284 bp, artificial
  synthetic oligonucleotide
aagaagctcaaaggtatcaaatgatactctgattagtaagactgagggtaagagcaggaagaatctttgtacttttaattttgtaacctcccacatagctattccattcagtcattcattccttcagcaaatacttatagaacattattattgtaccaggcatgattcgaagcacagggatacaggatagacaaggcggagaatattcctgccctcaaggaactcatattctagtgggcaaaggtatacaatagacaagtaaattgtttccccaaaaagatagg

SEQ ID NO: 7280 - DNA, 1371 bp, artificial
  synthetic oligonucleotide
gttctataagtttaacttcccccgtgagtagatctttttagggcgctgacagagccagcagagctgggctcatttcctgtttgcccagatgctaagcttccatataacccttggttacacaggcccttggaaggaagccttggcctaaatagccccaaacaagtgataatagaaaagccttttatatttagcttttggatattgtaagtgatttttggcagcatatttctcttcctaaatagagctggattgggctaattaaaattaactttatgggatgcagaataggagagtggttaagagcctttatagaccagtggtatgggcgctcagccacacagtctggttttcagtccaatcaccaccatttgctagctgtttatctccctgagtttcttcatctgcaaaacacagatatagccagaatacctttctcattgggtatctgtgaggattgcatgaagactaatacatataacacagcctgatgtctggcccctggaagcattcaataaagggtggcagtcatagttatcatgacattatttccctagtagacccactgggctttggataaaggaagtctaaaggtagcctgggggaggggtatatgagggaaaatcaggccaggattaaaaactgtcagcataggcccggcacggtagctctcatctgtaatcgtaccactttgggaggcagaggcaggtggatcagttgaggtcagcagtttgagactagcctggccaacatggcaaaaccctgtctctactaaaaaatacacaaattagccaaatgttgtggcaggtgcctgtagtcccagctacttgggaggctgaggcagaagaattgtttgaacccgggaggcaaaggttgccgtgagccaagatcgtgcctgggtgacagagtgagactctgtctcgcaataaataaataaatacatacataataataataaattgtcagcctataatccagaaaaaaacaatccacctgtggataatcgagttatccacttcttattctttttttttttttttttgaaacagggtctcactgttgcccaggctagagtgcagtggtgtgatcagagctcactgcggtgttgaactcctggcctcaagtgatcctcctgcctcagtttcccaaagtgttgggattacaggagtgagccaccactcaacggccagaacgtgatttcttgaccctttttctcaggattgtgctagctcctcagcaggtttaggctagagtgagcaggtggcattgccccaagaccagttggatgcagagtctgtcaggaatcacttctctatgcaagggagtaggtctggctaggcacaggtatgtgcttgcaaggtaaatagttgttac

SEQ ID NO: 7281 - DNA, 5827 bp, artificial
  synthetic oligonucleotide
attacaggttgaatgaactcattcaaacctgtaaattgtaaacaaactacggctatcaaatggcaatggaggggccgggcacagtggcttatgcctgtaatcccagcactttgggaggccaaggagggagaatcacttgaggccaggagttcaagaccagcctggccgacatggtgaaactgcgtctctactaaaaatacaaaaattagctgggcgtggtggcgcacgcctgtcatcccagctactggggaggctgaggcaagagagttgcttgaatctgggaggtggaggttgcggtaagccgaggtcacaccactgcactccagcctgagcaacagagtgagtgagactccatctcaattaaaaaaaaaaagcaatggaatcacatgtgagcaccatttcaacaaagcacaataaagatattactacattaacagaagttagaaaaccaccacaaatgtcaaagtattgggaccaactgacctgttcaacaatagatgtgatatttatattattcagaaacagactccaacacaatagggaaatcctaaacagggagcatcaacctcttacctccgcagatacatagtctcctcatcttctgtgttacaaaacttatgggcatgtttggcagcatcaatcacacgggaccggtcccggggcctcatgggcaatttctctaactggcagtctgaaggaatggagagatttggtcactagagtcatggcaaaatatagcaaatgagtcactgcaaaatatcctgagaagttttgagtgggatccctagcactagaattttctactacaattactatgcttattgaaacctattattgaatgttccaactaaaaatgacttgctatcaggagaccttggtatttggacccagctctcttactaccctggtgatctttggcaaatcacttcctcctttggagacttttgcctcatttgaaagatgagttagatgatattatctcaaaagtccttcccaatactgcaattcaggtttctgtaagtatttctgtgatcatagtacacttggtttgtgttataatgcattagaatcaggagacacaatcaagcatactggaatgcctacaaggaagcactgggaaaagtgggtatgtgctaagaaaaggagagaggctgggcgtggtggcatgcacctatagtcccagctactcagaagaatgaggcagggcgattgcttgagaccaggagtgcaatgctgtagtgttccatgattgtgcctgtgaatagccactgtactcctgcctgggcaacacagcaagaccctgtctctgttttacaaaaaaaaaaaaaaaagaggccaggcgaggtggctcatgcctgtaatcccagcactttgggaggtcaagacgagcagatcacctgaggtcagtagttcaagaccagcctggcccagctacttgggaggctgaggcgagagaattgcttgaacccaggaggtggaggttgcagtgagccaatattgtgccactgcacttcagcctgggcaacagagcgagactccgtcaaaaaacaaaaaaaaaggaagagagagggtgattatatagtatgcaaatgatccatcctagttggaggaattttaatctgaaaacaatgaaaacacagtaaacaaattaggtacagttgtaaagcagattgaaaattgatataatgggccaggtgcggtggctcacgcttgtaatccagcactttgggaggctgaggtggcaggtggatcacctgaggtcagaagttcgagaccagcctggccaacatatagcgaaaccgtctctactaaaacatacaaacattagcagggcgtggtggcacacacctgtagtcccagctagttgggaagctgaggcaggagaatcgcttgaacccaggaggcagagggttgcagtgagctgggatcacaccactgcactcctgcctgagcaacagaggaaaactccgtctctcaaaagaaaaaaaaaagaaaaaaaaagaaaatttatataatgcaaattaagcacctaaaggatcacagagaaagtcaagtggtcagagtaattcaagatgaatagaggaggtgaagagaggagttagagaacactaggcagtttacatgtcagctcatttactcttcacaatgaatggttaaagtaaagatttgttgttcctattttaaagatgaaggaactgaggttaaaaagggtaagagatataccatgcatctaataagaagcagaacaagaattcagacccaactctaagtgattcaaaagcacatgctgtttccaccacacctccttaccaagaattaatttcttcgataaatacgtgagggccctctaggtagcaggcactgttctaacactgtgctaaagattcagcaaacaacaaagcagataaagtctccgccctggccgggcacggtggctcacgcctgtaatcccagcactttgggaagccaagacaggtggatcacctgaggtcaggagttcgagaccagcctggccaacatggtgaaaccccgtctctcctaaaaatacaaaaattaaccgggtgcggttgctcacgtctgtaatcccagcactttgggaggccgaggctggcggatcacctgaggtcgggagtttgagaccggcctgaccaacatggagaaaccctgtctctactaaaaaaatacaaaattagctgagcatggtggtgcatgcctgtaatcccagctactcgggaggctgaggcaggagaatcgcttgaacccaggagacggagggtgcagtgagccgagatggtgccactgcactccagcctgggcaacaagagcgaaactccgtctcaaaaaaaaaaaaaaaaattagccagacatggtggcaggtgcctgtaatcccagctactcaagagaatcacttgaacctgggaggcagaggttgcagtgaggtgagatcgcaccattgcactccagcctgggctacaagagctagacactgtttcaaaaaaaaaaaaaaaaagttccggccctgatgaagcttacattctagtggaagaggcaacatattttaaaataattataatatgattttgggtaatgataagtgctaaatattaagcagggtaagaggacaaagtgacagggatgctgttttagataaggtaatcagggaagggttctctaaggaaattacattttagcagagacctgaatgaagtaagggagggattgagggaaaagtttttggggcagaagaaataccaattaaaaaggcactggggggcaggaacacttttgacatgatggagaaaaagcaaaaaggccactgtggctgaagtgcgatgagcaagaggaagactgttagggaatgaagcctgagaggtagccacaggcctgatcaagggtcttggtatggatggactttggttttattctcagtgttatatgaaaccattggttttgaacaggactctggctactatgtggaaaagagtggaagcaacgagagcaagagactattgtgccaatccaggtgaaagatggtagtagcttggactacagtgttagaagtggaggtggtaggccggccgtggtggctcatgcctgtaatcccagcactttgggaggcctaggtgggtggatcacttgaggtcaggagttcaagaccagtctggccaacatggtgaaaccccatctctactaaaaatacaaaattagccgggcgtggtggcacatgcctgtaatcccagctactagggaggttgaggcaggagaatcgcttgaacctgggaggtggaagttgcagtgagccgagatcgcaccactgcactccagcctgggcaagaagagcgaaactccatctcaaaaaaaaaaagaaaaaaaaaaaaactagccgggcctggtggcgcacactacttgggaggctgaggcaggagaatcgcttgaacctgggaggcggaagttgcagtgagctgagaccgcgccacagcactccagcctgggtgacagagtgagactccctctgtctcaaaaagaaaaaggaatggaggtggtaagaagcagtcagatcctgcatacattttcacgaaagcacctgcaggatttcctgatggactggacagatgtaaggtacgtgacagacagaagtcaagactgattccaggttttggtctgagatactggatgaatagttgtactactgactgcaatagggatgactataagaggagcaattggagagggggtgtagagggtcatgaactcaattttcagcacgatatatttgagaggcccattagacattcaagtggagatgttgaataggcaattggagtctcaggagaggtgcaggttaaagatgaacatctgggagttaccagcatgtcagttgtatttaaagcttgggaatgaatgagatcacctagggggtgggtacagagtgagaacaggtgagagtactgagctatagggccttggaatgcctaaaagtctgagagagaaaagggagccagacaaggggaaaaatctaaggctgggcgcggtggctcacgcctgtaatcccagcaccttgggaggccgaggcgggtggatcacgaggtcaggagttcgagaccagcctggccaacgtagtgaaacccccgtctctactaaaaacacaaaaattagccgggcatggtggcgggcgcctgtaatcccagctactcgggaggctgaggcaggagaatcacttgaatccgggaggcagagcttgcagtgagccgagattgcaccactgcactccagcctgggcagcagagtgagactccatctgaaaaaaaaggggggggggaaatacgaggtaggaggaaaatcaagtgagtatggagtcttggaagcaaataaaaaacatgttgcaaaaggaatgaaatgattacctctgtcaaatgccactgacagaattaaaatgaacattgataactgaccactagaactgttaacatggagccaaatacggttaagatgatgaggtgggaaggaaagcctacctgaagtgaggtcaggagagaattagaagtcaggatgcagagacagccaatataggcaactcttttgagaagctttgctataaaagaagcaacgaaatggggttatagctggaggggaatacaggatcgagggagggttttattttcgtttgctgtgaggtaagagcaactgcagcatcttggtatccagcagaaaagttataaagcttctagaggcagtagtttttgaagacagtggattaagagggaaatacaatatgtttgtgtttctatttttgttctcctgaaggagtttagttttgaggaaggtctggatacagagtcacaaggctaaacaaaaagcaggaaaaaaaaaaatgccctggagtggggcggggatgcgtagggaggatttagtcggagagagaaaacccaccaatcttcgttgagaagtggctcccagatcacagccagaggaaattcgccttcaagaacccgaagtctggctccttgcagacgcccccgcagttcccggctactcacccagcactaggaccatctggccgcacaaacagtagtaaacatggaggggcttctcgccgtcgtcatattcctcccggtcccgagtgtcagagcagactactgaccgagacactactttcggcatgattcccaagagcaatctgaaaactctacgccaagaagagggtcgccccgaaatgacgtcacgagtgcgccttgcaccttttccttgtggctacgctggtcacgtgttagcagaagtcttataaacttccgggctgtcctatcaggctaagatatacgggggtgcg

SEQ ID NO: 7282 - DNA, 2113 bp, artificial
  synthetic oligonucleotide
acgcctctgcgctcgcggccccgccccgggcctcccgtggggctttaatgacataagcaactttcctcgcgcaccccccgccccgtcttggtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaactttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaaaaaggaaaaggatctttctgttatttttttcctcaatgatttccttcgg

SEQ ID NO: 7283 - DNA, 1548 bp, artificial
  synthetic oligonucleotide
tttactgtttttgcttatggcttccctatgtcttgctttactacctttagataccatatttagtgatggttttgaagtagctgggatctccatgtgctattacatctgcccagttttagagcagtgtctcttacccataatttagtcagattgcaacattgatccaaatgtgtttacacttgagatcataatacataaggaaactcaaagttttgaactctaacacattcccactttttcttgcatattatagtgtcaataaatactgaaaaggaagaactgtgctttcttcctcagaaagaggaagatttatgaccaggtggtgataaaggtgaagtatgttctgatggacatacttccatacttctaatgggcatatgtttgtccattccataagattttactttcttagttataatacatagtatcttcaggtctggctttgaaaagaaaatagggagtaacaataatttgaggaatataatgtctctgtatgttgcattttatattattttgaagctttgagacacttgttcatagtaagggcagctttgttagcaaattgtttccaatgagcttgctaaaaacaaactttttgatactgttttgtcacagatctagtcctagaatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtg

SEQ ID NO: 7284 - DNA, 2886 bp, artificial
  synthetic oligonucleotide
aactcaatagaaaaaaaaatcaaattaaaaaatgaacaaaagacataaacgaaatacttcaccaaagaggatagacagattgcaaataagcacatgaaaagatgttcatcactagccaccagggaaatgcaatttaaaatcacaatgaggtatcactatacacttattagaatggccaaaataagtgacaatggctgggcacagtagctcacgcctgtaatccccgcactttgggaggccgaggggggtagatcacgaggtcaggagttcgagatcagcctgaccaacatggtgaaaccctgtctctactaaaaatacaaagattagcctggcatggtggcatgcgcctgtaatcccagcttctcaggaggctgaggcaggagaatcgcttgaacctgggaggcagaggttgcagtgagccgagattgtgccactgcacttcagcctgagtgacagagcaagactccatctcaaaaaaaaaaaaaaaaaaaaaaaaaaaaaagtgacaataccaaatgctggcaaaaatgaggagaaactggatcactcagacattgctgctgggaatgtaaaatgatacagtcactctggaaaacagtttggtagtttcttataaaaccaaacatcaggccgggtgcggtggctcacgcttgtaataccagcactttgggaggccaaggtgggcggatcacctgaggtcgggagttcgagaccagcctgaccaacatggagaaacctcgtctctactaaaaagacaaaattagccgggcgtggtggtgcatgcctgtaatcccagctactctggaggctgaggcaggagaatcgcttgaacccaggaggtggacgttgcagtgagccaagatcgcacgattgcactccagcctgggcaacaagaatgaaacactgcctccaaaaaaaaaaaaaaaaaatcagttaccacttgatccagcgattgcaattatactcttggacatttattccagagaaatgagaacttatgttcacacaaaaacctgtacacgaatgttcatagcagctttatttgtaacagcccaaaactacaatcagcccagatgtccttcaacaggtgaatagttagattctggtacacacacactatggaacactacttgggacaaaaaggaactttttttttttttttaaacagtctcactctgtcacccatgctggaatgcaatggcgcgatctcggctcaccgcaacctccgcctcctggattcaagtgattctcctgcctcagtctcccaagtagctgggactataagcatgcaccaccatgcggggctaatttttgtatttttagtaagacaaggtcatcatgttgaccaggctggtgtcaaattcctgacctctccgcaggcctcagccttccaaagtgctgggattacaggcatgagccaccgcacccggccatctctttgtattatttcttacagttgcatgtcaatctataattatctcaagaaaaatttcagtttaaaaagctgatcggggactttatcatcttaatatcactaaaagtgggacaaccgaacatgtaccccacgatgtgatacaataggatatcacggcactatctagaaagcgttatggctctccagagaattgaacctgaaactaatcaagttcctgactcccagaaacatgtgaaacaccacaagaatggaactatccaactccagaatgagggaacagtatgtgacagcccagtttcctcatcaaataaatactgtagaatgaaaataaaaggaagagggagtggttataggttaaaggagatggatcaatcaaatacattgtatagactttgtatcatgaatgaatcaaacgagctgtaaaaagacatttgagacaaatgaagaaaactgaacatgcaataggcattgggtgatttttaagaaatcactgtaaattttgttgaatatgaataatggtatggtgactatttttaaaaattcttatctgatacagatgtgtactgaagaatgtacaggtgaaatgatgtcaggattttataaaatatactccagactattgcccacaaaaacctagggcagaatagatgaagaagggtagcatggcagactgctgatgattgctgagtgatgggtacatgggattcattaaactcttttctacttttgtgtgcttgaaattttaaggcaaagctttaaaatatacaatttaaaaaatggctcctggctgagcacagtggttcatgcctgtaatcccagcacattgagaggtggaggtgggcagatcacttgaagccaggaattcaagaccagcctgggcaacatggcgaaacaccatcattacaaaaaataaaaataacaaacaaacagaaaacgtagccaggcatggtgacccatgcctgtagtcccagctacttgggaggctgaggtgggaggatcacttgagctgggaaggtcaaggctgcagtgagctgtgatcacaccactgcactccagcctgggtgacagagtgagaccctgtctcttttttttttttttttttttttttgagagggagtcttgctctgtctcccaggctggagtgcagtggcacaatatcagctcactgcaacctccacctcccgggttcaagcacttctcctgcctcagcctcccaagtagctgggattacaggcatgcgccaccacgcctggctaatttttgtattttttagtagagacagggttttgccatgttggccaggctgaccttgaactcctgacctcaggtaatccacctgcctcagcctcccaaagtgctaggattacaggtgtgagcaactgcacccggctgagacggtctcttaaaaaaaaaaaaaaaaaaggctccttatgaagattggctgcttgata

SEQ ID NO: 7285 - DNA, 1842 bp, artificial
  synthetic oligonucleotide
gtaatgtctgtgatgagagcaaagtatatcacactgaatgccatgttcaataattaagggcaggaggagacaatcctatttttctgcatctgttacagtcactcctggaactgaactggccaaaattgacatgatcatattccagaatctctcacccttcctgatttaaaaaaaaacaaaaacaaaaacaaaaacaaaaaactatgattgcaggaatgtcaaaagaagtcgtctcccaatctatcaaagaatgaatagtctagtatagggccgatttaggggttctgaaggacagaggtccaagtagcctcttcaaaaaaaaaaaacaaacaaaacacgctgcgttggaaccatactgcagtctccattgaatgcaaagagctttcaaagaggcctgttcaaaacgtcaccaggttctaggaaaggggggaaaaacaaacacacacacacccccacccccaccacagacacacacacctaaaacctcactcagagccaaatgttaatccttctgatcccatttagggtaaaaagagggcaatccatttttacagtagatatatccatttctttgtttgagtccagacacattatgcgcaaatctacaagcaaggctgacgctgctgcggctcagagagctgatacgtaccgcctccccaggagaagacagtaagaccctgctagggggctgcaagtagaggggggtatttaagaggaatggaaaaagagagtggtcaggaggagactagaacagtggggtcccctcgcccttcccccacaactccaactgtcgaatatattctctgcggatactgcatccttggaaggccctacgcaggtccgagatgctgctattcatcattccccacgtcctctaataccgccaccaactacaatgaccacctctcaataatcctcttctaggcgctgcttcatctccatccctggtcctggagaggccgcttccgcgatctctgcaccctcctagctgttatgtcatgcccagccaccacagtcggccaccccacccccaggccaatagtgatccctctagtgccctccagcacctccaaatctccagcctccaacctatcctccgcatcccgcccccgtccctatcccaaccaccatcatcgatccctccagcgccgtccctaacccgatcccccatcaccgatctctcacccccgtccctaacccgacacccacaccttcctcacctgcagcccaggaagacgtggttggtccaggcggcggagagcgcgaggagctggtcgagggcagccccgggatagctgtgcaggtgccgacagatgaagctgcgccgcagagcccactgccagtcactttcgtggctatagcgccactgctccagcactggctcgggcgggggcggcgggaggggcggcagcggcggcggcgggagggggggcagcggcggcgcgacaggaagtcgccccccaacagcagacgtcctccagccatcttctccgcccccaagcagggaccccagggacgaagccgactacggaccgcgagctaggcagctagcaagcgggcggaaacggggggccggtgggaggggccgggtaaggaggggcgcgctgaggggagaagatcaactctcggggggactggagtgtgtgcgtgggggccaccgttaggaggaaaagaggagcacgagctcgcgtcccgacactgggatgcacgtcccctacactcctctaactcgtggaggagcagaagggcttccgccgcactcacgcgcgagccggggaggccgagtcaggctccgcacctccacggatccgcagacccacgcactgcgcggagagcgataaa

SEQ ID NO: 7286 - DNA, 1148 bp, artificial
  synthetic oligonucleotide
ctgaccccacccctcatcacattcccatctctgagcctcacctagtcttcactcacacacattctcaaccccctacatctttctgttttgttttgagacagagtcttgctctgccgcccaggctggagtacagtggcgcaatctcagctcactgcaaccctgcctcccggattcaagtgattctcccgcctcagccacctgactagctggaattacaggcacccgccatcacacccgcctaatttttgtatttttagtagagacggggtttcatgatgttggccaggctggtcttgaattcctgacttcaagtgatctgcccgcctcggcctcccaaagtgctgggattacaggcgtgagccaccttgcctggccccccaacatctttcctgtcccccctcctacctgtcagcttattcctgttcagtcccttttcaggatgtcttttcctccatctattgacttagcatcctgaggtttttgtctttagcccagtgttcttcttactctactctgatccctgggtgattttacatgtgtccatggttggaacatatcacctctaccttgataacccaatctatttctagcctcttctcatctccaattctgtgtgttcaactgcctactgctgaaggtcatcgcgtatctcagtattcctcagacagatcaaacttgacatgtccaaaacagagctgattattttgaaccctggttctcttacggaatgccatcaccatgtgtccactctccaaagctggaaatttgggcctcattctagatttttcttttgccttcacaaccccacaccaagtgcctaccaagtcctgttgatatttacctactcagtatttagcaaatctgtctcctcttccctatctcagcacctattttacctcttgccttgatcataaatccttctgtgatctggcacctgcttacctcttcagcctcatctcaccgttttttccccaagcttactccaagtgttagcccaggggcagaaccaggtttttccagcccttaggcttatgcaatctgaaagactctctgaggaaaataatacgacattgtgattgaacattagttacagagctttggaaggggcctgtgcaatcttcattagcttcacagtgactctgcctctg

SEQ ID NO: 7287 - DNA, 1715 bp, artificial
  synthetic oligonucleotide
aggggtcaaagcagggaaggggtggggttcaattctgccacctcattcggaagcagacgcaggcaaggacctaaaagaaatgaggctggagaaaaaggaaacataagcaccatacaatgttagagctggaaacgcccttaaagatcacctaatccagccctttcgtttcacaaaaggggaaacagagactcacagagaggaagtgacttggctcacgtcacagactgatttagtgacagagaatagtgctaggatccaggcccctgtcgagccaacggccactctcaaatggaaaagctgactcaagtggcacatgtgtttctttagactggtaaaattccgggacattgagcttctggcttgatgctggtcaggggcagaagggtcaaggaaccgaatctggaaacccgtgagctccccaaggtggttctggcccacagaaggcaactgaagcagtcaatgcggtggaaggcactcattgtgtgttcctgctctctactcacttccccactttttcctcctgtttccctctcttttgactgcggcctaagtctcagcctggccagctgcccagttctgctgaagaaccccaagactaacacaagcctaagtctaggtcaaatatccccacctcaggccaggggtgacccttgctcagggtgagtgaaactttcccacaaaagccagccagattccctggaagccagacaattgaaagagagttttctaggtgttctggctattgttacctccaatctgctaaaaaagaaaaggtttacccacaggcctctgggtgaatgcccaactgccctctggggagcctgaatttgcctctgcctccatctggtcttgtttaatggggatctgaaaaaaacccagttcctgcctcagcgccagtgttcagagctgggggcctccaatgtgaaaggaaaccgaacacgacctcacacctcatcagggccaggaaaacagagttctgccccgttaccccagggccttcattccgggtcagagagggccatggcaggggaaacctgagccctgaggcctctcgctgagaaggcctgcagatcttttccctggtcacctttaagtgagtggaagggccggctgagagcgcgctgcataattcagcagatggctgcctctaatgagaagacactgaagaagaggataacattatttctcaccctcctgagcatgtggcctccttcctctgtgcaggcggcagagaaacccacggtttcaaatcccagcagcagaagcctcctcctgccaaactgaggaggaagggtctgtgtttctaatttattctgcgccccccactccagttgttacttaaaataatccatcattacatggctggtggctccaagatttttatttaaagcaatatggagaagaaaaaataaaaaagaaaacccacacaacccgtgactgtgctatattggatttaagctgagaatctttttaatatcagagagtctccgaatcaccctagtatactcttccctgggccctatgggagtgctgagggagtgtagtgaaaagagggggaagagaggtcatggcaggattttgatgtcttagaaacatcatgaaaagacaagtgtttttaaacaaggaatctgtgtcatctggtgggtgtttaatcgtatcacccactgaccagcaatagcacttcggactaagtaacttggtctccctacacccat

SEQ ID NO: 7288 - DNA, 2394 bp, artificial
  synthetic oligonucleotide
attcctggccgggagcagtggctcatgcctgtaatcccaacactttgggaggctgaggcgggtggatcacaaggtcaggagttcgagaccagcctggccaacatggtgaaaacccccctctactaaaaatatcaaaactagccaggtgtggtggcgggtgcctgtaatcccagctactcgggaggctgaggcaggagaatcgcttgaacctgggaggctgaggttgcagtgagccgagatcatgccacttgcactccagcctgggcaacagagcaagactccgtctcaaaaaaaaaaaaaaaaaaaaaaaagaattcctaagctagccacacttaggtttattctctagtcttctgttcccaaaccctgaatacatgttccttggaggaaacaagcagcaaccagatgtccaaggtctcctgagttaactccgtcttccctggtgaattacaacttattgcagacacaaaggagaacagagagacaaatgacacataaacaggagcttcactggctgggggaggggggcatggagagtgacgtcagttttcccagaaacccatttatcacgataacaaggtctcgagtgcttaggctgctctttcagcttcagaatctggcgtacaattatgttcttcatcatacagtatggcaaggccagccagagcaaactggagccatgcaaagcaaaccaagtggccctaaagcaccccctcacccccatctgcagaacaaagggcatctctaggttgcctgagttgtgcctgaggtgaaacacacacaaccttctggaatgttccccattgcaacatctgccctgcaatcctaatccaggcaagagaaactggtgagagtatggaggacaggtcgatgcaaattcattagctgacatgaaaaatcattagcgtcatttttggatggagctagtgtaatcccagagattaattcctctacttcagctataccatctctgaaatgcaggtaaccaggagcagaaaagccacagcagaaaagagggagccctcaaaacactaaagcaataaacaacgagagtgccaatcttgggggaagaaaattctctcaaattgcatcatcacagagaatgtcccctgtctactcctggtccttccacaacatgactgcataaagtgctctgtgctagggtgtgcagggggtggaggaggttccgaagaaatgatcctgcccttccaaacagggacaaaagagacattaatacatattctgtagagaaaatattatcagattctggcttcagattttgtaaaatcaatttcaattacaccaaatacctagaggctttttttttgtactgtagttgcattgcatgaactattttcctaaataagtaagctacaaggttgaaaaacatttttatgtggttcagagattttcgtcaagtagtatgtggtgtcatgggatttgacctacctctgtctcccactccttcctcacctcggggtgctggtgggcttattaaagtcccagatacccatggatgaatagaatagctagggtgtcccccccaaatggaattcatcgccctttgcaaccaaacttctggtttaaaaaacaaacatggagcctcaggtcacttcaacatggtttctctgcacatcccaggctggaaaacttcagttctttaaatgaagattttttttttcccagagtcggtcgccaacaaaaaaagagacggcaccgcttttgcgagtctcacacttattttcctgagtctccatagaaagaagccagctccacaggttttggcacacaagcccagttacactgaacatgcacccgagacagatcctcagaggcccgctccaaaacatgccaaaatacgcagccagccacctacaggccagccaactgcaccccacactgacgcacaaatgagacccagaggcacacagcacaagcagacagagaggcgttcggacacacaccacagaggtgagcacactcagagaaacacgcggacttctttgggtcacagacagaaccccggcgccgccgccgcccgcccgggaagacacgagcgcgcgcgcgtgcacacatacgcgcacaccgatacacacacagacgcagtcacatatgtaatgcatatagagaaaccctatcccagccagtcacctccccgcccccctcgccactcaccgccttctgccccaggctaaccccagccccgcgcctctttgcctgtgcggtcccgggtcacaacgggcagccgtgcgcaggggcgcggcaaggccagggtgccagggacccggagggctcggcggctcctacggccattcattcggcaacgccccagccgtggggccgcagctgcagcgagggaggcggtggcgctcactgcggctcttgggcaatgca

SEQ ID NO: 7289 - DNA, 4489 bp, artificial
  synthetic oligonucleotide
cgctgaacctcgaagacctgaactaagtgcttaattcaagtctcctgggaccctttggttcctccaatacctgcccacctgcggctacaagtccctcctggggcctgggcctccagcctccttcggtggggtgtgggtcagtgtgtgtgttggtcttgatgtgtgagtagatgtgtcggtgtgttcgtgtgtattgtcagtgtgtgctagctgtgtgtctgtatatctgtgtgtcaatgtgtgtgttggcatgtgttggtgtgtcagtgtatttcaatgcatggtgagtgtatgtgtgtcaatatggagagaggtgttagctcactagctttacataccttatctcactcagtgcagtgggccgacgactgagacgtgtgaatcagaacattcatttcaataaagaggtttggaaactctctgggatcatgcctttctttttttttccttttttattttttttttgagacggagtgctctgtcatccaggctgcagtgcagtggcgtgatctctactcactgcaacctctgcctcttgggttcaagcaattctctgctgcagctgggactataagcgcccaccaccacgcccagctattttttttttttttttttttttgtatttgcagtagagacagggtttcaccatcttggctaggctggtcttgaactcctgacctcgtgatccacctgcctcggccttgcaaagtgctgggattataggtgtgagccaccgcacccggcctgaaatcatgcctttcagtctttgtcccgggtcaccttcccaagaacaggggagatggaagggctgaggaggcaagagggctcatgagtggtcagttcgtgagttttcttccttgaatgtctgtcctcgttgatgagtgaagccaaaagattcccctttatgaagagtcatttgggactcccgggcgcttccatgaacatgtatgtgctcatgtttgatgtttccttgtggggtcccttgggcccagcatggtgtctggcaggtgttcaatcaatgtttgttgagtaaaggaatgaacagaagcatgtaaatgaggtggcttcagtatttccatgtccttaaagaagctgcaacaaacagagacttcccaggggcaagcaggtggctgtcattagcatgccaatgtttgtggagccagactctactgcctgggagcagaaatggctacccctgctagataagagtgggccctaattggagcccagctttccacaggtcactgctggagttgggggtgctaatactggatagaggagcagcaagcaactcaggggcagggagggagaagagggcactgaaatggagctaagaggtcaggaaagggctttgtcctgaaactgtggctttgtgataggagaacgagaaagatggtagagtcagtctcaagtggagaagccctgagaaccatctgaaaaataagatcagaaagttggaggaggggccgggcgtggcggctcatgcctgtaatcccaacattttgggaggctgaggcaggtggatcacttgaggtcaggagttcgagaccagcctagccaacatggtgaaacccccgtctctactaaaaatacaaaaattagccgggtgtggtggcgcatgcctgtagtcccacctacttgaggcaggagaattgcttgaacctgggaggtgaaggttgcagtgagccgagattgtgccactgtactccagcctgggtgacagtgcgagactccatcaaaaaaaagaaagggagggggagagagagagagaaaagaaaagaaaagaaaagaaagagaagaaagttggaggaggaagacaaggtgaagcagggaaaatgatccgggattcaccaaatccagacagtgccaattaaatcagaaactctgtgaaggggctgagtcaaaatgaactaaagatccctttcctcaattctgcattatcacctgctgcccctggttttgctttagtttctttccagtgtttcttaaaatgtggcctttgaagcatcagcagcatatgggaagttataaaaaatgcaaattattgggccccacccgagacctactgaatcagaacttctaggatgggacccaggaatctgtattttaacaagtgctccagtggattctgatttatgctgaagtttgaagaccactggtttatcttgaaaatctagccctgatgggttgggatacaggactggtaaggtttggtaggatattgaaggagaagtttgaaggccgggccattgccaataattgtagatctgttggatttctatggtgggaggagtgagggtatgggaaagggggtgccaaaaaagtaatagaagggaacccagcaggagctagctcactagaagagttagaaagataaactttgcctcccgatatggttaggctttgtgtccccacccaaatctcatcttgaattgtaatccccataatccctttgtgtcaagggagagaccaggtggaggtagggaaagaccaggtggagataattgaatcacgaggtggtttcccccatgctgttatcatgatagtgagtgagttctcacgagatctgatgggtttgttttttttttgagatggagcctcaacctgtcacccagggtggattgcagtggcacaatcttggctcactgcaacctccgcctccagggttcaagcgattctcatgcttcagcctcccgagtagctgggattacagacgagcgtcaccacgcccagctaatttttgtatttttagtagaaagagtgtttcaccatgttgaccagcctggtctcgaactcctgacctcaagtgatccgcctacctcagcttcccaaagtgctgggattataggtgtaagccactgtgcttagccagacctcatggttttataagggactcttcccccttcgcctggcccttctccttcctgatgccttgtaaagaaggtgccttgcttcccattcacttttggccatgattgtaagtttcctgaggcttccccggccatgctgaactgcattaaacctctttaaattacccagtctcaggcagttctttatagcagtatgaaaatgactaatacaccttctttgcaattttcattcattccacaaatactcactaaatctcaactgccaattgctaagtgccagaggactcaagaaagaataggtgacaagaactcctaccttcaccttaagacactcccaggacagttgccagatagctctacaaacaaccagtaatgtgataagtgatataattggtcaggagcaacaccctggggaggaagacacccagagaggtgagggaaggtatctcaaagaagagccatttggattgaatctttaagaatgagtggtggtttatctggcagtcaagagggggcagcagagagaatagcatgagtaaaaccagaaagaaagggcagagagcatttcaggaattttaactcttggccagagggagtggtaggaagaggggacagtggctataaatgagactggaagataagatggggctggatctggaaggatcaggttggtcataccaagttgcttacactttttgctccagaataggggttctcaagctctgctctccagacaacgcctggaactacgcccaatgtaaatgggatgctcacagtgcaaaaaaaaaaaaaaaaaaaaaaatcagttaatgggtagaaatttctctatttgaactttttttaaccataaattttcctaaatctttgacagatgctcctgcttatctgctagcaagtaacaaaaatgaatgaacaacttgccaacgaatataaaacagacaaacgcagtactaatcatgcttaattcaacagtttattttttcacggacatctgtacttgtggctatgattttatattgcacacacataatgtggacatatttttagctagcagaagtgttcttttgaaaagtgttttatttcatatggcatgatttaatatatgaattatttcattacattctggaaagagcaccaccacatccagatgctatgccacctgaaccagttggagaaactatcccttaaatagtgaggagtcactgaagagttttgagcaggagagtgacttgaacatatttgcaatttttttttttcttgagatggagtcttgctctctcacccaggctgcagtgcagttgcacgatctctactcattgcaacttctgcctcctgggttcaagcaattctcctgcctcagcctcccgagtagctgggactacaggcttgtgccatcaggtccagctaatttttgtatttttagtagagatggggtttcaccaagttggtcaggctggtctcgaacttctgacctcaggtgatccacccgccttggcctcccaaagtgttgggattacaggtgtgagccaccatgcctagcccatatttgcaattttgaaaggtcactctctctccagcttgggaaaaagattggaacagaaggcgattaaagcagttag

SEQ ID NO: 7290 - DNA, 2056 bp, artificial
  synthetic oligonucleotide
aaaaaaactgcaaggataaatacaaagctatttactatgagttgttttggaggtccttaatattttactctacatgattctatatcatcttaaaattttgcgaggccatggtgatacacacctgtaatcccagctgcttgggaagctatggtgggaggattgcttgagcccaggagttcgaaaccagtctgggcaacaatagcaagacccacccccctcttaattaaaatattttttaaagtattttatgaagatgtactcataagctgggcgcagcggctcacgcctggaatcccagcagtttgggaggctgaggcaggcagatcacctgaggtcagaagttcgagaccagcctgaccaacatggagaaaccctgtctctactaaaaatacaaaaaattagcccggtgtggtggagcatgcctgtaatcctagctactcaggaggctgaggcaggagaatcccttgaacccaggaggcgggggttgtggtgagccgagatcgcgccattgcactccagcctgggcaacaagagcaaaactccgtctcaaaaaaaaaaaaaaagaaagaaagaaagaaaatgtactcaggtatcattgcataattgaagaagttttaaatcaaaaaaaggaaaagatagaataccaatagtaaatatgtgtatatgaccatacgtatatgtgctgtaggtaaatatacatataagaaggatcagccaggcacggtggctcacacctgtaatcccagcactttgggaggccaaggcaggtggatcatctgaggtcaggagttcgagaccagcctggccaacatggtgaaaccccatctctactaaaaatacaaaaaatagccaggtgtggtgacacatgcctgtaatcccagctactagggggtgctgaggcaggagaattgcttgaacccgggaggcggaggttgcagtgagctgagattgcgccactgcactccagcctgggcaacagagcgagacttgtctcaaaaaaaaaaaaaaaaagcatctggccaggagcagtggctcacccctgtaatcccagcactttgagaggccgagtcaggcggatcacttgaggccaggagttgaagaccagcctggccaacatggtgagacttcgtgtctactaaaaatacaaaagaaactagccaagcatggtggtacgtgcctgtagtcccagctactctggaggctgaggcaggagaatcacttgaacccgggaagcagaggttgcagttacctgagatcacaccacagcatgccagcctgggtgacagcaagatcctgtctcaaaacaaaacaaaacaaaacaaaaacaaacaaaaaaaaacaactaatatgaagctcttaacagtagttgttctggattggaggattatggatgatctttatgctccctttttgcctgtctatattttctataattagcatatattacttttgtaataagagaatgtaatcaagtatatttcattttgagaaaacattacagtgagaaataaaggccaggagagaaggactactcatgctggctagccagcccattatctctcagtaaagcacacctacgtgggaggccacattttaatcaagaagttgcttagtgaccacagaaccagagcaaagtgcctagctggatggctctaatgtcgaaagacagcaagcaatgatagcctgatgtatcatctccactgcagtgctaacctgcctgccctgaatgcagactttaaaacaccccaacacacctaaagcaccaagaacctgccctaagattgtttgatcgcattgccctggatcttccttgcttgtgtatgacttacattcgcctgactgtgtctctggctgacaataaactctcagcttcatagcctagctttgcatccgtttgtggtctggtgtctgactctttgttttagcatttgcccttggtctccttgaggcttaatttgcagcttctctctaatgaatttcagtttggacttgctccttgactcatcctgctaagctcctctagttgcaggagcccgggtaggggccctgcctctcc

SEQ ID NO: 7291 - DNA, 293 bp, artificial
  synthetic oligonucleotide
acaacggcactgggagagacagcagccacagcttcccgagaagcactggaatcctaggagcggctgccgggcaggggcaggcaaggcagacagatggaagagtgcccaggctgcatcatggtagcagtttgaggttctgttgaaggagggaagtgacaagctgggctgagtgacaggcatggatgagagggcagaccaggctctggagaaaacagcacatgaacccatctttagtgacagtgaactgagcagagaaatgtcactttcaggcctggaaatggccagggaggcat

SEQ ID NO: 7292 - DNA, 5328 bp, artificial
  synthetic oligonucleotide
aagttatagatacgctcacgttacaagtctatccttttggctggaatttggggcttgtatgtgatttgcagttgataagccaggcttgaatgccagttcctgtgtaccagaacaaaggctatggtgtcgcacagacctgctctgccacttcctgctgggtgaccttgagcaagtagcctaacctctctgcaaactggggacagtaatgattcccagcacttgaggtcactgggaggattaaaagagttaacatatataacgcaacaagcacagtgcctggcacatagtaaatgttcaaaaccaaattacaaatgcataaactgttctgaaggaaagctctagatatttaggacttgttccaaatacgtgagggccaaggaagaaaagcttccgataccttctatcactgctgccacaggtggccccgagggagtgggctgatttggcctgagcctccatcccccttggcctagactgctggaacagtcttccgacttcctgcctctgcacctcccaaatcacctttttaacacaacctccatcatggctgtgtctctccccggctcaacaatcttctatggctccccgttgctcactgactgagctccttaagatgctgggggtgtggaggcaagaaccactatttactaagggaagggaagagcaaagagtacgctggtattaggagtgaaaaagaaaaaatatccttttttaaaaagcccctaagctttgaatttgtagaaagcggggccctggggagagagcagggatgcatctctaaagagaacagggcgctcctgcggcgccggctcagattcacctgtagctgcttctccaagccaacctgggaaaattgacgggagggaagagggtggagagcaggacagagagggcggtgcagaaggggaatatccctcctgagttccctggaagagcgtcagcctggaccctggtcttgggcttctctgctggaatcctgggcagccccgggtgctgcggcgagggtcaaggccacacaaagggcaaggcaggcagacgagccagtcacatggggcagtcgagctgcctgcgtgaatgctaggcgcgggacaatggcaactccgggacaaagtgcagggagactcctgaagagataagagggaagggcgaaggaagggggcggggagccagagcctcggagctccaggaccgcgctttgggagaccgtggctggaagccgagctcggcccgctgcggaaggggcgccctcgcgcctctacactctagccccggctgggatgctgagaaccgcggcttccagggccgcaggcgagctcccagccagtccccgcgcccgcccttcggtgctggaggcggggctgccgagctcacctggccgtttggggtgggaccgcccgcgacccgggggagctgcagaggcggcggtacccagggaagtggagctgggcttgccctggggacttggctggagctcacacccctccacgccccccaaggcctgcgcgggggccctcccctagctccctccctcctcctcctcctcctcctcctcctctcctttgctccctccctccgaacccaattgctcaagcagcttccttccccaacgccagcgccagttcctctcccgttggggcccgggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttcttatgtatattaaagtggaatatgtgttcttttcacatgacaaggctgtcctttcagtgttttcccccacctcccttactaaccacaaaggaagaaactgcatatgtttgcagggtagaggtcacccaaccatggccgtgatgttgtgccccccggggcaggctctgggcctccttctcagaacaaatggccagagctgtgcacagaagaagctacttccacttggatctgaggagaaacatacagttcacctctgtcctgagctctttgatggtctggcctcaggcaccagcctcatcctagaagagttgtcatataggggccttgggttgggggtaaaaggcaaaagtttccaaatttacatttctgatatttccacggtcagtcatgtaatttaccttgatttgtggcctctaatgagacacacccacgggcacttttttttttccaagatggggctttcctcagtagcatttatttatttatttttgaaatggagtctcactctgtcacccagactggagtgcagtggcgcaatcttgactcatcgcaacctctgcctcccgggttcaagcaattctcctgcctcagcctcccaaatagctacaggcacccgccaccacgcccggctgattttttttttttttttttttttttggtatttttagtagagacggggtttcactatgttggctgggctggtctcgaactcctgacctagtgatccgcctgcctcagcctcccaaagtgctgggattacaggcatgagccaccacgcccagccagcagcatttatttattattactgttttttgagacagagtctcactctgtcgcccaggctggagtgcaatggcgtgatctaggctcactgcaacctctgcctcctgggttcaagcgattctcctacctcagcctcccaagtagctgggattacagacgtgcaccaccacgcctggctaatttttgtatttgtagtaatgatggggtttcgccatgttggtcaggctggtctcgaactcctaacctcaagtgttcccctgcctcagcctcccaaagtgctgggattacagacacgagccaccacacctgctcagcagcatttaaaaaattaagtttaaggctgggtgtggtggctcacagctgtaatcccagcactttgggaggttgaggcaggaggatcccttgggcccaggagttctagaccagcctgggcaatatagggagaccctgtctctacaaaaatatacaaaaattagccagttgtagtggtgcaggcctgtagtcccagctactagagaagctgaggtgggaggattgcttgagcctgggaggtggaggctgcagtgagtaaagcattccactgcactccagcctgggtgacagagtgggaccctatctcaataaatatatatatttcacttacgtaaaattctttttaaaaagttaagtttaatgcataaattgtagcttgcaaaattgctcccattcagaaatggcatgaattaaatagactacaggagggttgactgagcctgaaaggccaggaaagcagttgctggctacagacccatgctgccttggagaacagtgcattttaaaaatagcactgtatccctgaaggcttgggtagcccttgcaatggactgtcgcgttccccagccctctcatcccagtccgtgaacaccagccagaaacagtcaccactaacaaacagcccagaaacgccaccctgagcccatccatccaggtttccatctctgcctggtgggcctgtttgcttctgtgctcaaaactttcctactttcctttattttttatttttgagatggcgtctcactcttacccagtctggagtaccgtggcaacgatcatagctcattgcagcctcaaacacctgggctctggtgaacctcctgcctcagcctcccaagtagctgggactacaggcacatgttgccatgctcagctattttttttgtgtgtgtgtctgtacagacagggtctcgctatgttgcttaagctggtctcgaactcctgggttcaagtcatcctcccacctcagcctcccaaagtgctggaattacagatataagactctgtgcctggcccacactgccttcctttagtaacccatga

SEQ ID NO: 7293 - DNA, 818 bp, artificial
  synthetic oligonucleotide
gaaaaccagtagcccacaataccctcctgattaccctccacgttgcgcatgccacgggcagcccacagtcaggccacgatttcgggggtggctgccacctcccaccccccgcctccagaacgagttcgctacaagcgaagggaaaccggaatccctgcccgactcggcagcggccgggcaaagaaagagcccccttgaatccgcggccgcagcgcagcccgtccctctccaggttgctcgctggctcactagcttccctccaggccacgaaagacaacagtggccgaactggatattttcttgaaaaagcctttaaaaggctcccgcccctcaacgctccgcgcggcccaggcatttcctggcagcggcctcgggttttgggaagccaccccggggccgatgggggccgatggacttaccatggcgagcagcggagtcaagaacacaccacgatggcggagaaaggaagaggagggaagctggcggaagaacgagcttagaaggcgcttccgatgggcggagtttaggaggtgacgctatgcaccgaccgcctcttctagtgccttctctgtctagcggtgcgctcccgtggcgccgtgggaaagcgcgctggtttctgccaaatgcagttagctttgcttcgcttccctaagtgcgttcccccaggggcccggcagtgtgctaggggcaccctgcttcgtaagtgaggcagacagcccgtgataaatgccaaagtagaagcccctccgaaaaattaaggagccgattgggcgggactaaccctaagggagggcaggggaagcgaccgtcacctccgg

SEQ ID NO: 7294 - DNA, 1857 bp, artificial
  synthetic oligonucleotide
ctcacctttattgtcaaggaatacataaccatcaaagcgatccctgaacaaaataatgtcctcttggtttttaaagttgatgtatgctctggcatacatatgaggatacaaactgcagagaggaaagcaattatgtaaatgtactcgcaggtgtctggcccaattacaagtatgcatatattaaagacaagctcaaaaatcaaatgaaaaacagtaggataaaaagaatgaaagaaacctttttcatttacccctttccttttttttttttttttacctcgtatcattagaaaaaaactcaaaataatcatgctcaggcataggttgaagatgttcctgaagctgctccttggtcaaagtgggaggtaatcttcgaattaccaccttaagaaatgcataaggaaaataaaattagtacaaatcagttttctgtcatacctgaaagaatcacagttcctgaagaaggctgggctttaaaatatgagatcacttgtaaaaacccaggagaaaatattcttctgcagcccaatgctcagaattagtcaaacataatagtaacgcggtttaaaaaaacccttggaaatgagaaccacctggagcaaggaaaaatcgcaggttttgctctttacagcagccctgcagtttaccaggtttgtgcatcattttcgatcacccattttttaacagatctagtggcaataacttagtaagccaacgctggtctttgtgggtgccacgaaatcttgatttagcaacaagtttctcccacgtccaacacatcttaaaacaaaatccttgcccattgaacttaagaattcaaaactctaacgaatacaaaaaatctacccattgctctcaaaataggatgctctcgatctaccctcctgtaccattaatcaccctgcactctcccccaactcgcctccatgaataatattcccatccctcatgtctccttcactatttaatatttctccccaattacacctttagttcctcattctttataccgtcgctcttccctcccattatcatctcacagctctgacctaaacccttcccgtttggggagtcccctcttttcctcacccccacccaggatttggccgggaggggctctccccatttcgggtgaatggatgaaccaggatgatgcgacttccattcaggcgaagagatagaaggagaacctgagaaagaaagggggcagccccattcccagccatcctccccgcgctgcggactcgtcccgccctctcccgggccagcggccgaccgggcaccttgctcagcgcttctttcttctccttgttgcgatcctgcttatcttcccccttggagctgtcccccgaggtcccaccaccgctgcctgtggccccggcgggggttaacagggttactcgcttctccttaggcctgtgctccttctcttccttcatggctacgtcccccgctgaagcggcttggccggaacggggttaccccgggcacaaacggctcccgggaagctcccgtcaaagctccgcccccaacaaatgccccttgtgataagtcgggccccacgttccattgggtcctgccaagctctcgcgagacttgggcctttcccagtgcaaaggttttaacacctggtttttacttcccgcccgccaagttcctgcgccacccaatcccctcgcggcccagactccctcggggcccgccccttcgcgcgtcattagcaattccgccatcttgaagtgactctgtcggggactacaaatcccggcatacaaagcagctacccgcttttgttgggcgttcaggggccagagctatctcagggtccctgtttgtgagtaaatcgaatcctttcat

SEQ ID NO: 7295 - DNA, 726 bp, artificial
  synthetic oligonucleotide
tctgaagatcatacttggagtaatttaaatattatctagaaaattattttggctgggtgcagtggctcacgcctgtaatcccagcactttgggaggccgaggtgggcggatcatgaggtcaggagttcaagaccagcctgaccaacatggtgaaaccccatctctactaaaaatacaaaaattagccaggcatggtggcatgcacctgtaatcccagctactcgggaggctgaggcaggagaatcacttgaacctgggaggcggaggttatggtgagccaagatcgcaccactgcactccagcttgagtgacagagtaagactctgtctcaaaaaaaaaaaaaaaaaaaagaagaaagaaaactatttttagggttccttccaactctaattcaatacattcaggttcttcaagtgttttcttttttttttcttttaaatagtcttgttatttgcccaggctggtcttgaactcccgggctcaaggaatccacctgccttggcctcccaaagtgctgtgattacaggcgtgagccaccgcacctggcctcttcaagcattttctaaaggtatctgtaagaacaagtttcagataataatgctttattatccaatcacaaattacaggtttacctgtcaagcacattgtctcaactcaacctaaagttggcacagaaacagagagggaagaagaaacttatgagtagcatcaaagagaaaagaaata

SEQ ID NO: 7296 - DNA, 478 bp, artificial
  synthetic oligonucleotide
gccagaaagcaatggatgaggataacaaagccgcaagccaaacaatgccgaatacacaagacaagaactacgaggatgaattgactcaagtagctctagctctggttgaggatgtcatcaattatgctgttaagattgtggaaggtagtgatcctgtttgtttggatgcctaaataattgtctatatagtctaaatatagcaccacactacctggcaactaacgaactcacaccttttttttgcagaggagcgaaaccctttgaaaaacatcaagtggatgactcacggtgaattcactgtggaaaagggtcttaaacaaattgacgaatatttttcggtaagttaggccgaccactccagcatggtacaccggtgtgaagaacaataaagagactctcagcagatcaaaagtttgaagtctggaaaatctaggagatggtatcaaagggggctgactagaataagtaaacatcatct

SEQ ID NO: 7297 - DNA, 2085 bp, artificial
  synthetic oligonucleotide
aatgaatgtgaataaaaaccactaacccagaatttattcttgcatctgtttcgtgggattagcccaaattctagccatatcaataaaaatttactaatcatttggcctaactggcctcccggcctcgtgttccatctcccttgtgagccatcctatagccgcaaccacagtaacactaaaacaaacaaacaaacaaaaaaacccaagtctgattgtgttctcttcccaaacctctgctatctcccccgctgcctacagaatacagtcaacgctcctcagcttggattcaaggctttggccccaatctccctttttaaacctctctaggcttatttattaagtgcttattatatgccaagcactaggctagtcactgagttcataaaccagttggagagacaggtacattgactaattttaataaggtgtgatcagcactattacagagactgtgagaacacagatagtttcaggtaatggatgataaaatattgtttttgacctctgcaggttcacgagttctgtctacaatagtaatgtccaatacagtggtcagacacatttcaagtgctcaatagccacctggggctagtgtctgtcacactggatagctgagcacagatacttttatcacccatggacgtgggggttaactatagctgcttccaagacagcaagggagccgggctcggtggctcacacctgtaatcccagcactttgggaggccaaggcaggtggatcacgaggccaggcgatcgagaccatcctggctagtatggtgaaaccccgtctctactaaaaatacaaaaaaaaaaaaaaaaaatagccgggtgtggtggcatgcgcctgtagtctcagctacgcgggaggctgaggcaggggaatcgcttgaaccggggaggcggaggttgcagtgagctgagatcgcgccactgcactctagcctgggcaagagagcgagactccgtctcaaaaacaaataaataaataaataaccaagacagcaaggaacatttcccatatgtgaagcctgtggtgctagctaccagttccccaaacacaacccctctccccaacaccttggctcgggtatattttgtagtacaggctcccaagagaaagaatgcatgaaagtactttgtaaactattaagtgatacagaaatgtgatataataaacaggctcagaggtcttgctttcatcatggctttggttacttcgagcaaattatagctcttttctcaaactactcccacccctataatttatgccaaagtgttctgaaaagaaacacaggcaaaatggttatcctagggctaaaaatcctgattatacctaccttgaagcttttaatccaggaccctacttcaccacccgcctgctctgtcactttctctacaaaggaaggacacgaagtaagacttccaaaagaacaaaacgtttattttttaaatttaagaattatgggaaacctaagtaatgggaattgcatcctcatcggggtcttctggcaagtcggaagcaccaccctctcctgtagctcgatgcttctctagtttagcaatcaattctttcgctggattgaagacgccattggtctgctggtcacagacatagcagcgcggggtggtgcggaaatgctgcagtgcacagctctcgcagaaataatgcctgcacttggtgacaactgggttttggaagctctggcgacagatgaaacacttgaatggtatttcctcatcatcgcttcccacttcatagttttcatcctcatagacaccatagcgaccctcatcaagctcacgttcgatctgccacccatgcttgtaatctgaacggtcatggaggaatttgcagctgtctccgaagccgcagaagccagtctctttgtagtccttacagatgtcgggctggtaatcccagcgcacggtggcacgtagatgctcgggcgctcggatggggcccttcctcaccatcccggaagaggcattgcccatagacgtatccttgggcttcatgtatttctgataattgttgattccccgatagatcttgtcatcctccttgcccctcagctcctcctg

SEQ ID NO: 7298 - DNA, 327 bp, artificial
  synthetic oligonucleotide
atttttaggtatcacagaaaaatgtgcaggagcagttgggaggctagacattttcaaactggtatgaaatgttcataggtgtatttcgtttcatccacaattccaaatactgaatttttgtagttttctttcccagaaagcagcttgcaatctgcatggatgtgagtgaagccgaagtggaagccagtaagcctgatgaaagcaattggtcagagtagccactctctgaaacctgcctcagtccttgaatacctttgtcctacacattctccaattggcctgtttttgttgccttttctatgtttgccaagtgagttttgaacttta

SEQ ID NO: 7299 - DNA, 2185 bp, artificial
  synthetic oligonucleotide
ggagcaggggctgggctcagggcttattctctttccccaggccccttccaaacctttctgagccaaaagctacctaggggtttcaaggctgctggggcctgtttgcccttgggcttcagggtggaggcaatgcctcctggacaccaaggtaaatattttcaagcaacatttaaatgaatcaagtggggaaactttggcctgataactaggtttgtataaatagaatttgattggaacaagaaccatgatcagggtgaggagagtaaggcatggtcgtgcaagtggatgggcaaattctggttttatgtaaatatttgataatttgctcataatatttttgatttttcagagtagtgcaaaaagtgttatttttctggaatcctgagtttttttgtgcccccttacattcactatgggggaaaatcattcctaaagaaagcctcaatctggatattacaaaatagtgtactcggggagaggtgttgggaggtaagtatttaaaagcaagcttgaaatgaacaacataaattttgtttcatccacaactctaaatactgaatctttgtggttttctctcaccagaaagggacttgtaagatgcatgagcatgactgaaaccagtgtgcaggtcactatacctgaaaaaacttatttggcagggcagccattctacaatctgcttcaagaggtagataccattgccctagatattctgaagttggtgtgtttttgttgccttttccaggtttgcgaaataagttcaaactgtgagtttttgcgaatagaaaatgggataagaaaacctcagcttagggaaatttcccattatcagagcatacacgatttcaaaaaaggccaaagaaagtagaaccaaactacttttctagttcctatatattaatacaattaaatatgtatgtgaataatatcagtatgaagtatctaaatatgttatattgtatataaatataaataaataatatgcagtatatgtgtttgtatgtatgtgtgtatatatatacacacaaatacatatgtgtatatatattagggaggacatctatgtgaagattatcgataagatgggaataaaagcattgtctatgccatagaattgagaagaggaataaatgacaatatatgtaagtacctagcacaatacctagtcacagagtaagacctcagaaatatttgttactattactctgtaatatatcctctcaccacagtataacccatggaatatgtgacataacagaataagcctggttaggagtcacacatttggttcttttggagatacacactgaaatatttactgatgaaatgatgtgacgtctagatgtgcatcacaaaaatccagggggagatccaagtgtgtttgagaattggttagggtattcatgaaacaaggttgtctatgataattgttgaaactggataatgggtacaaatagggttcatctttaccattctctctgcttttgtatatgtctgacagtttgcataatagaaaaattgtaataatcagagttgtaaattcaaatgttgacaaggccagacaggtaacataaaagagagaagcaagcagggtagggactgtggcaaactgggaaagaatatgtctcttccaaaggggcagccagtattcagctccagcttagtgttgctggctggcaatgttgggccaggactgccagatttttcagtttttcaagattggccacaaattataatgttgatatgaaaccttcagttctttaaatgttggtaactaactgaaatatgttttattgaaaagtatgctggccatctaaatcaggtctgcagaacagactcaggctggagctgctagtttgtaaactctgcctgagaagccaattttaagcaattttcattctctggagcagtagaatataattgacagcgtttctaaagccaacaatccaagaatgccattgtgctgtcctgctgttccttattgtaagtcccgtgcccatatatgctttgctctctgccttccatccctacctgaagtttctctaactttatctttcattctctttacttggttctgatcttaaggttcagagcactgatgaccaagacttcacaagtgtccaagagaggagacctcacagtaatgaattaggcaccagctcacctgatctttctctctggtaca

SEQ ID NO: 7300 - DNA, 340 bp, artificial
  synthetic oligonucleotide
acacatctttttttcctttaggaaatcatatttcctctgtttatgagcaatttccataatctgaagtttacacatcctattttctaccactaaagcccctactgttcaaaacttatttgtcaaccatggaaaagacaacagaaaacaccagcttgagaatgtccaggacaaaacctaaagcatgctttagaatggctgtcctgccaaattgctttttcaagatttactgacctgcactctgtcttcagtcaaattcaggcgtgctgcaagtctctctcttaggggagaaaattacaaatattcagtatttggagttgtggataaaatgcaataatatgaa

SEQ ID NO: 7301 - DNA, 484 bp, artificial
  synthetic oligonucleotide
tatatctgttttgtgtgccaaataaggtatggataagaatttcaaaggaaaagtcatttaaacagaattacaaggaagcctcattttatgagctgacattcctcaatcaccaatacgccctgtacggctcacatacatacatatgcaaaatgggggtggggaaagtccctagtaaaagaacagtgtgtttcaagacagggcccatctccatttatgctgaagagcttagacacaaccctgtagtctaaaggaatcttccgaagaagctactcatagggctttatgggaaggtggcagccaaacatctatctagtatattgcaaattctgttcactatcctccctttctgtggaggacatagggaaataggaatcattctggcccaaagttcctctgcatcaaatgaaacacaagaggagactctaccaaagccagaatgaggcagttctccctttgctcacccatccccagcccagaaggcata

SEQ ID NO: 7302 - DNA, 1765 bp, artificial
  synthetic oligonucleotide
ttgcattagtgtcctgtctccctgctttcaccttttttctcctataaacattctccacccagcagccagagtgatctgatgatgaaaatgtgaattacaccatggtgcccctgcttatcaccttcatactgcttgttcttgggttgggtccagagtaggtacttaatacatggtaatgcttattacattattatttgctctggtatctaggaataagatatattaggccaaggaagaaaatctgtctgctgagtgaaagacacactctcctggcacatttcctggcccagggctcatacatgcagcaaccaacataggcttattgatggaagcacatataggtacatagaaacatggtacgtgtattgttttcacaagaagatgctctatctttattacatgctgccagaggagaacaatcactctctctcccttgtgaataaaaaaatatgaaagtgagtcaagtaggaaatgtgaggctgcatggtcatttgtgaaattgtataattaagcacctcaattaatcctcaaaacacctctatgaattaggtatgattgttatctccatttaaaaaattattaaaccaaggcaaaatgagaataaactgctcaccagattagccagctagcaagtagtgagtgaagccatgattcagatacctagtctggttctagggtcactgctcacataaatctgttacatcaggccgtgatttgtggctatttttgcttaggatgagggttccattaggtacttaaggttttcaagagtgaatcaaaaattaaaaattaaattatatttaaagtaaaacatttaagtaagtactagcttttctggtgcccacatagggcaacaacactcacctaagatgcctatgagtgactgaaggtgagaaaacaccggggtacactgtggaaatctgagatgtggaagaaatcaagctgtcacagacgtcccagctagtctactgcactccatgattaaaactcttacatgtctctcatgcagcatttgatccaaggctgaaaattgatcatgaactgattagttaagagaaggagagggggccagactccaacaaaagtcagattttggttgaagtcagagagaggttgtgagattgccatcccttgacatctttttaaaagtgaattgtttaatcacttttttttaagctgatttcttagccatcttgcagaaatatgaggcaggggcacttatccattaggtacagtaggtaaggtaactaagcccaatgacacccttagcagcccatgaaaatggtttagtttctttcataaaatggtgctgaagataatgatagttgcaaaggaaaaaatacggtagaccaatatcatagtatgttaccaagcatagggcctattattggaagctatttccagtgctcaggatattaacatctcctggagcgtctgcaaaacacatcttgaaggcagaaccatagtcctcaatttggcctgcctcttttatttgacaataaagttttatttatttctgagcataagattgggattttatttctagaaaaagggagaaaaggtggaaggaggaggaggcagggaaaaggtggaaacttgcccaggcccatagcaggagcccaacacagggaacacttaagcttgtgtagagtacttgtaaccagaagcccggaggtggagcacagcagaggatgcaatgtgccactgtcgcggccagagcccatgcagtgtaaacattaacattcttggatgcactaagcactgg

SEQ ID NO: 7303 - DNA, 805 bp, artificial
  synthetic oligonucleotide
aagtttcagataataatgctttattatccaatcacaaattacaggtttacctgtcaagcacattgtctcaactcaacctaaagttggcacagaaacagagagggaagaagaaacttatgagtagcatcaaagagaaaagaaataagcaaaaagaaaaagcattaagtctgcagatagtattggatataggaatattaacaaaaccatactggtatattcgttttaaaaaatctctttgtaggctgggcgcagtggctcacgcctgtaatcccagcactttgggaggctgaggcaagcggatcacgaggtcaggagctcgagaccagcctggccaacatggtgaaaccgccgtctctactaaaaatacaaaaattagccgggcatggtggcaggcacctgtaatcccagctactcgggaggctgaggcaggagaatcgcttgaacccaggaggcggaggttgcagtgagctgagaccgcaccattgcactccagcctgggcgacagagcaagactccatctcaaaaaaaaaaatctctttgtaatgttaatatctggcatgcaatctgccactgagtttagttgagaaaaaataattcaaaataatgtgtattatttaacaatgaacccttctattaataggaaaattatattccaggaattattttagattatgctaaaacctactagcaacatgttttaatctttagatatgttctatgtttttaaaacttaaggggtagaagaacataaatcacaagaaagaaaaatgtgagatatatttaaagttcttcacttaaacatttt

SEQ ID NO: 7304 - DNA, 1916 bp, artificial
  synthetic oligonucleotide
gcattcaatttgctattctcttctctctgcttctacaccttgtacaaatatttttgtccatgtttgtgtacctacctactgagctccctaaagaggtagagacctttgggttattcatttttgtattcccgagagcctaacatagggtttttgctacagatcaagcagggggtcagtaaatgctagttggaatgagggaattaacatagtactgcaccatttagtattcaattaagaagatagttgtccaaacactaaatttctttcttaaaagtagttactgtaatgtagttgctctcttgttatcccagaacttgaattaccataagaagttgtgaatttctatttgattgtatgtattttgattatatttcaagatggtttatcatctagcaaacagtctaatagagcagattcaaacttgcaaaataaatgaaacctgtatagtctctaaaagtttgtatgccctagaagttcacattgaatttcgatgaaaacgactcgcttcccttccatccaattgcttgcgactgtcttacccgatctttccctttccttttttcccacccgttagccctccggaaagagccgaacacacaagagcttcccagtcttcctccgcccccttgcggaaagaaccgaaggcagagcacggcgccgaagtggagccgcctcaagctcgggcccttccggaccaccccggcctgcgctcggaagaggagggcgcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggtgaggacccggccccaatcagggagggggcgaaggagcgcgcttgccttctccgtccctgggccgcgcctgcgtttgcattcgcctcacttgaaccaggaagcggcagagtcggaggctcagctcctccggctctttctttgtgtgggccggggagcgaaggaggggacgagccgcgagggccgcggcgcggtccccttcgccgttaggggccgaggggctgccggtgccctgggtaggccccggggcttggggaatccatcacagagacccacttggcttttccctcgcccctctcgctgcttttttgtgcctcttttactcccctagcccctactttgatttagagcttttctgccaggcccatcctccccttccgtccccttcccggggcacaacaatgccgcctgcttcgcttcatcccccccccaacaccccaccctgccgttcgccaccttctactttccctggtaccccatattcctcccgccctcactctgctgtttgtacctccgtctgtatttgcaagaagcttgctttgcacgtgaattggggttaaaaacctcggttgcagctggcagggtccatatggggaagagggaggtggaggaagggagatgaggttcagctgccgcagggagccgcgtgtcggtttgtttcactccctcgcggatggcttttatctctttccaccgtcaccagctcctccgaactggccctcggtcaagggtttcacagtgatgtggaatggcttttccacagtcgaatcgcatatcttcggagtgggttcagaccgacttgtgctgtctctggggccaccctgagtgggaggagggggacacataaacgaaacgaaaccgagtcccagtgtcacctggacacgtacatttgacgcattcccatattggaagaacccgggagcaaatgacaaaaattgcgtgccgttttcagaaaacctgtctttc

SEQ ID NO: 7305 - DNA, 1461 bp, artificial
  synthetic oligonucleotide
gatgggccaaaatagtggtctggttatattttaaatcaataaatctgattttacaataaatttgggccctgtttctatttgtgtgcacgtataggagtgtgtgtttgtgtgtgtgtgtgtgtatgtgtatttctgttagaattctggggcttacgttgtgagacgcccgccctgcccccccattattgatcagtagcattccgagctccagtaacacaaaaggttactaggtagcacagcaaatggtgaaagcaatcttgcctggacaaaactgagtctattctgagacaatgattgtggactttggaaagaatgctactttttttccctctccagtttactctaaaccagcgataccaattaggagaaaatggaaagatatattcactttttaaaaattcatctcaaatcctcatatctttggtcaacaagcacttcttcaaacatttctttaagatctttttcaccaagcacctcttgtcagggttcctttcaggatcccacaactttggaaatggtggttcctagctgattccattgaagactgccagctcacagccctcggctcctgtcctcactctctgcaaacggctttcatcagccagcacccccgggcctccctgcagaccccggggactctactcagggagaggcacatcacaagtcaccaaccacacttggatgtaggccaaggattgtacttaggctcacctgaatgatgttcctggactttttacaccatggtcttattttaatagagtgatctaggcaatgattcctccttggtatccttatctgtgcccccactggttctctaatctcatgaatcaaagatcttctccccagatctttgctttcattttttttctgccctggtccttgatagagttcccgggattcacatttgataatgctcggtacttcccttgctctccttccgtactgtcaaagaagctcccaacaggtggaaacaacttgcttttaattttttaattaaatcaactaaacaaaggaggtaatatatgttaaaacactcatagaaccagaaagggctacccaaatgttagtcaggggcagctgggatgaaatagaaagagcaaaggctctggcatttggcaaatctgggctccagtcccagttctgctactcagctctgggcaagtcacttgacccctcttggcctgtttcctcacctgttaaacagagacagtaatacctacctcacaaagtagtaatagtgaagattaactgtgcaaaagcactttgcagagggttaggggccattattgccgctatcaagacagaccatcagcaaacccattttttcctcaggagatcaaagataacagtgaaattaagaacgcagaaacaaatctatatatctgcagttaattgatttttgacaaggttgctaggatcataaagtagggaaagagcagtgtcttcaacagatgtgctggg

SEQ ID NO: 7306 - DNA, 296 bp, artificial
  synthetic oligonucleotide
aagtcatgtggcttcttggtgctctctctctaccccgttgcccccaatactagttctaagcaattcccctgatcctttgccttctcaaatcttacccacgtgtcaaaggcctagctccagccctaccaccactgaatgccttctctgacctctggaatccaagataagccactatggcacttggagtttgttcccccagcttagacctcattctctagatgtccgcgtgtccattggtgtcttcaccttgactgccaactccttgagaaaagggactgtgtcttctccctctcatg

SEQ ID NO: 7307 - DNA, 1322 bp, artificial
  synthetic oligonucleotide
ctccaatgcattcagttttctgacgttcactactagctttatgtcagatgaataagaagacatggctactgtcctccaagagctcacggtctagtaagggagagacagactgggttaaggaccacagaccaggtaaaaacaaagtgctataggagcagggaataattcacgcagccaggaatataatatatatatattatattataatataatatatattataatataatatatattatatttaatatatatattaaatatatttaggtaaataaatttaatatatattaaatatattatattatattatattatatattatatatattaaatatattatatatcatatataatatatatgatatataatatatatcatatataatatatatgatatataatatatatcatatataatatataatatattatatatcatatatattatatatgatatatataatattatatatatattatatataatattatatatataatattatatatatattatatataatatataatattatatatattatatatatattatatataatatataatattatatatattatatatatataatatataatatataatataatatatataatattatatatattatattatattataatatatataatattatatatattatattatattataatatataatattatatatattatattatattataatatatatattatatataatataatatattcctggctctgctacttataaactctgtgcccttggcccaattccttaaccactctgtgctttggtttcatcatctataaaatgggaatcataatagagcctgccatacagggttgctttgaggattatatgagatgaagtatgtagtgtgatttgcataaggtaggctgctaaataaatggtagtgctaaggtttcatagaggaggagacatttttgtatgcgctcaaaagatggattagagctcagcaggcagggaactaatacgtattgagtcatggctggaagaattcacttacctggatgacaggttaatgaactcaccagtgttgctaaaacaatcttccatttcaaaagcattttaagttaaagaagcacttgccccctactttggtcacaggaatactatggagtttggtggaattcatatcattcccatttgatagacaggaaaatgaaggcatagataattgtaaagatgtatgccctcttatagcaagttaatggtaggtctgggactagctctcgggtcccctgaataacagcttgagttcttttagccacacctcgctgcat

SEQ ID NO: 7308 - DNA, 7147 bp, artificial
  synthetic oligonucleotide
aaaacaaccagcttttctctcatccgggtattccccctggtcagagcccccatctgcattgcggtctttgaacctgggtgcctcccttcctttgaaacatgctcaaaattcccctcctccaaaaagtttttcttgatcaaaattaatcacttattcatgtccctaaattcccaggtaccttactcaataagtatattaattgtaactggtaccattacaattgtaaccgtgggtctggtccacaacccatatgatatctgccagtcccaggattgtgtatctgagggaaccaagatgtgagttgctagaaggtaggatgctgtctctgttactttgttttaccttgcacacgttcttgattatcctctcccaagagagtagataaggtgtataatctttattgggcacagaaaagttgggaacccagtatcctgtcctgtacacggtgttgttgatgcctggctagttctctgggttgatcttttgaaccgattaggatttgcttacctgagtcagctttgccacacagggtgggtccccggatatcccagccttgagtatccctagaaacaagtggctgcccacacaagggcctcaagaccctgccaatctcccaaacatttccttaaaggcgctgaaatccatccctccccactttagacagttctctgaatggagaacatccgaggccgcccgcgaattacaaatgtgttatttgggaggaaggaatgccctactgtagtagaggtgcctttgcgcctgggggcggtgttgccaaaagggagaagggggttgctgggaggggatggggggacactggagtcaaattaccatcttcttaattgcaaagcgcctgctccactctgagccttggacgcactgctctattcccaggcagccagcaagcgtagagtgcaggcaccttggtgcagtgtgtctgcgtgttttaaattttattgttttggttgcggttgtgtcttgacaataaagggagtcccctcagaaatgctgcccttggaggctgaaacactaacctacctacccactgtcctcttccccccacgcaagggaaggtggtgttgccagagctaagtgggagtagctcctaagtagcctagacgctgattcaggcccggactgtgcgggaccagggccagggaactccggggagactcccctgtccaaactgtggaaacccagcgttagcactggactcaggaatttgccagtgccgtcggtctgcggacttcaaaaagtggaatgcgtggcgccggctccgcttctatctgggatttatgattcctttcccgcagtgtggagactgggctgggcgaagcccactcagctgtttgttgcgcagacctttcgagaaacacaagatcgctgagggcccctgggagcccaagaaagaaagctcttcatcttgttccccaacccacagagcagtgcgccaagtagcgactctttaagccctgggccaccaaccagcccactccccgaaggcagacgggcccggggcgctgtggcttgatttgcaggtggttaggtggttgtcgtccgcagcgggaatggacgctgcggaaccccagcactcttccactctgccctccctcgcgaagcgcaacagcttggcgtcggggagccagggctgcgttgttggcgccacagctggccaaggtaagcagtgcattcccacctctctgtctctctctctctcgctctcgctgtcgctctctctcgctctcgcgctctctctctctccctctccctctgtatgtgtgtgcgcgtggtgtgtgtgttggagaaagagtgcgcgcgcgcgagctgggagtaagggggagtctggtactgctgggctcgggattcggaccaagtccttggcctcatttgtaccccgttgtaaataactacgcccttaaaaatgaaaaagcaaattcttatactgaatatgcaaaaccattgaggatacggatctttccaccatccaggagataacactttctggggcccctccggtgaacgagttttgttgacactgagtcttctgcgggcagtagggagattatatagggggttcgatcttctccctgccccctccactcgagatgttcccgcaaattcatcggagaagacctgagcagactgatggcaggaactgcgggacagagggattttgcagaatgtaaagtatgttggaaagagagaattcgatttgattgaagtgtatccgaggcgaattttaaaagattaggtgggatcatgattttacaatcccctcccgctctccagggctccaaattaatttctccgcccagtgaaatcacagggcttgggaaggtgcctaacagctgagggggactgggtttgtttttttttgtaactaccaaaaagcagcttcgaggggcagccaagttggtgcccgaaggtagctgtcccccagtttctataaggaaaggagtcgaagggtgcccctccccctccattccgccctgcgaggaaaagcgcgacttcagaagatgcgcgggctcgcgctggatgtttctttctcgcgctctcactcctgcccctgactcccttttcacactcatgcacattccgtgcatttggagcagagtaacaatcaaattcaaagaatgttgatcccgccgctgcagagggcagggctgggctgtcttgagtgattcctcaggaattcccctcccctcatccccccctttcttctcacccccgcccatcccccagagttgcgcaacccgccccccccccccaatcagcgaggtgcaagtcaggcccccacccaactgcatctctaaatttcagggcagcttcaagagagttgggagggggcgaggaccctgcttctaattgtcgttagtcgtgagctcttagaagtgaccaggactttgcaaagagggagtgtcgaatggaaagcgaaggcgcaggttgcagggaagtgttttgatcctcagattgctgggatttaccaccgactgcaagtctgtagacacacgcacacaaacaggcacacacccgcactccggggcagagatactccgacgcaagcttggcgctccgatctccgcacgtcgctcccgctgcagccaggccgctcccctgggactctggtccaccacccagacgctggggcgcgaagaccaccccatccatgccccgtttcccgctctccggcttttggggcagctggggcgttcacagtccagaggccagggcactcaacccctgctgccgccgcccgaaggaagggccgctagacttacccatggaatcgggcagggacatgtcgctggaccgctgctgagtcagggactgatgcatggtgaaaactgcccggttgccccagtccccgaagctgcttcaagcgcccccggctctgggcgccccgcagagcatcctactccgcggttgcctctctcggtccttccgagagctgagagacactgcctctggttgcgagctgcagcccaagtgccgcctccccctcccttccactcttctccctccctcctcttctgcctccctctgctctgggaggcagcagcattggcggtccgtgcagccgcgtgcgcttgcgcaagaccccccccctcctccctccccctcagtctccccatcctagttatccacctcccagccttccaagccagacagggagcagttttagccccttggggccagggctgcgcagagaaagagggggaggcttcagtatgaagccaaccaaccttctctatagttggacagggtcttgggtaattatcctgttctaggatttataactggggagggggtcagagtcagaggttcagagctgaggaacacacacacacacacacacacacacacacacacttgagcaggtctggtcttagtgcttccagaatgacataatggagctggagatgatccagagaagggccactctataatcaaagggatggtgtgtgtggggcggggggagggtggtggctgacatatgaagatagattaaacaaacgcagactctttagtctagaacgatgaaggctgggaagtgatgtgaccagagtgtataaaattatgcagagacggagagaaggagcacagccttattcaccagacctgagaattctagaaccaacagcccccaatctttagctagaaaattcagctaaagtataactctgcaccagaaccccagtttgtactgttcaagtgcttttataacaaggatctcattttatcatcatagcagccatgcaagggaggaagaggagttatcaataaccccattatgcagaggaggaaactgaatctcagagaagggaagaaaatatcctgtgcccactcagctagtaagtggcagaagtgagagctagaacctagatctgttggactccaaggtgagtgttcttgctatggcgactgaaaagaactattattctctatagcaaatggaaaacctaaggaattcattagctccaaaagatgcagcaagatgaaaatgcaagtagctttggaaagagtgaaagtaaagtcatggctgacagatccactgtggattactaagggaaactggggatgaggtgggaatgtcattgatcttggaagacagccaaatccttctcgaacctatccttttggaccccattaggatattgggcttgaagcaccttgtggttggaccaaaaggtggtttgaatgttctcaaaacaactgcagatcaggatgaggcctccttggagtgcccccaagacatctatctggtggccaggggaggtggagggtgaggaagcgggtaacagtggactccacctccctctgggaacagccctggaagcctaacatagctaagagaatatacctatttggaggtgcccatactgtcccattgaggagctcccaggctctgcttgccaggtctccttccaaccacctccttctgatggttgctgcaatcctttctccatgttccccgaaaaacccaaaccaaatcaagtataaaactattctaagagtcaatgggatgaagaagagtacttggctctttccagatctgccttgctaatctactgtaaagctttgtttttcttatccaggaaatgggactgaaggcccttgccctttcccatcttctgaaggaagaaaatatgtttcttgaagattaaaaaggaagccctttgtaaagaacttgggcaccccaggggccacgttgaatgctgtgtcaggtattattagcaaccctacactatacatgtggtttagaaatctgtgatatatgtcctagatagagacaagatgcctactattgtagatgtgtgtgtcttaagcctgcttagcttgtgtcagggtctctataagctccacaaaggcagagagaaatcctgtatttatacttctgcaatgattgtctttgagtcctgtttacttatctctttctcctctcattctaaatatctcatacttaatgtggaggactcctgcaaccagcactgatttctcaggagtgcttgctaattaacatatttcgtttctgtgaaagtagcctgaaagaaaagaggtttttatacaggctctaaagactatatgacaccttctttagagattcttggctcccctatagcaatcacacagcaagagatccctaaagaagccaaatagaaacttgttaccatgctggttttgatggacagattgagggcttttcaattcagagagaaacacactacccaccaaatgatgcagagggcatatgtaatttgacctttataatcccaaagacacaaactagtgaggtacctttaatgggagtgaggtttgctttctcaacatctgtattcctgaatcctgcttgaaattgaacattattttataaagtactagaggagctggctatttaaaagaactgcatatggtatgtttcttttgtgctgtctcttggggtgccttgtgggacttggagcacagcacgcactcagtcaagttaaaaatgactttgagaccagtagcagtgacaatagcagcagctgcagcagcttggagagtagtagcagtcttctccccagagatggtgtatttgtctggagagaggatcgggaaaaggggagggactagaatgggaactggggggaaaaccccctacattttaactaagcccagtacatacacctcttttcctccaaaaaaaagtttattttaactcaaattgaacaggatgattaaaaagcaagaggcaatgtttcctgggctccattctgattttcttcatgtcaaaacacatgtggagtttatacataaataggtttataataaaacttaccaataggcaagccatctagatgaagaaacaggtctttcatgcaagtgaaggctactataaaactgcttggttagcttttgataaaaaaaagaaattattaaaatgccttaaaataaatccttttcatagcaagcttaatcaagcatacagtgttgccctaggttgcaaactgctttatagcatcaggaaatgtttaccaatggggctgcagcctacttctctccatcttcttcaaaccagtgatgagcgccctccccagaagccttcagaccagtagaaaaatgccagatggtgctctgtgtctaacacattctccctgggaagagccatagcattcaattatctccttattttgctgaccaatttgactatttaaattacatagtataccttcctgattccaattctgggaatgtgggctagagaaatgtctacatgtttacacacacatacatgcatacatgcatatttaaaatggtggccatacaggtattcacaagtgcacatacttatagacatcccagctagtatctctacgctctggttatcaccatccaactctcgttttccagactttggttgatcaaggacagagagaagcttcagaataatggagagcctcaaagagtccaaacattcctaactgaggttggggtgtgcccaccagactaccttaggtcaatgcctagtactcagtgcctgcaccacaaacatgtgaatcttgattgaggaaaaccatagttaagggtgttgcctgattctcattgccagctggtctttttctttgggtaccaggaaaataaccatagcaccagggaacagtgttggtac

SEQ ID NO: 7309 - DNA, 442 bp, artificial
  synthetic oligonucleotide
tccactggaatgtctgaaggtctgtgcatagctttttatatagctcagtgtgattacccaacatatcagggcttttttcacagtaacctgcctgaatctttgtccagaatcactaaaattggctgtcaattctcccttcattcggggatggggacatgtagctaaaggcagtaagtgaggtgtttgtgggaagagcctgagctttggcaccagagagaactgggttcaaatacctgctctgctattcactagctgtgcaaccttgaataagtttctgaatttcttcaggccccaaaaagtgttggttgccttcccctactctcgggattctgtttgtgatgctggggtaatgagtataagggatgcctctcaattgcctactcatacaattgagtgccttctatgtgagactttatggccattatcctgttggtaaccatca

SEQ ID NO: 7310 - DNA, 1384 bp, artificial
  synthetic oligonucleotide
ttttaagaaaatgtgtggcagttccttctgtgggaaatgagggaggagcctcatgtcaagtggttatttaaaacccatatcttgtcatttgtgggcttgaaatgaatttggctaaatgaattgactaaattgaatttttagaaatcaaatcttgatcttcatttttaaaggtttaaaatgtatttgttctttgtattgaatggaggaattccgtttaaatgttcaaaactggtaggtaggactgtacaagaaaagatgaaggcggtgatgacaaaccaataaattcaaggaggccgtttggagaaatcgctgagtcaagagtacggcaatcacgtgaagattttaataaaaacgaaactaatcagacgcgtttagacttcccttccctctccacccacttttggtcttgttaaagggaagaggagggtcggttttaatcaatccttcggtttccctactgggcggagcactgagaaggtggcggaaggaggggcaactgggcccggctggcgcgccttcaggcacgtgggtctgggttgcggaccaggaacacagcgatcagggcgaaacattggccttttgtgtctcttgcgtttggtacgttttgggggccggctgcagctgtgaaaggccgcactcgctgccagcggtcaaggcgaccttgttcagcaaagccactattgtactttgagctagtgactccggcggcttggcagctttctaggcattcctccaggacctttctccccctggaggcctcagctttaaatgcagtttgtttttacagttggatacagctctattcttggctttggcgccaggagtagcttgcaatccttgccagttaattgtggcctctgcgcgaaaagaacgatgaagtgctgcccttttatgtctaaaggtggcgcttcggacttcgctggcagtagctggcagtaggtgctttgaagtctttcttcagcgaacctactcatctggtggcctttatgcgagcatgaacctgcaccaaagccactaggcttagtacctgtcctgggttggcatgtctgtgggtgccgctgtagctataaatgactttgattggcataaacacaattgtttcacatgtgcacttgtcaaaatttaattaattggacactttatttctgctagcgaagtttcctaaaaacaaataaatagtacactttaaatatatgtagtttattatatgtcactgatgcctcaataaagttgtttaaaagaagcacattcagaagattaatacatgataactaagattaagtaactgataaaaatacaaaatgtgtttcttttatctacatcaccgagtagagaaaaaaaatcacatctattgcccaatttcgtaatttaactgccatttatt

SEQ ID NO: 7311 - DNA, 686 bp, artificial
  synthetic oligonucleotide
tttaatgctgtaaggcttttccatttttggtaatctgatgcatgtgaagtacaataccttacagttttattctgcattcctctgaccatagtgagattgatcttattaatgtattggtcattcgggtttccttttctgtgaatcccctattcatattctttgctcgtttttgaacttacctgtttttcttattgacttatgaaacctacttatattttctgaatattaatcctgtgttggttatatgcactatgaatgtcttctcccagactgtaagttgtctttctgatttgtatgcggccttttgattagttatattggaactatctctccaatgttatttttgtgctttgtattaactttactttttctaggcttctttccttctttccctgtttcactgatcatgtttcccccttctactggtttggatgttggacattctaattctttttgagtcagcctaaaaatatatattttaatttatatacagtataattcatttttgttgtacagctctgagttttgacaaatgcagagctgtgtaaacactactacaattaagatgccaaagagtttcatcatgcctcaaattccctcttagtacccctttatatatccctcctctcacccccacccatgctaattactgatctgttttccactgttagttttgccttttgcat

SEQ ID NO: 7312 - DNA, 666 bp, artificial
  synthetic oligonucleotide
aatccttaccccaaagtgtatgccccattaattcagagtcaaactctttaatcctgtagtaaccttatctactatttaggtataaaataaatgggaaatttttatacaaataataaaaccaagaacaatgctttatcttaaaaaaaacaactctggatattatgtacaataagttggaaacctcaggagcttgctcaatttatgttttcatcatatatacatagacatgagtgacaaaagaggaaatcgattgaaagggtaaaaagctaacattctccttcaggaatcaaagaaaaggaacagaaagaatgagaaacctaccatgtttaagtttggacagcattgatttttcagcatctacagatgcactctttccgactaacaggcgcttggctaaatctttcttatagaaggcctcaaaaacatccttgcctatgtaaaaagaaatgcaaaatttataatattccaataaaaagtactgacaaaactgctttaaagtgctttaataaagcacaccattattccaagttattttactttacacattttatttaagtttgttaaatgcaagaaacagtagagatccatttttgtgccagacatttcgaagtctttattgtaaaacttttttgcatgtaactgtcttgattgcattaacttttcttc

SEQ ID NO: 7313 - DNA, 923 bp, artificial
  synthetic oligonucleotide
tgcccaaggtcacaaagcaggtatgtcaaactggatgcttacatgttgaatgatgacagaggaaaacagggatgtaaatgaggtatggtgggtttggctcatcacaaatttggttagatggttagtcctgctattttgtgataaacgggggctctcaggtctccccaaatttagctgtatttggacctggaggcaggagttgctgttttattggtgttccttacattgctaggtgtggaaggatccaggcagtggcatgaccagtatattttctcacctgtgctctgcagagcaattggtggtagcggcagtggtgtggttcttagatgcgtcttgccctagttggatatataaggccaggctgcagctgcctctaaggtataaggctgagaggcagtttgtgggaaatgggaacctactggaggacttcacaggctgtagattctgagagatgtgaggcccagcaggggtctggcagtagcccaattctttcttgcagtgaaagcatctcctccagtgttcaaagctttggcctagctcctaaagaaacctttctttactgaaaggtttgggtgccatgcttggtgctcaaggaaatttgtaaaaaagaacaggaggccttattgcaaacttccttgggcagcattttagagccttgtgtcaagatgaccctataaaatcctttcaggattctaagaaggtaaacacaattgttgaatatttaatgcttattacagctacattacttattttagtataatgtatgatagacttgggttttctgtgtcctgtgctacatgtacctcaaggacccttgtaagataaatttcacagaacatttatgcacaagttacaggacagagaaaatgtatgtctaaaacataaaggtcctttattacatgactaaatgaagttcattgttt

SEQ ID NO: 7314 - DNA, 375 bp, artificial
  synthetic oligonucleotide
ttttatttgttgctactaaattatctcatcttaggtcgtttcttagaagttaaatgagaacaagttacagaagagtctcagctgcatttcagcccagtcagggcctactgttatcagacttaggacacaatagggaattcttgattactaggggaaaggatatagatgatataattggatcagctttttggatatcaacttgccactgtaatgttcattttgacttactgacatacgttggagtgaaagctctcaaaagggaaaagaatttaggcaccaggtataggtatctcttaccaagcaacaattttgtgttaggagtgaatagtgggaaatattggcaacctccaacttttattttgaaaattaattatt

SEQ ID NO: 7315 - DNA, 711 bp, artificial
  synthetic oligonucleotide
tgttgtcctatgctgatgcataatgaagccctgaggcttggaaacttgcaaaccaataagatgatttaatgatgaaacggcatgtcagtttgacactgtctattaatagtccttgagtgagcttaaatttgagacacttttaaaagcggcatgtagttccagttttgcttcccttatcagtggagcttgagatgtctgttcctgccgactgatgttttaacaaatttttagtttctcatgatgtgaaagattttgtatgcacgtcttagtctggatactgttttcattagttctaatgctgctgcatgcaaattttgtttaaaaccaaaattgactcttcacatctggactagattggacatggtgaggaggctggaaggaaagtcctttttgctctgtaggctctggacagctttcttagagttgacttatccaggattaagaaaaagttttcttttgcgtgactaaattctttccacagtttgcttgtgtaagcattttagatttaagcaagttcaacttgaaatatatttgaatatgaagtagaaacagcttcatttaatgggataatagcaatctctaacccatcaaattaatatctactaaatagcttccaaaaagcactgactggaaaatatttttcactatcatggctttattcagtttcaaaaacagtaggggctaaaatgtttggacatttatcctgcattt

SEQ ID NO: 7316 - DNA, 1561 bp, artificial
  synthetic oligonucleotide
ctgagagatactgtttattactgtactcacattgaacatgatttgattgtagtaattgcatctgagaccacatattagggggcttcataaaggggttttgttattcttcaaaactaataacgcttcatcttaaccaaaaccctcaatgagaataatcagaaataaagcaaagttttacacactaccctgaggatcaataacttcaagcccaaggccatcttaaggaaattttctttctggtttgctaaagctgtgggagaccattaccatcatgaggccagttacaagaaatattgatctctaaaatgtcatgctctaacactctatgcggactcacagcatgtgctggccagattgcagaacaagtcagctctaagtatttcacacatttatcagtacaggagctattgcatttaccactggattaagtttctgagtagccattgaaatttgggaaaaggtatggtaatgcaaagtagataggttaggacctccacactgaaaacagatatggtacagctgtgaacatgggaaaattccctgaacttgtacaaggaaacaaaatccagaacaggctgggcgcagggactcatgcctgtaatctcagaactttgggaggccgaggcgggtgatcacctgaggtcaggagttcgagaccagcctggccaacatggcaaaaccccatctctactaaaaatacaaaaaattagccaggtgtggtggtgggcacctgtaatcccagctacttggaaggctgaggcaagggaactgcttgaaaccaggaggcagaggttgcagtgagccgagattgtgccattgcactccagtctgggcgacagagcaaaactctgtgtcaaaaaaacaaaacaaaacaaaacaaaatacagaacagattcaactcaggtaagtgaaactgccagatggccaaaacaagttcttcaaatttccacagaactcattgacccagcaggactacatttttatccaaattgcagctgggagcttgattaactgagaaacaacacaattaaatgacatgacattcttcataggcaccaatccaatgtcagtatctgcaggctgaagtacagacagttacactgaaattgcgtatgctctgaggaatgacactaaattcgcttccaggaaaattactcaattttgtaagtaattttcagttttttttctcagggatatttttcaactttcactttaattttctttagttgcttagttgtacattttgagaaggcaaatccattggaacttggggaggcttagaacataaatcagtattagaagtaaagggaacacacagctaaaagttttactttaatcacaaattcacaactagagatatcatttgcatatcttagaacgctaaagacctgttaaaattttttaaccaatcagcaaaaatatgtgccccacagatttctaatgttcataatttagaatttatcacatataatatttattaatagtttatttgcaaaattattattcttaaaacacttctttccaacacatttacaatgttcatgtgttttaaagaaaaaaa

SEQ ID NO: 7317 - DNA, 620 bp, artificial
  synthetic oligonucleotide
caggttcccctcctatctctttatttttggtaatttatttgttgaagaaactggatggtttatttagtagagtttttgacatcctggattttgctgaaagctttcccatagtgtttaacatttttctctgtcctctttatttcctataaagtagtggttggctgttgatgcttattcaggttcaggttcttttttaatagcctcaattattgaacacttggatcaactcataaccaataattgaaaaaaggccctctaatgcatttaatcaattctactattgtaattactacccaacaactcattaatatacagaaacatggaaaaactatcatccacccattcttcatgcagcagtttgccactcttgaacaacagggctcatgtcactgaatctgagtagttacttttcacaccatcttgagtgaggggatgacttaagctcacatgcaatatataaatatttccttgcaataaagtaacaagttaaggcaaaacattttgcataatttactactaaacaccataaaaactgccttaacttaagctctttttcgccatatcaagcaggctaacagggcatcctaaggcacgttagagactctctcatcacagatgac

SEQ ID NO: 7318 - DNA, 3036 bp, artificial
  synthetic oligonucleotide
tccctgcagatgtctcgcaggctcctgtaaggaaggagtttttcccacgtgctctttggagttggactgggaaggcttagtgttaacttacctaccttagcctagtcacagcactaaagggcaagttggcctacttgagagtgaggcccctgagaagaacacaaaccaccctcaatacactttaaatactcttcccagggttttgtgctcaggagttgtttgaaaggcacaggcacctgggtggttttatggggtaataaaaagatgtggaatggaggtgggtgtggatcatttctgcccctctgttctgttcccaagaaaccctggagtacagtgattctgagacactgttaggccacctgtggtagacatgagtggcctttttccaattacttcctttccccctaatctcagatgatatgagggctgggttcacaaaagcatggtagaggcaaggcttaagacgagaggcccaatgggcttgagccagactgttggccagactggggctaaagactcgtcagcatggtcagactaggacactccggcatgtgattaaccatctacagttagggctggaagagttttagctggcatttgggcatgactttataaaatgaccttccacacacaactctaaaatcaggtctggggtctgaggccagccctaggtcagctcccactgaggtactttgcactggctgcctttttcttttgggagggacgactgtagcctttgaggtgggtcctcataggctttcagtagtgtgaagctttggtcaaatctgggtgcctagcactatatttaagcacatacatatctgctcaacgtcactcagctagtaagtagtagagtcagtgctggaaaccagatctgtctgacttcaaagctcaagctttaaaccattaccccaccatttctcagcctccagcctctcaaataccaccttcatgatttttgccatatcgtgtactgcctacactattattttgtaaaattttttaatttttaatttttatagggacatagtaggtatatatacttatgggggacataagatgttttgatacaggcatgcaatgtgaaataagcgcatcatggagaatgggatatccatcccctcaggcacttatcctatgtgttacaaacaatacaattatactctttaagttattttaaaatgtacaattaagttattattgactatagtcaccccgtggtgctatcaaatactaggttttattcattctttctaactatttttttgtacccattaacaatctccacctccctcccttaggttcccactctccttcccatcctctggtaaccattctattctctatgtctgtgagttcaatagttttgatttttagatcccacaaataagtgagaacatgtgatgtttgtctttctgtgcctgtcttatttcacttgacataatactctccagttccatccatgtttttgcaaatgacaggatctcattctttgttttggctgaatagtactgcattgtgtctacactattatttccttaatatttttgaatcaacttttaaactttcattaaaaggaaaatctatgtcactgccataaactgaaatccagtatcaagtaccctaaatggaagaaaattatactaatatacctataactgcttattataaatgttcatctgggtatgactgataatcatctcatatctcgctggtggtttgcctaccacactttggaaaataccgcactattctaagcagcaggattataataggccttgaaggctactctggactaaatgtttgtgtctcctccctgccctcccaatatggtttggcactgtgtcccaacccaaatatcatgttaagttataatttccagtgttgggggagggatctggtaggaggcgatgggatcatgggggcggatttctcccttgctgttatcatgatagtgagtgagctctcatgagatcggatagtttaaaagtgtgtggcacttctcccttctctctctctctctctctctctttttctctctctctctctcctgccaccatgtgaagatgtgcctgcttccccatcacccttctgccataattgtaagtttcctgaaggctccccagccatgcttcctctatagcctgtggaacggtgagtcaattaaatatcttttcttcataaattacccagtctcaggtagtcctttatagcagcgtgagaattgactaatataacacccccccgccacttgcatacattggagccctaatctccaatgtgatggtgtcttattctgttttctgtggctacagcagaatacctgaggctgggtaatttataaagcaaataaatttatttagctcacagttctgatggcggggaggtccaaggttgggcagttgcatctggttggcttctggtgagggctttatcaaaacatgtcagagaatagaaggggaagtcagtacatgcaaaaagggcaaaacacaacaggcaagctaagaatgaatccatttccccaagaactaacccagtctcatgagaaagacattaatccatcttaatgaactaatcacctcttaaaggcaccacctcccaatgctgccacgttggaaaccaatccttaatatgagttttggtggggacaaacaatatttaaagcattgcagatgggatttggaagtgtggcttttaggaggtaattatgccatgaaagtagagccctcataaatgggattagtgtccttttaagtgacacaaagagatgatctctccctccaccatgtgagggcacagcaagaaggcagccatctgcaaaccaggaaaagaaccctcaccaagaacctcgatcttggattttctagtctccagaagtgtgagcaataagtgtctacggtttaagccacccaatctatggtatttttgttatagcagcccaaagtgaccaaaacaaaggccatctaatgaaccttcctccccttttcaatttcaaaatagcctgtgcaatcttttaattaatatcctcttgcctga

SEQ ID NO: 7319 - DNA, 294 bp, artificial
  synthetic oligonucleotide
cttattaatgactttaatttattgtctagattcctagaagattctttattcttgaaattcagttgctttactaagatatattttagtgttaataattctgtatcaacttttatagggttgtggtatgttttttttcaatctgtgcatttatttttcttttttgtttgtttctgggaagatttaaatactttctagcccatgttttgttgtattctttatgtttctcaattatgtttacattggatctcctttgtctatttgtctatcctttttatctattgtgttattttaaat

SEQ ID NO: 7320 - DNA, 1392 bp, artificial
  synthetic oligonucleotide
tagaaaggaatcacaattctttaactgcaagcaagaggagtccgaacactatttgaaaattttctgttaggttgatgcaaaagtaattgtggtttttaccattgaaagtaatagcaaaaaccacaattacttttgcaccaacctaataatatagaaacgtggaaattctcatggtactttcactgtcgcgtgatgtacacctgaggagattttgggaagaacgctttgaatctctcaccacatctgtgaatttcaaagtgtatgtggaaaatggtaagattgtctagggagcagaaaggcaggtatttctccatgagcactaagctgtcttatccatttttcagtcactcattttctaaaaatgaatctgacatttttttctttttacaggatggaatgagaactcatttaggttaaattttcagctataaaatccacttttaatctgtcacttgattactcgtatctcagccaagagagaaaggtctcaaaaacaaaaatgatattccagtatgtattaatcaattggatggaactactttatgccttgaatgcaaaattttaaaatgtatcatttaaggatcaatacagtttctaagtaactaaagctaaatcagtaccagctcggcacttcactttggtaacagatcattagattctagtgtttctgaacccgtaactacaaatacatactgcccagaaacagttttcagaggaaaattgttcccatttgcctttttagatgttgatttatttgtgcattccatgtatagtctaacctttttataatgttactgtagaggtaaggcaaattctcttagaagaactgtattagacttattttgtggggtttctaagtctcaaagggcttaatttgacctatgtatgtccaaaatcatgtaataacaagttcagctgtattgtgtattattgatttctgcttactcactgtagttttattgcacagtgggcttagggaattaatgagttttatgttaaatgcttaaggacaaaacgataaatttcaattctgcatttcagaattgaagaaaaccccaagtgtatatggtttaacctcttatgtgagggtttgaattagttccttttacggaattcctggcaaggccattcaatcttagattggattaaataaatcatagaatttagagggaaggaggttgaattggtcagattccttgcaggagacagataagactctgaggacaaatttgaggagagtttaataaaggggctatatacaaaggtatggggagggatttgggatactaagaagagatagtgatccactctcaataatatggaactattatcttttttaagcctgaagagcaaagagagaagcagtttctggaactccaagagttcctgata

SEQ ID NO: 7321 - DNA, 974 bp, artificial
  synthetic oligonucleotide
gtgctgcacaactcaaggggtattctattcatattgggtgtatgcagtgaataacctgtgcaaacacatgggtggtcatggggaagttccttatcttgtctaggttttagtttccttttcccgaaaaatgaaatgttcgaattaatttgtcaccaggcctctaccagctaagggtctagtgtaaatatatggataatttaaaaagaattcttacttgctttggagagttttacacatatatttgaatttgtgcttatctgatgaaataagtacctagagcaaatcaattaaggacatgacactagggagatctggagctcgatgattagagagttgcctcatgcacttctgctcaggttctcagtatattgaagaaacagtccatatctaccactgattctagaacagcaaaagcagacatcactttttcagacatcccctggagttagggatatggctaactgaataggtccaaaatgctttctttgccaggatgtgaactgcataaaaattaactgcatacagcgccatagattcaaaagcagtcattcaagtaaattaggtgttgcctataggaacccatttcaatgaagcaattaattaagcaaaaattgtatgtgctatccatcaacaagcttaaaggcacgatttaattgttaatattgtggatgtacagatctgcacagaaaattggatttaggtatgaggatgtttctatcatgatactgtattagcagtcaacattgttcctcttagatgttttgcctggttttagttaaatgatgctttctatagtcaggcttaactgaaaaatagattagcatgttctattcaattgtattccacatccagatagaattcattactaagcagttgtactttagcattaaagacctatggttaaggtaaatttaaaaataagtattcttctgatccttcctcctcactaggcttctttcttactctttttagag

SEQ ID NO: 7322 - DNA, 739 bp, artificial
  synthetic oligonucleotide
tttaagtagttgtaaagaatgtaatttcagtgatagtataaacttctacattttaaaataaaacattcattttcctcttttaaatgtttccaatggaatctaaatactgtattgatttgattcctatatcatttattttaaaattacataaattagttcaaaatatattaacgattgtaaagtttacatcattactttttctcctttagctcatttttccattctacttttcctagggtattttatcttaatatgatttaattcttaaaaactaaattggtaatctaattatattactttggtaaagtatgtgtgtatatatatatatttagatatatgttatatctaaaaatatatatattatatatatgtattatatatatttatataatatatatttatatatagatatatattagatgtatattatatatagagagagatttttagaatcctctatgtctataaagctctaagtgttgaatttttttcttctggaatgaattattacaaattattaatacataatttatcaaatcataagcattaatattctggcaaattaaaatataaaatgttattggaaatgtatctcaataaaatgatagctgtttttcagtagtttaatattctagatgaattccattttttgtaagaatgagacagattttatcatcaattttcaaacattttattttatttttaaaatacgtaagcataggaaaaacttgttatcata

SEQ ID NO: 7323 - DNA, 1381 bp, artificial
  synthetic oligonucleotide
atttttttttctgtaaatattcattagcaatgagtggccctatatttgtagaagacttgaaatgaagctgaagcaattgaaacatgggtcctgtttgctagatggaattatttccagttgcagagggatgatgttatttctgtttgtctaatgtctttattaatgactttgaaaagtagttaaatgacatgttaattaaatttgaggtgatagtaaaggagaaagcgttgtgaatatcattgagattccaaacaataacctctttgggagaggttaaggatataagcaaactagaaagccagatttaacctatcaagtaaaagcaatcatgcagggaaaatgatcaaaaatagatattttagtctaaggagagtactgactggaaatcagccgtgctgtgagcatttggcagtcactagaatagaattaggctaaataaaattctcaagcaatgagaagattcacactgaatttttaacttatttccaaaaaaaatgcattttactttgaagtgttgttctaaatgttggtgtagcccacaaacaaaggaccataggctttagggatagatcttatgatcagaaaaatgtccatatctgctgctgaggtaaaaaaaaaaaaatctctacagcatggatgaaattagttgtgtaaagaaaacttgatgagcaataccacatcttagagagtgttttggaaaaaggtaaatgattaatctgcattttaaagttagtgtttccacttacttcagaaccacctggagtgctttttaaaatgcagatttctgggctctagcacagaccaactgaagcagaatccctggatgcaggcacatgtaatctgcattttaaaggaaggttgttttctttctttttacataataactttgggaaccattgcttagtgttatctgtacgaaattccactaaaatatgatgaatggaaaataacatacaaaatgggaactctatcatactatggaaagcttttgtaatgacttggaatactatggcaccgattattaggagttaaccaacaccacacaaaggagaagcataaaatcatcaagattatttgtgtacagcctcacaaattggatagtacacaactccatggtgaattattcacatagattaccgtgtggatggcaccccctagagtttgcagtgcagatcttaaatcagtacatacagatgttcccagttagtactagcataattatattttggagcagggtagttcattaatctctatcacactcaaaatgaaaagatttatgttttccatggttcgattcaccagacattacaaatttggcattcaagatgccttgatgttgagataaggaagttactagaaataagaatataccctattttaa

SEQ ID NO: 7324 - DNA, 452 bp, artificial
  synthetic oligonucleotide
tactgtcatattcttcattatacagatcaggtaacaaatttgggaaatttcataactttcccaagttcacataaactagtaaatggtgaagccaggatttgaactcaggtgttctgacatctaagtgtttgactacttttataggctctccttctttatgccatatcacttcaaactcagcatatctaaaattaagtttctaaacccctatccctaatcctaagcaaaactctttactttctacatttctttaatgaaatcaccattttctcaagtctcaatggtaccatctttaagcatggataatggaaactaaggagttttcagggttttgatttaccaatgcatgagaatgttcatccaaaaacacatgaaaaacctcttttaatgcagaatgtatttactttaatataatatgtactcaggtctatgaacatgcattaataattctt

SEQ ID NO: 7325 - DNA, 318 bp, artificial
  synthetic oligonucleotide
atatatgttttttctgtaaagactggggggcttatgagagtaagagttatattttgtttatttgtttattagaaggtcaaatatcactgtgtttacatctccagttaaagtctattacatccacttttattgcatgcatgctactggatgcgatggccagagagtggaagtcggatttgtatgaaggagaaggaacaatatctggtaattggttgaagactgggcactgataaaggagcagcagtaagatgcatagtggaaaagaagattcagcagaatctatgaatcagagccacagaaaattagcaaaaacttaaa

SEQ ID NO: 7326 - DNA, 217 bp, artificial
  synthetic oligonucleotide
taatcaaacacaggaaaatacatgtttctgtgtgttttttgtttgtttttgttacataaagtatagttcctctggcattgcttggggagaaggggatgtcatttctggggataaagctagaagaataatttttcttttgctccccttacccactcaaaataataaaattttgtttggaggccttggatttaaacacttccctgatgattgctatttt

SEQ ID NO: 7327 - DNA, 277 bp, artificial
  synthetic oligonucleotide
gactgaaatattatcaagcatattttccaacagcaatggcattaagctagaaatcagtaacaggaagaaaatttaaaaatttcacacatatgtggaaatgaagcaacacactcttgaacaaccaatcagtcaaagaaggaagaaaaagagaaatcaaaaaacatcttcagataaatgaaaattgaaacatgagataccaaaacattcagaatgcagtgaaagcaattataagagcaacattaacaatgatggacacttaaatggagaagtaaaatct

SEQ ID NO: 7328 - DNA, 191 bp, artificial
  synthetic oligonucleotide
agatggagatgggagtgtggagatttaagatatgtaatagactagtgatgaggttatacattggtacaatatttatgaaatttaattataaaataactgaaaagttttaaaaatttggtatattccttaatacagacaatccacacctaggaaagtgtcctactggaaatatagatgtaggtataaacata

SEQ ID NO: 7329 - DNA, 589 bp, artificial
  synthetic oligonucleotide
aaaatgcctagtgactaattttttgaaaaagcttgttttcagaactctaggtaatatgccgctaaatttcatgatgctttctatgtatgctttactcttaagcttactcactgagttgtagttaatttgaaaagatgctctggacaaagtgtgtgtgaatctgggttcttaaggcagagatcaatgatgctttgtttagattcgctatttcctgacttcctcctcactgatcaaagatgaatagacatgacagtgcttcttgtaatgcattcaaattttatctgttaatactcttaatatgtaaaaaaatcaaaggttttttgtcttcttcctataaatgaatgacatgtctttaattattaattaattaagtccttacaataaggaactcttcagatgtgatggcattttttttcccacaacaatccataaaacaccatgctatggtttctctcttatatacaaaatacaattagaaaaattgagacattttacagacaattgttaatctccacatattatggtttaattcctttttctgattatgccaaatcagagcattttagaatccagggacagatataccatg

SEQ ID NO: 7330 - DNA, 326 bp, artificial
  synthetic oligonucleotide
ttgatcaattagataccagtgatccggctcctaggatattcatgggtttttgcttaatttatcctcaccctgtaaacagacatttgccatcaaggaggacaagggttagggagatagcgagaggaggcacagaccctgtaaatggaggtagtgcaaatcattccgattaccaaatgattccagacctctttatttctctgtcaaataaggggaacaatctagacatccaagtcagccatactttgggaaatgatgcctaagtacagtaggaaagcagaagaatcagcctcagcatttggagtaaaacaaagtttaaaaagaagccc

SEQ ID NO: 7331 - DNA, 533 bp, artificial
  synthetic oligonucleotide
aaaaatagacattaacctgataaaatgatgatctctaaggagtgagatgacagaagtgacttatagtttctattttatacccttctctttttttagtacctggtttgtattacttttataatttaaaattataattactttttcatgtaaattattttaacaaaaagcaacccattttatcttttggccccaaattctacttttaaggaaatcattccacagaaattattagacatgcacaagcgatataccagataatttttgtaaattttataatacacatataaacaacctaaatattaaacattaggggaataattaaatatattgtggtatataaacatggtggagtaatataattatttttaaaaatatatttcaaaaataatcatgaaagtgtttactatatgattgtaagaataaaaaggatagctcaatgatgccatgtagtgccaagttaatggaaaaaggctgtgcaatgtaatccaagttgagaaggggacaaattgtaataataaggtcatggttatgct

SEQ ID NO: 7332 - DNA, 734 bp, artificial
  synthetic oligonucleotide
agaaaggaactgtgagtagcaatagcatcctagacacaccgtaatttaaatctcctttcccaaagacagtttctccctgaggctgggaaaaaatgaagatggtggcatggatagcaatcaagtcactgtagccttatgacccctttcaaaataaagcaaagtggaatggggaagaaggagattcaggggagaaaatatttgtggtctttgactatatgagtctgaaataacttaatctggctacctaaacatatgtctagttcctcccttgaatattcaataggtacttgaaacctcagtgtctaaagtggatgccaccataaggggtcaactgaatatataggtgtggtgttgctccagatgttagtgatacctgattttctgccaggagaaaccagcagaactttaagaattcacctagctacaaaaagcacagtttctttcaatgtagtttacagcaaataatttatttaacctcacagttggagataaccattttatctatacagcacgtgtagtagttgatttgcctgaaccttcctaagctccttctcagagcttgttctcacagtccctgatgaggctgattgctctcccaaccaccataattgattaaacctagcatggaaaattgaccaataaccaattgacaaataacaggttcaagaccaagctgtgccttttatttgctgtatgacattgagcaagctgcttaagcttctctgaacttcact

SEQ ID NO: 7333 - DNA, 1861 bp, artificial
  synthetic oligonucleotide
ataaggaaaaaatagaattttaactgaccaaggaagtcaagatagactctataaaagaaaatgtaagctcttcaaagaaagggaccaagtcttaattatctttgtctcccttgacatacgctagagactcagtaaagaaaccccctacctagagattttcgatagatccatttggatgttttatttaaaatctcctcaaaggctgaaaatgtctgctctgagtcttcaatttaacagcttcatttatacctatcttttcacctttttttttgttttttggaaatttcttcctccctcttgtcctctctcactgcaaatcttttgatttctttcacagaagcgtattgagcacggcaccctttcagtaatgttccgtttttcttcttgtttttaaatcaaccatatgtccccccaacctccaccctcattaagaagtgaagctctgatgattctggctttctcctttaacagaagagttctgttataaagaagagaaacctcacttatagactcagggttagcctaagaaatggagaccctttatgctgctatttacttgatgcaatattttaaaatggaatatgtgtgtgctctctccaaaattttaccaggcaaaagccccagtatggaatgcctttacattaatcagctttcccggcagcataatgatgctggaaattcggaaagcaatggaggattcttagtcggatttaataggctcgggcactttgctaacacactgcagtggatcaattgaagttaattattatacaagattaaaccccaagtaactacagtacatcaaaccaatgcaaaaagctctggctaggaagaagaaaaaacaatcatgaattctggaggtaagacttttctatgcagtccttaactcactatattgcgtagctgcatataaacatattggactaatacaatatgaaatccacatattaaatactgaaagtgagatataaacttcacttactgtctccatggtatacttaacctggggacctgaagaaatagctgtgaattttcttaacatttccatttatttttagagagttgatttgtcttccactgcttgccaggatttacatttccacccaccagggactcaacgttttatgatcattgaccattctaagaaaaataagtatctgagtaagtcacagaagcaaataaatggggtttcacatttattcactgcctgagtcacttcaagagaacatggctaaacctagaatgggtgcttcataagtaactgttggtaatttgaaggtgtatgctttaagttctttaggaaccaaactgggaaagacaaaggaacacactagaaagtagaaaacaatgacaaaccatatgtatgctaatttgttgtcattaggtgatagtgatgtaccttttgggtaagattatgtttttaaaatatcaaccatttcttcccaagagtttatttttctccttatccttaccttcattgaacagctaaacaattctctgctcattttgctttggcagacagcaaacaacagaaacagcataaagcagtggggagcaaaaggcttctcatcttggcatttaagtttcaaaagcctagcaaagggctcacaacacagacaaataatatttgtgagaaagcaaagattactccaactattcctccacaagaacagaaaaagatttcccaggatgagagaactaaggaaagttggagaggaaataatgagaatataaatgtcaaatgatcccagagaagggtccagaaacaaaagttacataggtttttggtttccaagagatagagaatttgggcctcatttttaagtaaatcccttgggaaacaataagatacaccagagaa

SEQ ID NO: 7334 - DNA, 2512 bp, artificial
  synthetic oligonucleotide
gaggtcatcagtcaggggcctaggctgctaagtccagaggcaacaccaagggatcaatgcagctaggtacagttttctccagcctcaactttcaatccccacccccagaccagctcattcccacacctccctcctccttggtcagtgagcctgagcgtccttttcattaaccttttagttactacctctacgcacatactttttcctatgccctccaaagaagtcagccccatactgcccatcactgctcagcaccgcccaccccatgcccccgcaagccggcctcagcactagtttaaggggagggacacgcctcccaaagctgcggggatgggggtgggggttgctcactcgccctcggatctctgctgtaaaagcggagcggcagagaccgggcatgcgcagcatcttcgggcgcattgtgatgggaactgcttctctgagtctctacaaagactccggagtaaccactaatggccctcctaaggccccccttctttaagacagacacacaaacacagaggcaatgcagctatttttttttaaagggtgggaggacgttgcagcttgaaaggttgatccacgttaggagtggtgtatttctattgatcccatctccggtgttgacaaacgccagcgcctaggctttgcagtccggggctgcagtttgcagtagagctaagcggtgtgcggctttaattccacgtcagatcaactttgatcaatatccccctactggcccaattggaagagcccaattcaccggcactgagccttttcgctctttcctttttttccccccctctttagacctaccatcttttgcgggggggggggggcgcggagagagtctcagattgtcttgataatttattctttcgttctctttcttttgcttctctatttttgtttttcagtgttttgcttgttttgttctgttttaggattttattctctctctctctctctctctctctctctctctctctctctatcatagggacagaaatcgctttggcaaacccagcttgcagccaatgaacccgccttccagattggtgtgaagacagaagtgaggtggggggaagggagggggtgtgagagatcctgggagcgagagggagagagagggagcaagaaaggaagagagagcgagcgagagagagcgagcgaataagagagagagtaagagggagagagaagaagaggaagaagaggaggcggcggcagcggaggaggaggaggactagtgtggggtggaaaggaagagtgagcgagagcaagttaaggggagggggtgtaagagccagcgaattctttttctttttctattattattttgacgactcctgagttgcgcccatgctcttgtcagcttcgttttaggcgtacatggccaggcagaagaaaatggggcaaagcgtgctccgggcggtcttctttttagtcctggggcttttgggtcattctcacggaggattccccaacaccatcagcataggtaagcgcaagcgagccagccgtcggtccaggctctccctcacccgagaccactgccccggcaaggctttccctgcggtgggtccctgtcctgcgtggcctgggaactgggactggggccgggaccgggcagagatggtgcggggcggggggcggggcggggggaatctgagcctcaacgaggtggctggtctgaagagcctctgggacaagagaggggtctcctggggctagtgggggtgaactgctaggttttccgagccgagaggagcaccggaggcgagcaggaggctgggatgctgcaagggggtgaagagtcgaggcttttcggctcgctgctctggactttgccatggcgtgcgtgcagctcctggaagttgtcccagggtgatgccgactgtctggccgcgccagggcgcataacccgggcccggggtgctcagtccgtggtctccggctgtcgggagacaggctggtgctgggggaggtggagcccactttggatctcccagacccgggcagcagcaggcgttggtggtggatggggtaggaggcgggggtgagactaggagctgagcgggcaagcggcgaagtcacgcagaccacgaattcatgaattgccgctgtgtctgtctggagcccggctcctgggcgcctggagggagttatcttggcttctgtcgtatttacaagtctagaagttagaatttttgccattactgaaccaaccccctgtattgtcacgggggagggtggctatggggaacgggttggggtagcagggggaacaatattgtttttcttcccaacctttcccttcacacaatgaaaagatgaccagctgtgcggatgggcggggggcggagggggggggcgactaaaaaaaaagaaggctgccgactaagaaagaaccaagtctcactcttggttccatcgtcctaacccaaaacggctccctcgtctcttctcccttctctctagcctcttcttttcagtctagaaaagccaggtt

SEQ ID NO: 7335 - DNA, 2081 bp, artificial
  synthetic oligonucleotide
aaatcaagttttgactttattcctttggctttgttactttgggtcttattagataaaatatccacaggagggtgcaattaaaaccccaggtgggggtgataggtattcttcagcagcactgtgggagttgtgcagacacaaaaggaattccctccatcttgggagctgctcagaaactgtctgggctccagatacagagctatagatagcctcagcccgtgtgtgggatgagccttgagctaaggcagcagcccccaaaaagggtcagtccttgacaaaggttaacatggatagaaattgtcttcctcatatttctacctcttctattgccattattttcttctcttgctctatccgtccagctcgtctaactcccttttgctggtctctgcctactcactgaccagcccctgattctagcatcccatccacactaaacttacctagggactattttctaccccggacttttccagacctaattcccagaacttctccttctccaccagaatacctttactcttggtccatgctccaaggatgtagagtgcagtacggcctgcactctactttgggggtgacagctttatatctaatataggtatatatttcatatatatgaaaatgtcagataaatggtaaagggttaatatatgtaacggggagtatctgcttcaaaactagggactatgggaaacatactgcctcaatttcaaggaaagatacttaaataggagtgtttctggatattactctcagagtggctgttcactctacccaaactaaaggtcagctggctttggtcatagaagacttttacaggccaaagtacaagtctaactgcccatagtaggttgggtgtaagtacacccgaggcataggcaggttcaacttcatgttgaatctaaaagcctttgcgggtaatttgggaagctgcaggttcaacttcttcatattgaatctaaatgcctttgggggtgatttgagaagctgctaaagttcataggtatttattttattaaagaggctggtgtggagactgaacctgcctatgtgggcactgtcaggagatgtactggcacaaaaggaaggttataggagaggataagggtgggagagaagctatctctccagctgtaagtttcctttccctgggatggtatgtggaatgccacgtttaagaggtaacatccctctcaccgtcactaaatagtatctctggaggtatttggaagtgtagttaagcagtatctcctcctccctccatccttcccttaccttgtctcaaacatacactctggcctccctcccagtggaaataaccagcatattctcttctggatttccaattgctcattggtcacagaagtgtttacatcccatgctctatctggacctccctgttcctcaattcccaaccgtcactggcttcttaagcaattatcctcaacacaaccatcatttgtccttatttggagggtgcaggggagcaaggataagaataaggagaggaaacacagctgataatgatccctcaaccctatgaggcgcaattcagggtagaacagcacttgttaatttttcatgtgcacaccaatcacctaggaatcttgttaaaacaaagattctgattcactaggtctgtgatggtgcccaagaatttgcatttttagcaagctgccaggtgatgccaatgcttctggtcctggaaccacactttgagtaagaagagcccagagcaaggagactgtgatcattaaaggaaaaggctctcgcagaccagctcttatccatctttgtatcttcttgccctccaaagaaggttctgtaagagacacatttggctcgttcttactcaagtatgtatctgtcacattcccaacaagtccgtgtccatttcagccaggtctgtaggtggcattactagatatctgatgatagcatttagagttgttttattgtagggatgtggagtggggactgaaaggcaggttcagcgaggaagtagctcatgagcccgggtgacactgtcttggcttcttgccataccccaaagtgccccttttagaaacaacctgccc

SEQ ID NO: 7336 - DNA, 983 bp, artificial
  synthetic oligonucleotide
caaggctcaacttttaagttgtggcaaattatttggagtctcagggcccccatgttttgataactataatggcgtatttgcaatttatcaggggcattctggaaactgcacaagccaatgagagaactaattctggtgggtggcatttaattttgcagtaaccccgcagatcacactacttagatgagtgctactttgaccacctcatggaaccagtgcagcctgtgggcatcctgcagggaggctgacagaaagggaagttccaaaaggtgaccccatgatgtggctcatccattcatagtgctgaacaatattttacctttcctgttcaaggcgttacaggtgaactgtaagatgagaacaagatcacaagtcagcactacctcctcccttcttgagttctcaactgagtgagcatcatggagggagaagaaagaaagaagttcagcctgggtgtgtgaagctgtaaagttgcaggttgaacccaaacccattttagagacagaagaaactaccctctggagataaaataaaaagatgaagctgagatgggacaggatcaaagttgatgaaatatcaagagaggttaataaaggaacattaatttattcctcaaatcctgtgttcagttgtgtgggtgtatttttgggagttgaggggaaaatggaaatagatatgataaagaattaacttttcttaatgcacttccagttgattattattatgaatgtcagctttgacctggaaatcccatagctcatcttacacaggttgcctaaagataatttctcttcttaggcttttctgagtaagaagccctcagtctttggtggaaaaacctcagtaattaattggaaacatgcatgaacataaaatggcttaagagtttagtggatcaggtaaggaagtcaagagatggagatgatccctaaaggtgtgtaccaggtccagtgtaagggagggtgagagagatggtgacttgc

SEQ ID NO: 7337 - DNA, 2115 bp, artificial
  synthetic oligonucleotide
tgtttccttggagttaaaactttaatcatgaaagctaatcccagtgtcggtgccaagagtaacttcctgtacacagagcttttatcctatggaacacagggttacagcattccgatcacttttagcttttagagcagagaatgggaacaggttgaagcgattctccagaattcttttcaggccaaataaagggaaaaaatagacacaaaatgcaaaatcgtccaaacttatccatatgcagcagggcagctttctctaagacaatgagttaactcttccatcccattagatctccctctgagtacaagaagtcagtccctctagcctcagtggcctgaaagctttaatagcctacccaaacagaaacaccccatcagcatttctcattggaatcccttggaatcattgttaaaaattgcagttcccaagcccaagccttgaaagcaggacttaggaatctgcattttaataagtatcccagatcacttatatgcacagtaaagtgtgagaatcactacacaaagcaatgaaagtctcaagccttgtgttctgaatttaggatgctcagacacagataagctgaatttattttcaaggaaggaaagtctcctttaatttaattaatattaacaacctacttaacataagcttttaaggttttcagaagcagtaaccggcaaacagatttaaggtctgttcacatcctttgtatctatccattatagcaggacataggatctgcaacacgaccatatgtagatctcagcaaccctctcttagcctttaaagttccctatataaagttcaatgttcatctaagaacattccataacccagactttaccctaaataagactgatcttacataaatttatccctaaataatgaaattgaactatatttcccttctcacagttgaaatcagtctaaagcagggaatagtagtctccataataaatagcaattagttgagtgtttactgtataccaggccctattacaaaacaaaatactccctggattaaaagggcccacaagatgattttgcctactgtaaactcctcttgaacattcataatgcacatgaacctattaaggactgcaagagggccttgaaggaaagaaatcaatttatttttcttaactcagttacaaaaacctatctgatagcataccccttttatgaagaaaacctgacatacactttgagaatgtgctgctacgcaacagtgtttctctaagtgtcagtggcatcaaaatgcaaagtcaggagccctacctcagacctaaagaaaccaactctgtgaggggcttcaggaatctgcattcttaggtacactgctctaaggtataccaggagaatcagcagttgccccaaagatgacagttgagggaaattgttatagctacactggcaaggctgactgaaaattaaacaaaaaattccaaaatggaaactaccaagtgactatatttcaacaattgatagttcgccaatctaaaaaacttgggctttttatagggggagattcttgcccatacataactgggatccaagaacaatgcacagaacaagtcccactaaattgtccagcaaattctgctgccgcctcaaggtataataggaaaacataggtgggtagatatgctctcccacttgctaagctgtaggactttagcaaaaccactttacctctctgacttagttttctcatctataaaatgagaacaattatctctacctcagggagccactgtgagaactaaatgaggcagcacacacaaatcttctattataaatatgaagttcacaaactgttcgttccttttccccttctctccttcccctcctcccctagtacagtacagcactatgatgtcagcatcattagcgtggagaagacaggaaatgttgctgtcagttttagtgtagttactctcttctgagggtagtttcctttaatgaacccctatgtcgcaatactgaagtagccattcaattctgctaagtaggagtcaacacccactggggtacacagagatgaaaaggcaagtcctgccctcaagttgctcatatcatagtagtgaaaatacctagtgtgtcagaaaatgggaa

SEQ ID NO: 7338 - DNA, 1799 bp, artificial
  synthetic oligonucleotide
aactccccctcatcagagacctccctgagccagcaaagtcaaggctgtgagctcagggccttcagaaggtcactggagaggacagtgagtctgcaggatgagtcaggagaattgagaaagcccagccagtccccagagccaggcctctcgtaaggcagccaaggaaaaagctctgtaagaacctggaacaccctgataatggagaagagggtggaggaaagaagcaacagacagacaaactccctgtcctcagcatcagcaaaagaaggaagtagaccagctttatccttgacaagtccttatcccactttcaataccctctccaaattacctgagacacccacagaaatgccagccgaccaggcatttcctaccacccgcaggttacccctttccccaacaaactcacctttctcagagcttccccagtatttcatgtcttgtttcctcagcatttctctgccttgtcattttatcataactgatctgggccaatacaccaattcctgagttactgtggtccccagcagggtcacatattggcaagtaaacagttgcctcttagcaacagagtacttgtaccccaaagggtatgtgtggtgaaaggatttccaatgaaggggggacctcaggcagataaatcctgggggaccccacattcaatttcatgtgtactgttacctctctctctccttgttaaagtgtaagccagctcaacagatatctggccaaaagcctaaaaacaaattaggtcccagagtaccaagataccatcttttgtgggccccaagataaaagagcttcatctgaattatttccgacagattgcaaactgctcatttgtgatataatcgtttgggggaggggaagaaaaaacaggagttaagaaaactgtagaggaagaaaacttttaaagcaacacatagtatgacaaaaattgtgtgcttaaaagtttttgaaaccttacattgttccaaagatgctaaataagaaagtgtataacctgaaaggcctacccatggcatcagcttgtatgcctggcacctgggagaaagttgggaggtgggactttggtggaaggaagaaggtaatgattggcagttgaggctttttctgagatgactgaggataagacaagcagctggtattcaggttatccagcttattagaggctgtagacaccatttgacttgcgatgggtctgacttcctaacatactgttctgagttgcagctgtgttttcagaataaaaacatctagtcgagttttgagttctaaactatctaagaaagcatctaatgatgctgatttttttgttttgttttgttttttgttttttgtttttttgacacggagtctcgctctgtcgcccaggctggagtgcagtggcgcgatctcggctcactgcaagctccgcctcccaggttcacgccattctcctgcctcagcctcccgagtaaatgatgctgatttttaatggatattactgtctctttaatgagacttctctggagaaagaatactgtgacctcaaattacttgtgcaagtggacttagcaggcctggcaaatggaccaagcttgtctttgggttccttctccttcctacttcatagctctgtctctctacacccctatcattgggacccatttttttcctggtaatttagggctccccgtgactccatgctttctcccatcacaagaatctttcctatgagggctcagttgtctgctttccaaagtgacagctgggggctaatgagctaaagtggtagtggctgacagtgagttaaattc

SEQ ID NO: 7339 - DNA, 1910 bp, artificial
  synthetic oligonucleotide
gttctttaagagctaaggtatccatgggtaaatgtgttatgtcatagcaacaatatatcaggcaataaggcaagagggtgcaaatgacaaaatctcttctaaagacgaataactggatcgtaagctcaaatagcacatatgcattgagggccaggataattggtcctttatcttctctttataaaaacaaaggtttatttgccctttaaatggttcaataaaattaaattggtaccctgtagtgtgtgctgaatacataatcagaaattggaagcaataaaaaaaaagagggaaaaggcaaaagtaataaaatctaaaatttggaacagtgtacaaaaacaatgtaggaaaataatgcaattcccaataacacctcctcattgtgtagcagatcctgtaacaatcacttcttctcctgaaagccagagatcaccaactggatccacagtacctcaaaggcacaggctgcttgactttgtagtatcctcagaaaaggggaggggcagggcaggactgggtaagaaaggaagtgactctctatttactttgtccacttttggagggatacacaaaactttgaaagtaaatgtagtactcatgaaaaggaatgcttcgtggaactcaaaatgtcttttaaaatatattccctgtaatccttccaaagctgctcatgttaagatcttcagagaaaaagcacaataaaaacctcataatacataagcatacagcaatccaacctccagaaaaacgggagagttggtgcttggcaactgatgaacatgaaacacaatacattaaaaaaaacacattcttctttctgatttctaattttgatggccagacacagaaatatttgtttaatgagtgacagcacattgataatacttttctgtatgaactggatagatgaaagagaagggaaattgtgttattgttcaattattttttgcaccaaatatattcacatgctttactcagagaaaatattaatcatgcacacaagaattttgacttggaaatctcagaacactttatagaaatccattgtgtagagtgattccggtggccagatacattaaaaaaaaaaaatgaaaaagagggacacagaacgagtttcaaaaaataccttcattaaaatgtcttacagttgaagattcttagtgaaggtgaaactatctagaggtcatctctttgcctccaaccaggagtacattaagtcatcctgaataaattaagttcatctgctttccacacaggacgtttcttcagcctttccaggggcctctcttagttttctccgggctcaacagaccaaaagaccctttcataactaaagaaatacacgttttatttcctttatgtctctcccaggcacctgccaaaggactctgcacttcgtttaccctcaaatatcattgctgcctggctggcacttatgtttagtgccacccataccacaccaatctggagctgggactctttcttaaacacagatgaaaaccaacaagagaaagaaaagtagccaaagtaggagctttaagggtgaaagagagcaagacagtcatagagtcactgggtctgcagcattgctttgtggagcctaggccccatactgaagattaatcttaaccaacttcatcagtgattccatttaaaaggcaaagaggcaactaggtcccagttgtgcacagaaacaaaaatcacaagcaataaaataaaattaaatactcataattaactaattggtggtacagttggctgcttttccccccagagaaggcatcttctatatgaattttggagcacttaaccaagtacaacaactgtaattattattattcctataataatagggttcccacagatcttcgtatttttacatgttttatactcattatggctaatccaca

SEQ ID NO: 7340 - DNA, 1109 bp, artificial
  synthetic oligonucleotide
cctaaaaagcaccctcttagcccaacccatttcaacacctttcccgtcatctctgacattgctatggaaggatgatttacatttacatgtgcaaaatgaattttccaaaatacatgtgttcatatattaatgcctgcatttgctagcagttacattcaagtaggatcaaatgttgacaataagtgttttctttgccagcatttagatacatgccatgtaattgcaaaaataattagttagactttcagaaggcagtatgctcttgagagctgaacaaaatgttcaaaggaattaaccccaagatggtaattaaaccatgcaatcatcagctggagaatggggctgacacactgttctgactctgaaacctaaaaggacccactgtggttaccaggacacaagaccaaagggcactggggagggatcatgatttatatgaacccagggaaggtatgagctgactgctaccctatactcaccccaccatatccatcctctatctaatttcccctctcctacatccccaggctaaacacaaataactcattaaagggcaggatcaggaagatagctgcctgtatggtaggcttggaagagtccagaatatccaccctttttaagtttctactgctaaagtaactcctttggggttttctagatatgtatgcattttcattggattaaggttttgctctttgtaaggaggaattcataaggtaaacctttggttctcaatgtgggagatgagctatgttgccctcctgagggatatttgatgatgttctgaggcattttgggttgtcacaacaggtagtaggagtggtgcccatggcatttagagggtagaagtcagtgatgttgcaaaacatcttacaatgcacaggacagcccctggacaaagaattatccagaccaaaatgtcaatattgccaaggttgaaaaaccctgaactgacccacttacaaagattcatttattaatccattaacaattcatacacagagtaggttcttgcagaaataggagatgggatgagtatattttgattgatcagttgaaacagaaagaaggaacagtaattttatagcagtattcaatagtctgggaaa

SEQ ID NO: 7341 - DNA, 746 bp, artificial
  synthetic oligonucleotide
aaaaagtctgatttctcctaactgaccaccacttcccctttcctgcgtcttcatgtcccttgagaaaccttgtgagactggaagagacacaaggctcctccctccttcacccttacacatgaccaccctccacccccccaaccaagacatgtaaatccatttggactgagacatttctgaggttgctaaagtacccaccctagtccctgccaaattccacccagtgaggaaaacattcctttattttttaatgcactttttataatttttttatcttctctgttctaaaatgtttctctctcctgcttctttatgatatattctggagatatttcaaagccatttatacttcatactgatattggtgttttcactgttctgtgaaatgccatagtttatattgaaatgatgcattaagatataggagaaaaagagacattgagagaggaaaaaaatggtgaggaaaataaccgagagcaacattatgagaaagatgaacagacccaagggttggaactctccctcctatagcactaaaatattatcaattcattacttggcatgcacctcttctttctagggtggggaagactttggaagttaggggatgaaatgcaattctttcacctgctttaccagctatgggtctgcccgagtttttgctttttggtttattgtcaagttacagcaaatatatattttgtgtcttctgggctagtcactatataacttacagtttttcattg

SEQ ID NO: 7342 - DNA, 1005 bp, artificial
  synthetic oligonucleotide
ttccagcccttactctcaatgttccatgtagaacattaagctcacttaccaatccaaaagacagtttgggttagcattctttctttttggaatattttgtttgccatatagttgagtaaacacaagcttgggactcaaatagacatgatttctaattttagctccctgatttccttgttgtgtgacaacaggggaggtgacaatttctttggggctcatttttctcagcttaaaagactgttccactaccttcctttcgtggttgttgtgaggatcaaataagattctatgtggaaagcacttggtacagtgcttggcactcagtaggtactcagtaactgataaccatagctatttgctcatgagtggtgagtttctgtgttcatgaaaatcagttatttgagaactattgctgaagaacaatgtccttgtggcttccccaaggtatcagttcaatctaaggtcatatcatgagagcaaagtctgagagttgggctatgctcaggtctcactaatataagtttagcatgttagaaaacctctctggttttttttttcctgtgatataacactgggtaacacatattgattgataagctcaagaacaatttgaggattaactagatttttcagcatcacctaaaataattaaaggcactaaaaccttgaaccaatatgctaactgggcatttttaataacaaatatatatgtattgaatgcttactatgtttcagatattattttaagcaatgtatgtgtatatatgtgtatgcttatatatctcatatgagttaatcctcatattatccctgtaggtagatggaaatattatttccattttacaaatgaggaaattgagacttagaagtcatgcaaccaataattggtagagatggaacttgaaccagggaagttgacaccaggtactgttaatcactgctctgactggcctcgcatctgacagaattttccaatcagaatagattcaaccggaagtcatcaga

SEQ ID NO: 7343 - DNA, 1605 bp, artificial
  synthetic oligonucleotide
atagaaatgatggcttcagctcattgaagaccctaacacattaatagtaattagcaggatatagttatccagcaaaagtagcagcaattcctaggctgctacttgtcccagaagataataatgcccaatggagctggcagagctcacatggagatactcctttcacaaggcttaggtggcagaagcaccagatggtagccacagcaaattagaagaaagtggtggatactatgtagtagttgttaagattcatttattgtctgggtgcagtggctcatgcctgtaatcccagcactttgggaggccgaggcaggcagatcacttgaggtcaggagttcgagaccagccaggccaacatggtgaaaccccatctctaccaaaaatacaaaacttgggagggcatggtggcatgcgcctgtaatcccagctacttgggaggctgaggcacgagaatcgcttgaacccggggggtggtgtggaggttgcagtgagccgagatcacaccactgcactccagcctgggcgacacagcgagactctgcactccagcctgggtaacagagcgagattctatctcaaaaaaaaaagaaagattcatttatggatacatgtcagataccctgggatttgtaccatcatatacaaccaagctgtcagtttcactcattggcatttctgtaaatcacaaatttctaaagtactcatcactagaatctgaagcaatccactgtgtttatcatgttaggctgaagaaaagtttgctataacacccatcgggtcaaactttttcaacattttccaattacataaagcattgtatttgtacgcaatgaagaaagactaaaaatacaggtaaatgaaacaaatcaaaatatttgcttaaagttggcacctatgtttgtccatgtggcagccacattacataaagacacatgaactaaaatggaagaatgcatattttctccattatgcctgcagtttcagggacatagtgccctaacaattaatttcatattcaaggctgtcttgattgctaataaatgatcctagggaaggagctttcacattatccttagcactctaacagatatggtgagtaagaacatacaacttcccacaatcatgatcctttcaatgtctttccagggttttactgatattttactggaaagagtcatgcatgggggagccaacattacaggtttccagattgtcaacaatgaaaaccctatggttcagcagttcatacagcgctgggtgaggctggatgaaagggaattccctgaagccaagaatgcaccactaaaggtaatgttccatggcatgtaaaaaacctaaggccagcttttcaaagtatctcagtatgatctttatacactaacagtcatcttatgatcaagtgattttcctcagaagtgattcaaagatgccacaaaacaactgcaggtgatgctattgcatttgaaaactaaacccctgaataaagaagctgttgagaatgagatcttttaaaatccagtgcttggaaataagttaacttaatttttaatgaattttatttgtaatatgcctataacaatttacagtattacaagaacctgagcc

SEQ ID NO: 7344 - DNA, 2127 bp, artificial
  synthetic oligonucleotide
tgagggccactttcaggctcatagatggtaccttcttcctgtgttctcacatgatggaaagggtaaggggtccctcttgggcctcttttataaggacactataagttccatttatgagggcttcactcccatgacctaatcacctcccaaagccccacttcctaataccatcaccttgggggttaggatttcaacatatgacttggttgcgggggggggggggacgtggggacacaaatattcaaactgtaacagtgatacaataactttaacccagatctttgactctgaagtccatgctttttaaccattacactatctgcccaacagctaaagtgtggtttcaggcccatcccattctgaaagatagttgaaatttattagaaaggcttatggtgccttagtcattctggagagaagagtgtttggcaacaacagcatggcaagaaatttaaggcgtaagtgtctttttattttatttattatttatttatttttgagacagagtcttgctctgtcaaccaggctagagtgcagtggcatgatcttggctcactgcaacctctgcctcccaggttcaagcgattctcctgcctcaagttcctgagtagctgggactacaggcacctgccaccttgcccagctaatattaaaaatattttttagtagagatggggtttcaccatgttggccaggttggtctcaaactcctgacctcaagtgatctacctgcctcggcctcctaaagtgccgggattacaggtgtgagtcaccacgcccaggctaaggtgtaagtttctactagcccaggttatccgatgtgagctataccatgaactctaccaccccatcacaactgaatgaccatatttctcctgtcactctctgtaaatagatcactgctctcctggcattgaggaagacattacacacagtgacatagagcaaggcagacttattgacattgttcagacaaagaccaattttctcactggatttgttttctcctccagcatgttccctgtactgcactcatttaatctccacatatctcttcctcattccaatttgtctacttgtgagtgagggagcttgagtattagagtccctcatttgtttagcaacttagatgccttctctccacttctgaatagtaaaagtgttcccataggaaccttcccatcttttccctttagttctttctactaaagacaaaagcaatagccggggaggctcttacagaaatgtcctcctccttcccctgcctaaaacaactttctgatgctttctgggcttataacaggaggtgattccagagaactacagcaaaccaacccatcggagaagactgccaaattccattttcctctaaaacctgtggctatgaaaaatatacattcttatcatgcttggagtaaaagctctctgttaaagaggatgatctcatgagctaaatgtgtcttcatcttcatttagaagttttagtcttttggcattgggaagttttcaacttctctatcaatgacagaaatggagaaaaatgaaaacacaggctttcatttctggcaggcctggcctcttgtggtttgcaagttgctttaaaaaaagaagagcagaaaacccctaatgatttctctaagttcttaatgagcaaaaagatggagaacagggaaatatttcttgcagtgaacatgaaacctatacagataggcactgctttatcttaagggtatttctcttatgcttttagtatgtaaaacagagcagagtggaaagaatgaaaaaaatcagagatgaagaaagctctgcaagggagatttcagtgtcagtcataaagtttcaagaaagaatcaaaatgaattaaatttgctaaagaataaggaagccaatcagcctcttttcagatgatttataaataggtttttttctaaggaaattcaaatcaggttgatgttggggcaccttgtatctctaagaaggctatttttgaaacaaacctcagtaggacacaatgtgccccattatgtaagcccttcagaacatcatggacttgaaactgtccacctgcttttagcagttttgattttgagctggatgtctgtaacaccactacatggtaacagtccc

SEQ ID NO: 7345 - DNA, 532 bp, artificial
  synthetic oligonucleotide
tgtcaattggagcaccctcataccactactacacacttacccacctaggtttctgaaaataacttgcctactgctattaccagtgcaagcagaggcttgaggacaactggccactggagtgattcaggacaccccaagagaggcacttcattgttgagtcagaatttcacctactccctaaccccatccataattcttaccactctctctcccagcctacagctggctttcataagagcagagactaggaaaggaattccatttgaggacttacctttttcagtttttcatcagtgtgggcctcctcaatctttaagttgccttgaaagtgacctctccctttaccttcttgctatggcaatcccaggagagctcaatggttatttttggatgctagttagttacagggtggagcatataactaactagtgttcaaaatacctactgagctctcttgggactgccataacatgattgccccacataaattatgccaagcaggtcctatgctctgaaataaccaattatcaca

SEQ ID NO: 7346 - DNA, 573 bp, artificial
  synthetic oligonucleotide
ccctttggtcatcatctcccagtttccctctatgccagcccctgacaaccaccattctactctctgcttctgtgagtttgaataatatatattccacatataaatgagatcatacagtatttgtctctgtgtttggcttatttcacttagcatgatgtcctacaggtccatctatgttgtctcagatggcaggatttcctttctttctaaggctgcagagtatcacattttctctatccattcatccatcaatggataccatatcttggctattgtgaaaaatgctgacattaacatgagagtgcaggtactgctttgagatccagatttccattcctttggataaatacccaaaagtaggattgctgaatcatacggcagtactatttttaattttttgaggaacctccatactgttttccataatggctgtaccaattaacattcctgccaacagtttaccagagttcccttttctctacatcttcaccaacacttttttttttttgtaataagagccattctaacaggtataaggtgatattttattatggtttttatttacattttcct

SEQ ID NO: 7347 - DNA, 484 bp, artificial
  synthetic oligonucleotide
gtgcaggaggcattgctgacgatcttgaggttgttgtcatacttctcatggttcatgcccatcacaaacatgggggcatcagcagagggggcagagatgatgacccttttggctcccccctgcaaatgagccccagccttctacatggtggtgaagacgccagtggactccacgacgtactcagcaccagcatcgccccacttgattttagagggatcttgctcctgaaagatggtgatgggatttccatttgatgacaaatttcccgttctcagccttgatggtgccatggaatttgccatgggtggaatcatactggaacatgtagaccatgtagttgaggtcaatgaaggggtcattgatggcaacaatatccactttaacagagttaaacgcaaccctgctgaccaggcgcctaatacgaccaaatccgttgactccgaccttcaccttccccatggtgtctcatggatgcggctggcaa

SEQ ID NO: 7348 - DNA, 963 bp, artificial
  synthetic oligonucleotide
gttcttcctgatatctttcaggcaaataattttgaggtaagccatagttattttctcaaagtcaaaaatcactctaacaaaacatctatttttatgtcaggcacattataagcactcaacagtcactgaatatatcaccctcccataaatattctgctcatcgatttttgcaaattacaattacctgaaaagagacatcaagatttatacccttttgccaattcatttaaaatatgctcagtaattctcaattctttaaaaagttatatcctttttgtcattctctgaaaattttaatttgcataggtatcgtttccaaggaactgaagactaaatggaaaaatccaggcatgctaccaagtccactgtttactccaactacagaggtaatcaaacaggatattttcctattattggatgatatgtcactggaaaataatgtagcccatggaataagaactgagaagggctaggaaccttaatgaattatctttgctaagttattctgaataagcaacaatatacacaataatatacaaccatttgagaaaactattgtttatttagaaaaaaggttacactggtagaattcggcagataaaaaaattctcttttaaaaatgtcactgtgaaacttttccagatgaaagttcagcaatacaaagctcctacagctgtagaattaaaacaattatgttttgatccccccgccgccaagatttgtctaacataattacaagaaaaaatggcaagggacaagtgatcgctggtacctttttcttttttaaacacgtttaatgttgtacatgtactatataaaatgattcctaagcatttcataagacaatgctcccactgcttttagtgactaatattaagaacaagccaaataataaattaaaacagttttaaaatgaggtaaaatcaaaagggttcaacaattgtttattttcagtttcaaaca

SEQ ID NO: 7349 - DNA, 1343 bp, artificial
  synthetic oligonucleotide
cttacccaaattctatcacagtcaataatggtctcttaagttaggaaaataaataagtaccatatcaacctccttacatagccaagggctctgcagaacaaactcagtagctagatattctcagcaactcttaacaaataggcttctaaaagtctctaagcatcggtaataaaatgcataacatggcagttaccacagatagtaatttcatctttggaaaaataaaaatacttactctgaagccagcttgagatggttgtgtcatcatgtttcattctttccttttctggattagctaaagcttcaatgatacaatctttcatacattaagaaaaaactaagtcattacatctctaataaagacccttaaaacatgaatatgccacatcataggggcaaaattgttggtcattacaaattatttttctagttttccaagaccagggatgttgctaaaactaattattgaaaaatacacttactgtagtaccaacatttcttctttagcctactttccatctttcagcaatcaagacagattccatcaatatcaagatgtttggtaagccaactgggtgcagtggctcatgcctgtaatcccagcactttgggaggccaaggtgggtggatcacttgaggtcaggaattcaagatcaccctggccaacctagtgaaatcccacctctactaaaaacaaggaaattagccaggtgtggtagcacacgcctataatcccagctacttgggaagctgaggcaagagactcgcttgaacccaggaggcggaggttgcaatgagccgagacagtgccactgcattccagcctgggagacagagcaaaagtctgtctcacacacacaaaaaaaaaaagttggtaagcctaacatgtctccctttatacaacacaaagacacacacgtacacacacacacacacacacacactctctctctctctcacatacacacacacacacacacacacacacaattgactgaccaaacttcagatcagccacctgaatcaacctcagatggttactaaaggaaaatagaatgaaaataaaacgtttaccatatgatctattaaatatgaaatctacatattacttcacttgaaaggatacaggccaagacatcataattcagtgaagtgaggtatttcaatgaatctactacaggtgttattaagttatcatacttctgtatttgtgacaagatctggaaaacagcaacaaacaatagaaggcattaactgatcaaaggatttctactgtgccaactaagtaatggctacactttctatttttcaaaagaaataatgcttataattaaagtggtttc

SEQ ID NO: 7350 - DNA, 2094 bp, artificial
  synthetic oligonucleotide
aacaaaggtgattatagtaaatatagttttaattggattcctacacaaagcactagaggaaggagataaggattgggacaccttctccctctttcttagtcatatataaactccaaaaaaagagaaagaaccaagaagctgaggataagcacccctaagatacaactagtgaggcacaaaatatgactcctctggcaggtctcaagacccaggtactgcaaaatcttccctaagatagcacaacacctagtaaataataaaaaaactctttccacctcaggaaaatctggattaccctatttttctagtgctcattcatcttttttacagaagtcaactacttcttccaaatgctcaatgcaaataaaaagaaaacagtaatgctacaggaattctacttaaagggtagggagaataataactttcctatctgttacacttttacaacagctgttgcacttactttaaaaggctactataaagataaaataagtatcaaagtcccttgtaaagttattttgaaaatcaagttcaaaattacacatctgtagtttcaaaagttcactgaagatttactgtattaaagttttcatgtttgctttttggtcctccataaaatggttgagaaatacttaaaaatagaaatactagagaaacgtagggcactctatcagaacagtccatcctgttctttgtcatccattctcttttgaaagtgttggcttaccactcaggatcccctccacaaaaaagaaagactagacagagcaggacctaatattaacatacaaggtatagtgacaataagatttctcacaaatatcatgctaaattttataattattgataaaccattaaaagtaaaagctaaacacctctcccattccttaactgaaaaaaaaaatagatggaatgcactcattttgtctttatggatattctccaatagctaaaataacttgttatcttaacaacacatactatacagataaatgtcttacctattaaagatttgatattttctaagattaaatcactagtaatacttccagataaatcttgccccaattcagcaatcagcttggcataaccttcattctcttctcttaacaaattgaatttttgctgcttataactgaaatcagataaatatcattaaggggataaaattaattttaattaacaagcttgcacagagtactgtattctcactgaattttcttatctccaacctacaacaatcctaagaatagttgttgaaagtttacctctttgtgtaccttttagagtagaaaataacagtgattcatatgagaaccccaatattaattacatagggaaaaccagtaacacaagaaaaggatattgttaatatcagggaacaataacatatcaccatttccatctctaagaatataccctgagtatagccacagtcataaattattttattgctaatgatgaaagcatgagtattattttaactttgaatatgggcaaaagtaacaatggttttgcacaggtaaagatcactgatgactcaatattaggctacttttagaaggcaaaaaacacaagacatgctaaccacaaacaaaaaaaacaatcttcaaagtccccttagaagctactaggattcaaaatatgaacgaaaaaacatactcagatacttgatctgcaacataagatacgtgtacttacaagagttttgtcttgattttaactgacttttgattgaattgctgtgattgtttgataagccctaatgattccagtgtttctggatccaggcgttcctttagaactgtgtctgaaactaaatactgtattaaaaaatattaaaggtcatttattccttagcattgcatccacaatgttaaatatattcaaactaaagcttcctaaataagaatacaaaaataacattctctacataacaacctacaatttataaaaaggcttagaagttcaatttaacaaatattgactccaaatattgaaatatttaataaacggctttcaaaaaattcactataaaattatatgcatgttgtatactgcctataaatgacaagaactacagatgaaattttc

SEQ ID NO: 7351 - DNA, 3345 bp, artificial
  synthetic oligonucleotide
atgcaatcataaaactgactatactgatttggatctactataattcaatccacattccacaagtcatgcaataactacatacacgtaagttctaataacaggtttttttgctgttgtttttggtttgtttttgtttgggtttttgttttttttttttttttaaagagtttcgctcttgttacccatgctggagtgcaacagcgcgatctccgctcaccgcaacttccgcctcccagattcaagcgattctcccgcctcagcctcctgagtagctgggattacaggcatgtgccaccacgctcggcaaattttgtacttttagtagagatggggtttctccatgttggtcaggcttgtctggaactcctgacctcaggtgatccacccgcctcggcctcccaatttgctgggattacaggcgtgagccaccacgctcggcttctaataacagtttttaagcagctcttcaaacataagaactatgacagatagcatgtattatgtaaatatacataatgtgaacctaaaattccattttatctaagtatttcgatctcctacatcactttttctcaaaccattaccagtcagaagccaagcagaatttcaccttatagccctaataccactcatgctaaggtggcagcaataatagtaaaactgttgggaggccgaggtgggcggatcaccaggtcaggagatggagaccatcctggataacacggtgaaactccgtgtctagtaaaaatacaaaaaattagccgggcgtggtagcacgcgcctgtagtcccagctactcaggaggctgagacaggagaatcgcttgaacgtgggaggcggaggttacggtgagccgagatcgcgccactgcactccagcctgggcgacagagcgagactccgtctcaagggggaaaaaaaaaagtaaaactgtcaaaaaacagtagctgaaaggaggaagctgagcaatctacaaacataacagcccctaaataaatgagctggctttgaaagtaaacaaaacaatgaactgcttttatcagttttgggggattaccctaatatcgatgaagatgatggtctggctgggtaacttcccatcttgccttccccaaacttgatggctatttgtcaactagctatcaaacttgacagctatttgttaactagcacatacgaggatttgtaaaatgttcattatagttaaaaacgaagatttatcaaatagccttctctgacaattaataaaccaataagcattctaagcataggctgggggggcggggcatgtgttaaaccaaaagaaatatgagacatagtccctatatttcaaaggcctcccaattcattacagtgcaagaataaacacacatgaataagtcagagaccaattaattgctaacctgagtggtacagactttaagtgcatgagctgtcctgagaagtttaaatatctaaaggttggaataatattacttttaatagctatcacttgagcacttactataagccaagtgctttacaggcattatttagtcttcacaacaatcctttgagtagagtacttattattcccaatttactcaaggggaaacagtccaagtggttaaggaacttacccaaggtcactcagctacttaagtggctaagacagccgcttatttagggaattctagagctcacactgttaagacttcatacagcagtgcggggggtgcgggggaggaagccacataggctggcactattacaagcgcgggatccggcaacgcgttcctcgtgtttcgttccaagtaacgaagttacaaagatttgaatctttagcatgagccacggtaaactggctactagaaatggagaggggtgggcaaggacgacaaaaatggctaacgagggttaatttcatccagggttgagctttagcatctaaaagcgacccagagaaggaaatgagatgttattaatatttgttcttatatctgaggtttgctttgctgcttaaacgactccttccaggggaaggggaggagggagcgctctaacgtgggggcgagaagactaggggtatggcaaattactgttttcggtgttacgggggaaagtttcacgactaaaggaaacgcgttatcctaggtactggagaagcttggagagctgccagaattagttgcagtcccaggataaaatggggtttagggaacatttaatgacgaaagttgaatccaacccgaaatagctctaaggtgaaaagacggagcaaagaaatgtcggtggttcttcagggaaagcggcaatccctgccacacttccccacggcgctacgcgaggccgggacagtcgagagaccgctccccgggagggcgagaggtgccaaaccgggttcttcgcggcgccccgggcttcgcggcagcgggcgaagaggaggggaggggaatccgggacggttcgccctccttggacttcaggcagaggaggcgccaagctccaaactgcggagtccaacgggtgcagagtgaagaaatggcacagagagagatggaaagtccgaattgccccggctcagccccataaagataaaggagccaagtgagatcaagcgaagagggggacacaaaaagagaccaagagggagcgcggagacctgcaggggcggaataagagttctactaagaggctaaaggaagccgagctaccgcaggcagtagcgatttctgggaggccagggaaggaaggaggtccgcggcggtaaacagcacctctccccgagttcgaaactcctagacgaccatccacgcccgccgcccgggtgggggagggggtacatctttccccctcaacctcccactacaggtgagagtgcagctgacgccctggcccggcccggcagtgcgcctgcctccggcccgaacactcacaattcgcctctccctgatttctcccagttctttatccactctgcgggaaccaccacagccgcggccgccatcttcctctcactagtagcagaagcccggatgtgtagcacgcgagcgaagggtcaaaggggagcaccgcccacgaggaatgccgggagctgagagttcgtttttcgatttcccgccccactttcctctccacccagcggaaacccgaggcaaggcagccaacgacgtggagactcgcgggcccctttgcgaggttactacacgggttgcgccctccgaagtcttcggccttacttcccattagaacagagaaatgccatccacaggccaacaagtagacttcatcttcttccgtaatatctacccctaaccactaatacaaacacgcatttttcaagcacctaatatgtgctagacactgg

SEQ ID NO: 7352 - DNA, 2160 bp, artificial
  synthetic oligonucleotide
taagccactaagtctatggtagtttgttacagcagtcatgggaaacgaatgcaggggttctttgggaaaacttttgctttcctgagaacagcgctgtctctaactcttctttcttatttttgcctttaatgtggagctgtaaaagtcatctagtggcattgaggaaaaggccagaagaactgtgaagccatcagccctaacattgttgagctgctgaacaaatgctagcagccccggatctctagctttccagttttgtgagaaaataaacccagaaatccatatttaagccattgtaggtagatattctgttacagacaaaaacacctctgagtgataagaaggtaaaagtatgaggctatgagagaatataacagaaacttggactggtggttatgaataatgtgggtagtagaatttttcaattgttatttcttcttgttgttgttctattcactgattgattgctgctcaacatccaatccctctccctatttggggaagaatcacccagtatgtgcagctttgtagtactgaacctcctacttcaaaatctaaatgagaaaatcttccatctagctgctccatggcaaccagtgtacaggcactagctcacctcaaccagaaaaagggaacaaggctatttaaaaacaaatgtaataattccggccaggtgcggtggcttatgcctgtaatcccagcactgtgagaggctgaggcaggcagatcacctgaggtcaggagttggagaccagcctgaccaacatggcgaaactttgtctctgctaaaaatacaaaaaccagccaggcgtggtggagggtgcctgtagtcccagctactggggaggctgaggcaggggaatcccttgaacccgggaggtggaggttgcagggaaccgagattgtgccactgcactctagcctgggcaacagagcaagactctgtctcaaaaacaaaacaaaacaaaaaaaacttgttaattcccgctcaccatcccccctcataacagactctagatgttcctcccaatatcctctaagcactcaatgtttctgtatgggccactggtttcttaactgcaagcacctgtgactctctgcctaagggctttctgaccacaggagtgtgcttagccagtatacaaggcaggccagaagtgccagggagttaaggcccttgggagaaaccctctatcaatgatggacacaaatgaagggaaaatacccccagcttccttgttccctgggcagaaaacccgatgcatgtcctatttacccttcctgaggccccagtggaattgaatccgagttgccccagagtaatttgttcattagcagaccatgtgttgtgttgtgttgtgttgtgttgtgttgtgttgtgttgtgttgtgttgtgttttgagacggagtctcacttgttgctcagcctggagtgcagtggcatgattttggctcactgcaacctccaccccccgggttcaagcgattctcctgcctcagcctcccaagtagctgggattacaggtgcccgccaccacacccggctgacttttgtattttttttttttttgagacggagtcttgctctgtctcccaggctagagtgcagtggcagtggcgtgatctcggctcactgcagactctgcctcccaggttcaagcgattctcctgcctcagcctcccgagtagctgggattacaggcacctgccaccgcgcctggctaatttctgtattttttagtagagacggggtttcaccatcttggccaggctggtctcaaacttctgacctcatgatccacccgcctcagcctcccaaagtgctgggattacaggcatgagccaccacacccggccaatttttgtatttttagtagagacggggttttgccatgttggccaggctggtctcaaactcctgacctcaaagtgctgggattacatgcatgagccacttgcacatggcttttttttttttttttttttggcagaccatatattgttttccatttcttccctatctcacttccttccattgtttcctgggattacctcccaagtaaaccacttgctctcaaacatttacctcagggcctgtttcacccaaagtatgacttttggtaccagaagtggtcatttaaaatagaccctcaggatgga

SEQ ID NO: 7353 - DNA, 1375 bp, artificial
  synthetic oligonucleotide
tgtgtgatgtgaactgactttaagtaatcaggattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtggagattagagttaatctccccaatcacataatttgttttgtgtgaaaaaggaataaattgttccatgctggtggaaagatagagattgtttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatatacaccaaactgttaaatgtggtttctcttcggggagggggggattgggggaggggccccagaggggttttataggggccttttcactttctacttttttcattttgttctgttcgaattttttataagtatgtattacttttgtaatcagaatttttagaaagtattttgctgatttaaaggcttaggcatgttcaaacgcctgcaaaactacttatcactcagctttagtttttctaatccaagaaggcagggcagttaacctttttggtgccaatgtgaaatgtaaatgattttatgtttttcctgctttgtggatgaaaaatatttctgagtggtagttttttgacaggtagaccatgtcttatcttgtttcaaaataagtatttctgattttgtaaaatgaaatataaaatatgtctcagatcttccaattaattagtaaggattcatccttaatccttgctagtttaagcctgcctaagtcactttactaaaagatctttgttaactcagtattttaaacatctgtcagcttatgtaggtaaaagtagaagcatgtttgtacactgcttgtagttatagtgacagctttccatgttgagattctcatatcatcttgtatcttaaagtttcatgtgagtttttaccgttaggatgattaagatgtatataggacaaaa

SEQ ID NO: 7354 - DNA, 534 bp, artificial
  synthetic oligonucleotide
acccacagtagtagtaaggaccattaatcctttggactttaggatacttaaagtctttcttctgtttttttgtttttttttttttgagacggagtctagctctgtcgcccaggctggagtgcagtggcgcgatctcggctcactgcaagctccgcctcccgggttcacaccattctcctgcctcagcctcccgagtagctgggattacaagcgcctgccaccatgcccagctaatttttgtatttttagtagagacacggtctcgtcatgttggccaggctggtcttgaactcctgacctcgggtgatccacccgccttggcctcccaaagtgctgggattacaggcgtcagccaccacacccggcccaagtctttcttcttggggagtatagttttccagatcattttctaccttcatttttcaatttttccacttcagttggctcactcatctcctctctgacaacagtccgtgaagattgtaaaagatcagctcagtggcttcactgaaacctaataggaggcccctcttt

SEQ ID NO: 7355 - DNA, 207 bp, artificial
  synthetic oligonucleotide
gtggcccacaaagcctaacatatttactatccagttctttacagaaagttggccaacacttgctttctagatcgtagagatgtgttggtctaaaagagacctttaagaaatcatcaaatccaggggtcggaatacctttctgtaaagtattttaattcaaccctggcatttgagaaatgaggattccgagttagggaatggcttgtt

SEQ ID NO: 7356 - DNA, 260 bp, artificial
  synthetic oligonucleotide
agtttgatgtatattcagtggagaggatatcgatatggtttgtttcaaggtatgatttttaattaaaaattgttgttcacatttgaaggtggcataatctgtggttttctgtattctcaaagttggtgagcaagagcctttgaaacagatataagtattagattacataaattgaagataataaaccaactccccctagatcttcttatgctctggtattgttttgggataaccttattcatattcaagatctctctagt

SEQ ID NO: 7357 - DNA, 1630 bp, artificial
  synthetic oligonucleotide
aatgtaatagactcttaagatactggctggtcacggtggctcacgtctgtaatcccagcactttgggaggttgaggtgggcagatcactggaggtcgggagttcatgaccagcctggccaacatcgtgaaaccccgcctctactgaaaatacaaaaatcagctgggtgtggtggtgcacgcctgtaatcccagctactcaggaggctgaggcaggagaatctcttgaacccgggaggcagaggttgcagtgagccaagatgacaccactgcactccagcctgagtgacagagtgagactccatctcaaaaaaaaaaaaaaaaaaatctacgaattgccacctgtatcttagcattcattgcatgtatgcatctagtcaaattccggaagccgatttgcctagctcatctacagttgaccatagacgcatgaaggagcccagctaagactggaagaactgcccagctgagcccgaattaaactcacaacctgcagaattgttagccaaataaatggtgctttattaaaaccactaagtttttgggtggtttttaaaataacatagcaatagctaactgctactgtaagcaaagtacaacaaagcattaatccattgtgctgtgattttaaaaaagatttctggttgattttgcatttccaagggtacaatgaacaaagttttaaaagtagcatagctaatagtattgctaatcatttttgtgcacagtagaatataattcagacaaaacatttttcagtaatttaatttttagaaggaattttgtacctgagattcatagcttgggcacatttcaaaaatccttcaatttcaactactgaaaattgttggcagtctataagcatcatttcaacaagttttgtttagattcttaaactccatagactcaacacaataaggaattgccttaaaggattcctgtaaagtctgtttttttgaagcttgcttaatgagaatcaaatgagctttggttaccttacttgtctctaacactttcttgtctttatagtcattacgttctttgttactatatttggatgaaacatgatttatcatggctgttgcaagtgattttggatttttttcctcatgaacttctgaggcagaaaagttgacatttagcttttattttgtcttcataactatgaaggattttcaaataagactttttcttaaaacactcatggccttataattaaacaattaaaaattaaataaagttatttatttatttattttttgagacagagtctcactcagagtgcaatggcgtgatctcagctcactgcaacttccgcctcccgggttcaagcaattctcctgcctcagcctcccgaatagctgggattacaggcatgcgccaccacgccaggctaatttttgtatttttagtagggacagggttttgtcacgttggccaggctggtcttgaattcctgacctcaggtgatccaccagcctcggcctcccaaagtgctgggattactgacgtgagccactgccgccagccaataaaattcttaaaggctattttgtttattgttccaaatgccgatgcaaaaaaaaaattctacaaagattagaattatatctaatttttatttttgtttta

SEQ ID NO: 7358 - DNA, 851 bp, artificial
  synthetic oligonucleotide
tttggttgagattgtgtggaatctatagaccaattcgagaagaactgacattttgaccctattgagtctctgatccatgaaaacagaatgcctctccagtttttttaggtcctctttatttcatcaatgttttgtagtttcagcatacacatcttgcacatattttgtaaatttattcctaagtatttcatatttattatgctattataaatggtactgttattaaatttctgtttccaattgatatgcaattaattttcgtatactgactctgtatcctatgactttgccaaactcagttctagtagcttgtttgtacactctttgggattctttggttaaatgatcatggtgtctgtgaataaagacagttttatttcttccttttcaatatttatgtcttctatttccttttccttgcttaattgctctggttagaacctccagtacaatgttgaatagaagtggcaagagaagacatcttgttcctcttcttaggggaaaagctttcagtcttttaccattaagtatgatgttagctgtgggtttttcatagatgtgcttgatcaggttgaggatatttctttctattcttagtttcctgagagttttttttttttttaaatcgtaaatggatctgcattttatcaaaaatttttaatgcatctattgagatcaatccttggataaacactacttgatcatgaggtattatctgtttttctgtattgatggatttaatttgctaacatttggtggggagatattttctgtctatgttcatgaagaatatttgtctgtagttttcttatgtctttgtctggtttggtattgattgggttttggattga

SEQ ID NO: 7359 - DNA, 3256 bp, artificial
  synthetic oligonucleotide
gcaaaatatttttctaggcactgaggatacattgatgaataaaacaggcacatatttctgccctcatggagcttatattttagtgtggtgaacaggaaatgaatgaaagatagtcattcaatatacagtagtatgttaaatggtgataaattctatggtagaaaatagagcagaatgagggacttgggagtgctctgtacaattgcttactatgtccttgggaaaatcagtgctagtttttttttttttttttttttttatcagagcatggataacaggacatttcttacttaggcaaataagcatagactttggagttagatagacctattttgatttgcgaccttgggcaactgtatcccagctttgcaaccttgggcaactaattttcattgagccttgtatcagccagtgttctatcagagaagcagaaccattaggagtgatacaaagcaaaggatttattatggagatcagatcttatgtaattgtgggagctgattaaacagttcctgtaagtctgttgttctggggccgggcacggtggctcatgcttgtaatcccagcactttgggaggccgaggcgggtggatcccctgaggtcaggagttcgagaccagcctggccaacatggcaaaaccctgtctctactaaaaatacaaaaattagccgggcatggtggcgcacacctgtagtcccagctactttgggaggctgaggcaggaagatcggtagaacctgggaggcagaagttgcagtagctgagatcgcaccactgcactccagcctgggcaacagagtgagactccatctcaaaaaaaaaaaaaaaaaaaagactgtcgttcccgatctgatgctgggcctgaagtcagcagggcagatagtcaagaaagatggatgtgaagtgggaggagagcaaggtcacactagaacttatgaggattagctggaacccaaatatacctctcacagtctctaagcctccaacttcaaacttggaggtatcatgcaggagaagctggtatgcttcatcacagagctaaacacacacatggcccctgagtcagagaagctgaaggaggaaatcccaggggaactagagaagttgtggcctatgtgtgttctctcagaaatcagagaagctggccagacgtggtggctcatgtgggtaatcccagcactttgcgaggctaaggtgggtggattgcttgaggccaagagttcgagaccagcctggccaacatggtgaaaccctgtctctactaaaaatacaaaaattagctaggtgtggtggcacgtgcctgtagtcccagctactggggaggctgaagcaggagaattgcttgaacccaggaggcagaggttgtagtaagccaagatcatgccactgcacttcagcctgggcaacagaggaagactcttcccaaaaaaagaaatcagagaaactgaaagaggagctttagcagttgctgtgggctcagacatgccccaagccaaagttaagagccaggagagaagagacaacatacttaagctgcaaccataccaagtaccctcctctgatcttctgggcctaagaagatgagggtagctgcttcacttctgcctcccgagtttcatgcaacatatatctggtggtccatgctaacccagcctatttagaatagagaagggaattgtagagattctagttccagcttagcttggttgacagtgtacaaatccatcacaagccgatatcttaatgggaataataatacctaattcacaggatttttgggaagaataaatgagttaatctgtgtaaaagtatctagcacatagtagataatcaaaattttttttctttctttctcctactctttggccaaggaatagcataatttcaggcctcagggccgtgaagattttacgtatttatttactgggggaaggtgctgtggggactgtgaggatacctgtttaaattattaaatgattatatcagattgcaaattacttgttataactatatttgaggttgactctgtttgaggatgtggaatatacactgaatgccccaggccattgaagatacatttagcatacatacatatacaaacaatgaaaacagatagaaagaaatcatataaattggtggaaaaacaaatttaatttatgaagtcacagagtcaaagaatgtcagacctggtaggagcttaggaggaggtcaaatatttcaatacttaattttcacagatgataaactgaggctcagagaggagaagtaaattgggtaaattcactacttgtttggtccagaaacattttttataggatttttttaggatcctatagaacttgttaaatatattgtaaggatattgttgaagacttcagacactttattattcagtatcttctatatgacatccccacatgagaaattttagaactaagtgccaggaaaaactttgtttaacccgaagaagtagtatgcttttattcctcatggacaatataaatctggtaaatgatcatgaggaaacatgatcattttgctttggctgccaggatgttcagagccaaatttgtagccctaactttactaaccatgtaggtctctatgagcctcaatatagatgtcttacctttgcctctggctttgttgctttttttcttcttgtcttgatttttagttaatagaatttttatatttttagttaatatgatttttatatttaatgtgatatatatcacattatatattttatatatatataatatatatatataaaataagtggcctcaaattctttgtggtatgaggaaggatataaacacacaaatagaaaaatcctatattatttgacctctgtggtgcagtgaaaaagcactgggcatggaataaattctagtctaggctctgccattttaatagacttctctgaacttcagtttctttgagcagcttggatattgtaacttctggtatgattcagaagacagcctttttagaagagtatagaagtgtctaaaaccttgtgtgtctgccccttatataaaaagtgttttggggaacttgactctcagttaagagattcagggtgatttgaaatgaggattttactcaattctggataagagaccagagttagattaagtttctagattggtgagagaatagtacataaagtagaatgtgttcatttatttgcttggatttttattttttttaatttaaaaaattatacggtaaaatggactttttggtgag

SEQ ID NO: 7360 - DNA, 822 bp, artificial
  synthetic oligonucleotide
ttattaggattggttatttctttatgttccacttacttctcccacttctcatttattaaccactcctttactctttaacctcctgtaatcttacctccattcccggtactgtattgaaaccattcaggtctacatgtccagtgacctttttattgcccagaggatcttttctcagctctcatggtccttgctttctctgtaataattgacactgttgatatctttaaattctctcttctcttggcttctggcactgtgcactctcttttcttgctcttccatctctaaccagtcctgtctcatggtcccctaattctcatcttctttaaaaccccttaaagttgaacatttcttcccccaggtcctgtcttcagcctttgctcttttctttacccactcttagtaattgagttcatttctgtgtcttcgactatgcacatgccacctgggaaatttcctagtagttactattacatgttaggtgatcaagaaatgttacttcaatttgggcttcaactctgtatgtctgggcttgacaactcctaagtctcagttttgaatttccaactgacttgaatgtttttgatgggatatccttctcacacctcaagttcaccatgtgcacatcagaactcaccaactttcctgctctcatttccttcttcccaatttcactatttctattagttgtagcactttgttctgccataactcaatggttctggtgtaagacaatgtctcatggtgggagctgtggagattgacaatacctgctttgttttacagagtggatgtaccagcaagttattgtcatgcaaaaat

SEQ ID NO: 7361 - DNA, 2085 bp, artificial
  synthetic oligonucleotide
ctgccaaataggctggctcctgtttcctctggagcttccttataacattttctaggctgtggttttatctatctgtttcatctgccaacttgctcatatctactttccttcttccagaaacgtgttgggatctctttttgttggtaatttcctcaacttctgtctagttctttttgcctttggaggtttattcccttatgtactgctgtacttttatattaagggaatctaggaggcgttgggagcaatgtatgcagctagtctaccatcttgaactggggtcaacaaatagttttgagtaccttccctgtaccaggtactatgctaggtgctaggggtgtaaacatgaatgaaacttatttcatggtatcaaggagctcatagtgtggtagcatagggagacccatgcaatggatattacaatgggacttgtctccaaagctgaaaacaaagggtattaagggctcacatattctaaagagaggtgacacaccatttttacagaacttgctaaaggacaacttccaaaatatgatttgtgtccattaaatcctttgaaggcatgtaaaggaagctggggattgactgagaggagagtgatagaaaagatagttttgaagagaggtatgggagtgctatggagtttctcctgctcatgggggagtggaggaggtgtttcccactcacttaagtggaaggtggctacaagagaatcactccaggagctttgacatgtgttccctggggattgatatttgtaggagctggtaacttactcgtacctaaaaacaaagtctaaaggtgaaaggggctacggctacggcagcctgtgaaaacagaggaaagagagagggctacattggcagggagctgtacttctgccagtgtgtgggtgaagctgtctgtttcccaggggccagaggtggtcatcaggatagaaagttagagtcgggtcatcttattaggggtctcccctaagaggattgcttagaggtatgcaatgatccaaacagaggaatggactgatggaaacccaggacagaggagttgaaaagggcctgccagatgaagtgttgcctaggccaggaaaactgcaggtgagagatctccagtgatgggaggctccaaggaaccctttagagaaagtgtcagctttggacatatgccacactcttcaatcaatgccaggttaaaatttaaccagtcaaggaaagctcttttttttggcccttactttttctagtccttccctggcagacttctttcaactcctcggtcctgggattccatcagttcattcctctgttgggatcatttcagagttggaacagcatagggagtgtgtgtggtggggtgtgtgaggagggatcagaagaggaaatggaccaatggggaagtcaaccatgctccacatccttcccctactgtgtttcttggctgagttagacctgagcttggggaggagataagcttggaaatgggtgacagattgaagctataatatactagactgaactgaaaactttaatgcctgaaaacaaaactatgttttaatatccgagagtgactgaaaaagatatgagatctgtctgaagttttatgcaggggtggggaaaaatgattccacagagcttgtgatgtgaaagaattatattgctttctgcttacaccctactgtgtctagctcattcaataaactagtttatataagtgctacactatatgtatagtcaaggttcagtgagtaggtagcacatagaagaaagtaataaactctttccagggaggccaggggaaggcctgacactttctctcagaggagttagtgtttgaactgggtcttaaagaataagaaggaatttcttaggtgaggatgaggcaggaggacatttcagaaagagggaacagcatgtacaaaagtaggaggtgtatatgggtgattgcatgtggtttggtgattctgaatcattgtagtgtaaactgctgttgggtggggagggaggtcatacttgcattttaaaaggtcacttttgtcacaatgtgttaagtgggatagtgagaattgtggagactgggaaacaatgt

SEQ ID NO: 7362 - DNA, 1852 bp, artificial
  synthetic oligonucleotide
tacaaaaaacagtaaaatttggtgattccatttaatagaaccccttttactatccacaggctagagaaacctgaagaaatttgggttccaaagctatttgttgtgggagtgacagcctgattatactggttttattactttttatataaaaaagcaaaaaaacaagtgagttctccctttcatgttcaatattccattagttgaacatcctctacgtgtgttcatagaaatattttatgtcctgagaataacttcagaggttgagagcatatcttccccagcgtttgctttagagcttacttgaataatcagctccctgctttcagaacaaatcttagttttcatgaacagcagtatcatcagtcattcattgatggatatttgaatggaaaaagtgccaggtgtttcaacttcctctccagcaggtttacaattaagctgttagtagtttgttgttggtttaaaaaaatttttggtttgttttatgcacagaaaaggaattcccataatccatcagatggagatgtgctgctggaaatgctgctaccttgtgaccaaaataaataaataaacaaaaataaaaataaaaataaaaaattgctgggttaccatcagctgtgtccattcagatttatcaatcataaattgaggttccttgcattacaaatgtgggctattcttttttttattattatactttaagttctagggtacatgtgcacaacgtgcaggtttgttacataggtatacatgtgccatgttggtttgctgcacccattaactcgtcatttacattaggtatttctcctaatgctatccctccccctgctccccaacccacgacaggtcccggggtttgatgttccccgccctgtgtccaagtgttctcattctcgttgttcaattcccacctatgagtgagaacatgcggtgtttggttttctgtccttgtgatagtttgctcagaatgatgctttccagctttatccacgtccctgcaaaggacatgaactcatccttttttatggctgcatagtacttcatggtgtatatgtgccacattttcttaatcagtctatcattgatggacatttgggttgattccaagtctttgctatcgtgaatagtgccatgaaaaacatacgtgtgcatgtgtctttatagtagcatgatttataatcctttgggtatatactcagtaatgggatcactgggtcaaatggtatttctagttctagatccttgaggaatcgccacactgtcttccacaaggttgaactagtttacattcccaccaacagtgtaaaagcgttcctatttctccacattctctccagcatctgttgtttgctgactttttaatgctcgccattctagctggcgtgagatggtgtctcattgcggttttgatttgcatttctctgatgaccagtgatgatgagcattttttcatgtgtctgttggctgtataaatgtcttcttttgagaagtgtccgttcatatcctttgcccactttttgatgaggtttttttcttctaaatttgtttaagttctttgtcgattctggatattagccctttgtcagatgtatagattgcaaaaaatttctcccattctgtaggttgcctgttcactctgatggtagtttcttttgccatgcagaagctctttagtttaattagatcccatttgtcaattttggcttttgttgccattgcttttggtgttttagtcatgaagtccttgcccatgaaatgtgggctcttctttaaaataggccatgttattaaatgaaatgatatgcaacacgtacttagaacagtgcttgttgctacacagcaagtgcttgat

SEQ ID NO: 7363 - DNA, 1371 bp, artificial
  synthetic oligonucleotide
ggatgtgaaagttgtactattaccttataatttatctgttttttagtgcaattttagttgtgctgaaccccgtcatacctggctgctttgacaggtgtgctattttagcaacatggaacaaaacagagaaagaaaaaaagagtgcatggtacgcttgtgctgtcagatccaggttgctctgttcctaagtttatggatgatttgttcagagttgttaagagacaaaaaaaggttaggttttgttttcacttatgtgacactgaatgttctcacagttcacctcacaggtcagctgttgctcatatggactgatataaagggatccctttccctgtctcctttctatttgaaattccaccattttgattaattcctctgggctaaccatttgcctgctcaatatatggagagcccaaggtggacaacctttcaaatccttaatgttggagtatgcattcatatatcagattaatttcttccttgatccaaagcatgaaaaggggtaagaggtggagttggtcaaaaacatgtgaggaaggaagatgataaaataatattggtcccattccccagagccatccccaaatgtcaccttgaatgctttaaaaaaaaattcttaatgctgaaaatgactagtaggagacttatgtttatactttgcatactaaggctggacactcttcaatcaagaagaaaagttgctaccagctaccactgaaatcttagaggattgttcttaatcctagtagatgaagagcaaatatctgcctttggtgcaagtcagctctgtacatccaatccattggtaagacatgtgaggaattaagtgtcgttctcgctattgagttcccagccttgccatattctcaaagaactacacactgaagttgcagaaagcatataatagacgacatagcttcagttatttaaattcaaattttaaaagtactttacataatctaaaggtacatgtacaagaccattcagcttcagcaataaataaagtcttactctagtgaaaatgcaggaagctttgcggaaatattacctagcacattttgaaatagaagcaatgttttatttcagagaagaaaatgaaggttgaaaggttttaaaatattaaagacagtttagcctcaatcgaagaaataacattttctagaaacaacagagaataaaagttacaacaaaattatcaacaacttgcaaatgattcaaaacagattttatggacaaaatgctgaaaggtgggccctgtacaccaaagggcacatacaaatccacataaaggcaaagcaccagttaaatgattcacagtctcatctaaagcccatcaaatagatacatctggaacatctttggatgtacatt

SEQ ID NO: 7364 - DNA, 3208 bp, artificial
  synthetic oligonucleotide
acatagttttaccatcacacttgaagttgaatgactttcaactgtttcaaaaattaaaattctctctgaaagaataaagtttgggccattgtaagtttggaaagctcttgaatcagagtatagtctcaaaaataatggctttgtgtaggatactattcctctggatataaaagttctgaaacgtttgttaaaaatcattatagttgtgtcttgaattttgtatgtagcattagttcgtatagacgtagagggcataggtactggcttgctttatttgaaatgtcatgaagaagtcagatgtagctaaatgttttcttttgtgtagtacttgacgtggtataaaaaaggaattgatgtggatttgtcagttctaaaccaggatctgtccccaacactgacccactgagaaaataagaaataagtcaggttggttgcttcttgcttcttgtccatttctaacctggacacttttttacagttagggacaacttttgatgaaataaagacaaatttcaatatcagcagagactagattaacacatgctttatagtaattaaaataaattaaaggcaatgataaaactccaccgttctttaacaattattcatgttctgatttttttggtgatacattttaaactctaggattatcaaaaagtccaaaaaagctttaatgagggaaggaagttaaaagtacactacattgctggtttgtctgtattaagggagggagtcagaggaaatataatcctgaaggggatgtaacaatttaaaaaaatgaattacatttttatgagttgtgatttgcttaggctaggtttgtaaggctccaaattgtaattctgcttgtttttcttaaaaaattagtcacttaaataactacatgaaaaaataacatgcaagaatgcatttacgttagtttaaatttacttctagtttatatacacacagggacagacagttttgaatagttgtaatcagagtggcatccccttgtgcccactttttacacatactgtcattttatttttttatttttattttttgttttgtgtgtgttttttttaatactttaagttctagggtacatgtgcacaacgtgcaggtttgttacatatgtatacatgtgccatgttggtgtgctgcacccattaactcatcatttacattaggtatatctcctaatgctatccctccccccaccccaggacaggccccagtgtgtgatgttccccttcctgtgtccaagtgttctaattgttcaattcccacctatgagtgagaacatgcagtgtttggttttctgtccttgcgatagtttgctgagaatgatcgtttccagcttcatccatgtccctacaaaggacatgaactcatccttttttatggctgcatagtattccatggtgtatatgtgccacattttcttaatccagtctatcattgatggacatttgggttggttccaagtctttgctattacacatgctatcattttatgtcaacatagtccacatacttaaagttttctggaaaacctaagactctaacatttttgaattttggcataagattttatttgtttatttatttatttatattttttgagacggagtctctctctgtcgcccagcctggagtgcagtggtgtgatctcagctcactgcaacccctgccttccaggctcaagcgattctcctgcctcagcctcctgtgtggctgggattacaggtgcgtgccaccacacccagcagttttttgtttgtttgttttgtatttttagtagagacagggtttcaccatgttggccaggctggtctcgaactcctgaccttgtgatccacccacttcagcctcccagagtgctgggattacaggcgtgagccatcgtgcccagccagcattaacattgtaaaccttcacctttgacatagaaagtgtaattttgaaccattgtttctgctataattcctttatttttccctaatttatatatttatttctaaactggcaaaattgtatatatgtattgtgtatgacatgatgctttgaaatatgtatacatgtgtaatagctaaattgggataattagcatatgcattacctcacatacttacattttgtgatgagaacacttaaaatctactctcttagcaactttcaagaatacaatacattgtttttaactatagttgccacgttgtacaatagatctcttgaactttttcctcctaacctaaatcttttatcctttgacccaaatttcccaatccccaccctgcacgcccctacgagcccctggtagccacccaccattctactcttggcttgtattagttcaactttttaagatcccatgtataactgaaactacgcggtatttgtttctctgcgcatagcttatttcactttacaaactgtcctccatattcatccatgttgttgcaaatgacaagatttcctttgtgtttaaggctgaatagtattccattgtgtatatacaacatattttctttatccattcatctgttgatagacatgtaggttgattgcattatgtcttggctattgtgaataatgctgcaatatacatgaaagtgcagatttctccttgacatgatgatttcatttccttttgatatatacccagcagtgggattgctggatcatatggtggttctatctttaattttttgaagaactttcataccgttttttataatggctgtactaatttatattcccaccaacagtgtgcaagggttcccttctctctgcatcctctcttgttgtcttgtttttgataataaccatcctaacaggtgtgaaatgatatctcattgtggtttcatttgcatttttctgatgattagtgaggttgagcattttttcacatacctgttggtcatttgtatattttcttttgagaaatgtctattctggtcctttgcccatttttattttattttattttttttgcaatggtgtctcggtctgtcgcccaggctggagtgcagtggcgcgatcttggctcgctgcaaactccacctcccaggttcatgccattctcctgcctcagactcccgagtagctgcctttgcccatttttaaatgggattatttgttttctttctattgagtaatttgagtctcttatatattttggatattaactccttatcatatgtatggtttgcaaatatattct

SEQ ID NO: 7365 - DNA, 1933 bp, artificial
  synthetic oligonucleotide
gtttggctgttacaggcagggaacctttgtggtagtgcacaggtagaataagtctatagagaatgcctctgattaagtcctctgctataaataaagggctggatttaagatattctttcgggtagaatggacacagaattaaaaatgtgagaaacagctttaaactctgttaataatgtttcaacatcagcttatgttttatttgattcacttcgttaagcttagaatccaaagtctactactagtaaaacccagatttgcccttgagcatttcaaggttataggatgcctggtcttcctgttaggatgctatacattcaactttgacacctatgttttctcttgcagtaaatgggataccactattttgtagtttgcaactaggggggaagttaaactacccagtttggacattttcctaatttggggtgattggccaaacttgtagtaaaaggctgaattcttatcattaggtcatttagttcttaaatgaagattttttttttaatgtagcaagatataataaggctgactaactggatagagtccattaacatatatggaattgagatatatatatacatcttggttgcacacatacacgcagaaatagaactgttttctcacaagatgacaaaaggctatactacgtatcacattcagtattggacagagagagtaaaagcaggaatgcataagaactgatttttttttctttttctttttttagtcacctggtgggccatttaaacattttatttatttattttttaatttttattttactttaagttctgggatgcatgcgctgaatgtgcagatttgttacataggttacatgtgccatggtggtttgctgcaccatcaacccgtcatctaagttttaagctctgcacgcattaggtatttgtcccaatgctctccctccccttgccgcccaccgcctgacaggccccagtgtgtgatgttcccctccctgtgtctatgtgttctcattgttcaactcccactgtttttcatctttgtcactgattatccacgtgaccttaggtaagtcagtctgttactgttactgcatttgccaagtaggaataattaagtcgtactaacctcacaagattattaaggtacaataatttacatatatgtgtgtgcgtaattacatatatgtataactttaaggtagtaatattactgaatgtttaaataacattgactgatagtcacagatctctaaaagggagggtgaatagggaaggaatatacaaacgtctcctattataattctctctctataggagctcctgcccttttaaaaaataccctgagtgtgaggtgggatgcatattttgaaaaaaatttccagatgattgatactaacaaccccctacccccattgttttttactgatgggttgtgttgagatgatcaaggttgtcttctgctccatgagtcttttcactctctctctctctctctctctctctctctctctctatatatatatatatatatatatatacacacacacacacacacagacacacacacacacacacacacacataaaaaagcagcagggcattttgaagtggtgtaaattgcaggattccaagtttcagtaatgggttgtttggactacatgtgctccgcgagtatcaagatgaatttttgaagatctgttggccagatttcccagcgtcacttgtaaatgtcttcttgtgaaaaacaagtgccaaatggcaattgtaattgcataggatttttttagtgtttcatgattgcctcccctccctgacacccttccccactggctgctgccccaacatccattattttttgccagtgcatttggacaccctgaactcctatatatctctcccaccccgtttttataattttttattttctttctattgctgagaaaggcacc

SEQ ID NO: 7366 - DNA, 1019 bp, artificial
  synthetic oligonucleotide
tctggtaatgaatcaccagggtggaacactgatttatgaatcatgtcctgctgtgtgcaacgttgcagggaggcctccgtttgcgatttgggtcgatcccattagaggtgatggattacaaaacccagcagagggtgctgttgtcaaagcaaaagaaggtacaaaagggccctcaaaggctgagaagccaatatactgactttgggttatgatgggaaaattataatttgctgctgtttaagttgccaaatttgaaatgaatgaatcattcttccaacaaaatgaacaggcacagaggataatggaaacatgttcattaaaacattctggagccctctgatcttgatgtcacttaaattttaaaaatctttttagggtatagtacataaggttttgtaatttgtctatatgagtaagagacaaaaaataattacctgggataataggctataagctatatctagaaatatagtctagggagtttactttttccaaaaaaaaaaaaaaaaaaatcagaattattggcaatctcactgtcctccaaatgaaaactgcttccctgaaggcttttgatgtggagctgttcttttattgccaatagaaccatgaaaaataaacacttcattaaaagtaaacacatgtacttggaaacccattactgttttcttttcaagttgcaaattacaaaatatttaagcacttttatttgccttttaaaatgttaaacaattatattctttttacccaaaatgagcaggattcagcctggacacaatggtagagactggctgtactactccctcccccaacgattacacaaagtggcatagtaattcagtatcaatccattatattctaaaaaactcagcctgggtagttgctcaaattttaataactataccagcctttggaaggcttgggaaaagcagttggactgtactttataggacagacttgaacttgagcctatacataatgccacctaaagttcagttctgcatatacacgtgcgtgtgtgc

SEQ ID NO: 7367 - DNA, 1625 bp, artificial
  synthetic oligonucleotide
aaaagtaacttacataaagagaaacttctgctatctggtgttataacagatatgccaggcttccattctacctcatttctacatgagaaaattgttatccatttccatgatgccaaatgacaataatacttgaaaaccagtgatgcctacctgagtgatgtccattcctgagtcacagctcagtggttgtgtggaagtcagaccatttgagccgattacagttgtgatcacagcattctcatcaattttgcgaatcatagtcccatccacaaagtaaataaatccatgcctatcaactgtgatgcctgttgggaaagagcaaatgagcattagtagtctagtgaaccacatttgcactaagctctgtattttgaaaaaagccatagcaatggaaaggcattttaaagacatatagattcaattttgctcagcacagacaggacagtaatgggagaggtttgttggggcatacattcacttctttgtgtattgagaagaaatgacaaaaagtcacacgcggagataaagccaggtctaataattttgtccagttttacatttccacccccttgatacttgcttgcccccacaaacaataaaaaatcatctttaagataaatgggaaaagacggggagatcatgtatattacatttttttttagggtgctaatgcacaggctgctgcttattttcacgattgcattaggaaataactgacttgaaaagcattataattattttcatcaattcagactttgttaaaagggagtttgtaataactttgatgaaccgggctgagtttttttctccatattatctattaaaaggggagttggcgagcaaaattatagtatcacaaagggaatggctaagtttctagaaaagataaaagccgataaaattttcacagcagtttttacacacagtgttaattacagcctggtttcttaaaatttttattataatagcagttagaaggcttgggttctaatactgaataccccacttacaactaatgtgtgactctgattgagtcattcatttgcaaatttcagactcctctttggtaacatagggacaggatcgtctgccttacttagctaaagtgatctactgctctggtttggctgtaactgaggcagagctcagttttaaaactaggaccatccttgacaaaccaggatgagctggttactctatatctaggtatatctaggtgttttttttttttgtttttgagggagttttgctcttgttgtccaggctgggtacaatggtgcaatcttggctcactgcaacctccgcctcctgggttcaagtgattatcctgcttcagcctcccaaatagctaggattataggagcctgccagcacgcctggctagttttttgtatttttagtagagacagggtttcaccatgttggccaggctggtctcgaactgacctcaggtgatccacctgcctcggcctcccaaagtggtgggattacaggcgtgagatatcgggcctggccctaggtcgttatatcatatgaagtaatacatataaaaagtatcagatacactttaagaacatatggctctactcctatttcccttggtgcttttgacagtgctcttgaaa

SEQ ID NO: 7368 - DNA, 1083 bp, artificial
  synthetic oligonucleotide
gaaaaaattaggttcaattggaatacttaatcttttcctacttaccttcatcaagtaagagaatccagtagattccagggacacctccaaccctggaaccaccataacaggtgctgtaaataaactatgaagggccccaacaaactctagaattgatttggtagccataccagacaaggcatctctctgggaaaaactgcttcaataggggtttgagtaaaattctttacatatatagttaaatttttgccttcagaataaaatttttccaatgtgctcagatctttctagaaaaaagaaggggtcaaaacccttctttgaaacaactacaatattttgatagccagtttgtggagtttcaattcagtcagattagtcatgctttgtttaggaagagtccataggccatttttccaagagaaatgctattttgctatttgcacaaaagcactttggaatgcagtacattcattcattattgaatacccccagtgtgcctgtgaggaaagttagaattagcaatctcctcaaatctcagctggggaaacccagacacatagggagcttgtccggggtcactaacaagtttgggcctggaccaagattagactagattatatgtgattttgtgtgcaaaataccatcagaatactcttgctctgaaggcagcaaaacaaatcagcgttcctgctttctaatgagcaacatgtcctattttgctcagccaggctgttctcaaactttgtgtactggcccttagaaaatagaatagcccaacataccaaagtgaaatctaatcaatgttattttcttgatagccagcagtcaggaaggtccctcctatcaatatgtaacttgccatttcatgtcatttctcaagtgtactttagctcttttgaggctgatttctttctactttctgaaaacaagccacacctgagaaagaaaaaaaccactggactatattccaatttgctttaatcccttgtgtctcaatgcaaattgcaatttgagatatgtgaagatttcttttacaacttgggtgttaggtttactatcaccttttggttagttttacattca

SEQ ID NO: 7369 - DNA, 1390 bp, artificial
  synthetic oligonucleotide
actaccatttcccaggcggcctgttgtctatcacgtctgatcatcaacatagcatggtacagggcacggattcagtctctagcactctggagtagggactagggagaatagtgtaatagaaaggaaaaaaaaattcattaacatctcagagaagctgtagaaagtagactagactggcagtgagcaggaataagtggataaggggtcctggactacacttcccaggggttagcataatgggttcgtgctggtgtgcatatattgagaaggcagttgagagtgagtaattattatggaataatactttctctgagccatgtgatcacctcccttgtgactcttctaatttcatctggatttctgccttcctgtattctctccttcacctccacacagagatattaacggaatgctccttaaccaagagtcactaattgtctagatagtcgtgttacttttgcagaggattctatcctctggtcacaggattgcacctctgacttcactgttagtcatcttgcaaatattacactggcttgtaaagaagactgagtaaaagattgtagcttgctcctccaaagccatttgacattggaaaaataactgaatgttcattctacttatcagagcagcagcatttgtatgacatggggatggcaagaaggctgagggtcacggcgtccctgataacttagtttagttactgtgacattcatctataagggctaggataggagattgacattaagtagccaaggtaaaggtgccatgcaatgaagctgacgtgtgaaatatgacaagattaagcagatgactttcaacagcttcaggctaaggcctcagaatttataatggttgcatttatgaaggcaatatataattacaagtcgtctgatagtcaatgtgagaaatttacatgttaccttcatgaactcagggaacatctaaaaataatttcatgatatttaaaaggtacctaattacaagatgaaaatcttcttctccgaaaggaattattgaatatagcaataaatattttccattcttttaaaatacaagattaatgcaaaaacaaaaacaacaacaaaagacaaaaaaccgaaagaaccaaatgaaggccatggcaaaatagaccaatactatgtagacaaaatactatctatgtaaaacaagtacctgctctcagagattcttctatctttccctattctctagtgatttatcgtaggataggatgagcccagaggtttctcaatttgacacactgcccagtggcctgaaatactttgtttatctattattcctagcttactaagagtgtcagaatcaggtgttgaattttcatcaagtgtctttttgacacttacggacaaattcacatagttttccc

SEQ ID NO: 7370 - DNA, 2489 bp, artificial
  synthetic oligonucleotide
cttgacttgcatgcaagagtaaatgttttaatataatatgcctgtacattttcagccttgctgaattttaaaatatgattttttcagaaaacaaaaattattttattggattgtggctggaaggaaaatgatccttttaaagatgaggaaggtaattcagtatcactagtttttacgaagaacattttcaatcaagacagaaaaataaaaatatatgtgtatttcagggatgcttgtttaggcatagaataaatatggttagaacaatgatttcaaggtgtgtgtgtctgtgtgtgtgtgtacatgcatacatatgtgtgtgtgctaggggacacatcaaaaccactggggtggcggggagcttttcaaactacacatactccactaccctcattctgataactcaccccaaactgagaatctgtactttaaaaagtcaccattactttttatgaaaggagtagcctgtcatagccctgaggtgagttgggtagaataaaaatgttgaaatctactaggttggaacagtgttctgtactataaacatctgtggcaacatttttttctaagaattaaacctagaattctccttccagcagtgtcacccatcccaaactatgttgataacaagcaagccatttttttacccaacaacaaattcccaaaagagaagagatttcttgtgctatgcgtttaaaatgacaacagatcacataactacacagaataaagatatttttgttccaggcctccacattgggtaggcagaggggagaggagaacctattaacctgaatgacctccttcttttccttgctttctccctccctcccttcctccttttctcccaactatctatctatctatatcatctatctatcattgatcatctatctatcattgatcatctatctatcatcatctaccaaagcacactcccacatcaatttcatgttcacatgtgaatgcaaagacttttcacatataagtatgctgctgatcatccagcagattagtgaatcaatttaccagtcctgcaatctattttcttcccagagctggaaagaaaataaaatccacattaattccatcctatggatggaacgttacctttcattgccttctacaatgtgtaaagttcagtgaaggccctacctcaaagtttcattttggtggtgagaggtactatttgaaataaggttgctatagaaagatgcttccttctgagatgatgaacaactgacatttgtatagaactttaccttttacaaagcattttctgattaattatcataatgtctcaagtcatgtacatcagcttaaacttcccctgttttccaggcctgaggcattatgaggaaaaaatagaaatgacccggataagaagtgaggttgtgaaaatccaggaaagggacaactgctgatcgcattgtgtttggttttaatgtatatgtaaaccaaaattattctgaatacaaaaaaaaaaggaagaacagaatggttcctcaagttctcttatatcagcaaactatttaaaaaatcatgtctttgaaaatttagatagaacccagggacaaaatgaagagacagtggcaaatgggagatccaactatcatatgggtcaggaggttataaagtatttcattcttcaaattattctggtgtcctctaaatatgtccacctcaccctttatttcatttctttcactgcttggtaatatctcatttgataatatcatgggaatcttttcctcaatgtttttttctacagctctaggtagttttgacttaagttaaagatactgaaaactgtaagagagtatattatttctgaccctagcgttgcccttaaatctgtcaactagggtctattttgacctattttaaatggcatcatctggtcttccttcagctaccctcctcttttggggtgaaaagtctactgggccaatggtataagcttatctggagtttgcactcctgatccccaataagactactccgtgggaagctgggtgcctagaatgccctgtctacatggccctaagcctactttcagggcctatggaggactctggcaagtttggactatgttgccgatatatgcgccccaaggcttgaaggatagctaaaggacaactgttttctgggggggttggggtggtggcgtggtatgtcaatagagtttggctggtatggctgagtccatgtatatgaagcctctcataatatggaacagagtcagggctgggaggagaaaggggttagaacataggcagaaggtctctatttgtatttttgctctatgttccacaaacgttaaggatggccctatctgtaccaattatatttgaaaagaatgcagctttacgtaaaattctctcctgatatccccctatatgaaatctcaaagtaatctagaaaattggtcatggtatagatcattgcacctaagaagttaatacatctacctcccaggaagctccatg

SEQ ID NO: 7371 - DNA, 604 bp, artificial
  synthetic oligonucleotide
tttcctattctttgtctcatgaataattagttgagattagaactgtctgtttccctgaaactagctagaaacaaagatacacatttcctgttcagctaactgatacttcccctgattgcaacacgatcccaccagtaaatcatctcacatgtaacccatctaccccttcctaataagaccaagacaaacctccctattgcaatagcctgaataaaatcaattgttttacttgttcagtttttctctgtgatacttattgaaaaccttttcagaaatttatatacttagtttatcctatactattacaataacaggtgaaaaatataaaacgtgaaactcggtaccttctctcctagtcccagctctttctatgtgatctcaacttttctggacctaattttcttaatttctaaataaggatattggatttgataatctttaagattttaacattctaatttattgataaattacgtgggggtagttatttttaattttatttatagacattatataactcaggtctaggaataagtcttttatttgttcatatcctctgctctgtttaaagcagttgttacataatgtttactggttaaatagt

SEQ ID NO: 7372 - DNA, 837 bp, artificial
  synthetic oligonucleotide
tatatagtaaaagttaatagaaaataacccatataaaagtttatctcaattgagcaagaccattttaaagggactctaatgtatttaaactttttatattattccttgttctcaatgatatatgaaaatcatgtttgagttgtagaactttctcatccttcgcctccattccttcagcagtatttctcattacaggtcaccacaaaccaaataaacacacatgttgggttatcctgaaatgtctgagataaaagacacagttttgatattatagggtaatataatccatgttaaatagaagcattgttcaaatatattcagcttgtgtgatgaaaatataaaagagagaatcatgaacatcagcgcaggctatgatcctatactgtttacatcatcagtgacctccctacaaaatatagccgtttatttacttaccatccactggtctatgatgcccacacaaactcattatgtgaacttttagattattctcattttagataaatgggaatcaaccaaatgtactttattacttaaagaaagtctaagtctctttttatctgccactcaaaatcatattcattgtctcttagtgggtaaatctgcttcaaataggtaactggggtaaacctgaaaataatttattagggatatacttggatagactttgttttctacaatgacattctattccttctaggaatagtgctgccacaaaatacacacatttcttaagtcagtttacattttagactgcagaaccactcaagaaagtaaattaatattcagtcacaataaaatgacatccagaaaaatcaatacaatttgctaccaaat

SEQ ID NO: 7373 - DNA, 1445 bp, artificial
  synthetic oligonucleotide
tttatataccagagacaaattgttatagtgcaaagagcattggattgtttgcacaggacttacattccaacaccaaatcttgctccaagaaattttaataatttaataacacatgctccacatgaatgtgttattaaaatttcccaagactcagttattttaccattaaattgggcatagtttctattatgtctactttccagggtttacagtttgaaatgagataactagtgaaaatactttggacaatagcaaattatgcgtgcatacttatatatgtacacatgcctatatgcacgcacacaaacatacatgcatacatatacagtacattatcaaatagctaagccttttgattttgacagacaagaaaaagtatttagctacaagtgtatctactaaaacacaactacccacattaccataaaattacctaagttaatgatactattcactatggtaaatgacaaaatttgaaagattagactgtcatagataaaaacaatgattttagttgaaaggtgagaaaaatatcagattgtgactattttatgccagaagaaattcaatttacttatgaagctaatatcatgttgtacttgatattttgatagtttgaattggaaatagtcatgttagcatctatgctgtcaatgcaagctctgtgcatacatatgtcactattaagtatcttcttcagtaacaagggaccgcctagtgttttttgtatgccagatagagataaaaagttcgagttctaattgtgtcttggccagtgataggtgcttgccctcggaaatatgatgtatatttgagaaccaactttagataagagtgggaagatgtaatatcacctctactgtgagaataccaaaggcaaactttttattttattttaatcctcctcccaaaggtgaggattaataaatccccagctcggccaggcgtggtggctcacgcctgtaatcccagcactttggaaggccgaagcgggcggatcacgaggtcaggagatcgagaccatcctggctaacatggtgaaaccctgtccctactaaaaatacaaaaaattagccaggtgtggtggcaggtgcctgtagtcccagctacttgggaggctgaggtaggagaatggcttgaacccgggaggcggagcttgcagtgagccgagatcatgccactgcactccagcctgggcgacagagagagactccgtctcaaaaaaaaaaaaaaaaaaaaaaaaattccgaagctctatgtccttgttgggacttggcaacctgggaagcctgtactgttgtatgggatcatgttgttttcttctgaattatgtgattatcactgcatatttctatatactttatcattaaggcaacttgatctctgactgggtctgtttcttcttgtcactcacagcactatcctgatgtctagtgtatacctcc

SEQ ID NO: 7374 - DNA, 1629 bp, artificial
  synthetic oligonucleotide
gttaatggaaaagaggaacatcaaagactattaatttttttagctgctccaaattaaatccaagttaacttggatgagtaaagacaagtttatttttctctattattcagcaaagaagagaaatttgtaagcaaaaatatgggagtagcatttaattttggctgaaagagttttataattttaccatttagccatgtattatttatataatactgatttatagaatacttatttatatgtataatattgacagccaaagaccaaaagtaggtaatgtccacaatagaaataaaaaaaatagtaaatgaatgggttagcattttacttaggcttctactgtgaagaatactaatttgttaatgtgcaaggtgacacgttaaagtgctaaattagcctgagcccttgttgtaaaatttaggcaagcagaaaagttcaaataccttatcacatattaattgccaataattacttgcatcaaggtaacttgtgttatttaaaataaattaacagatacagaaagaatcctagttaataaatttaccaattatctgccttggtataaatatgaatttatgttctgtttttagtcctattcacatatgactatgcattctatttataacgatttctgaaaaagcagcggttggctacatgacctgtcctattttttgtgaccatcatttctttatctcttctctcaatgctttctcatagaatgaaagcatcaaagcaaatgataacagtctacatatatacaaaatatatcactaggaaataatttcttttgaaaaaagttaccccatgaggtgcccaaacaatgccatacataaaagataaacaattcaagccagccactgtataatgagatttaattgtctcccattcttttaatatgcatggacaaaaaacgcttcttttccattacctcatcttaagtagttttttaaatcaaacacatactcacgctcatgctgtcactgataatggatctcatgtcaaagaaaaagagcagaaaggacctgataataagtgcaattatcaaacatcaaaaatgtagatcaaagtggatttcctgactcttctacatgcagtcacttcacagaatttcactattcatattatgtgaccctgacaggatatattaattttctccattatgggagcaatgggataggcatacttcagtaggaagctggcaataagtagagttattatttcactgtcttatttaatggcttgtgtgtgcataattgcgtgtgtgtgtgtgtgcatgtgtgtaaaatatgctccccagacacaccacactgtgtctccagagttgacagaaagccttcagggagatgttaaccttcctatgaaggatggatccagggaaggattttatttctttcagatagtacaatatttcctctctctgggaaacacccgacctatctttgggaggactgaattatctcagagggaaattgggagtacttctagaagtttgccattctgaatcatttcaataactcaagtaatcaaatttccacttctacccccaatcccatactccttcctttccccagaactttccttgatacattttttatttgaaaaataaattcattttcttttcctaccaaatgc

SEQ ID NO: 7375 - DNA, 1399 bp, artificial
  synthetic oligonucleotide
aggatatttccaattgccattaaatataatccaagtgaagtgattcaccgtggctcaggtgcaggttccccatcaatacaatttataagggttcagcttccaaaactacacttccatttgacagtaatttccttttttattttgttttgttttaagttgactacaattttcaatcacagttatcagttcatcacctggatgaaggtgacccagcagtccttctttatctaattcctgagatgtccttagattatctttcacaagcaaaattaacaatgataacaggaaaaataaattaattcaaagatgaagctttatcaaatgccatcttctgagggctgcattttttttcattaaacatgattcaaataatcttttgaaaaaagagatctggttatccagaattatcttcttccccactgcatgactaattccacaatcttaataagtttttaatgatgagttttataaataaagctgccatcagtttgccagccaagtgtattctttcaatatttttgagatacatgtgtatttttaagaggaattaaaattttcatcaaattaattaaaaggaacgatataacattagcacggtaaacactgaaataagtattttacagctaagtaatgctaatgctaggaatgatatctcttaaatttacatttctttatgtgtggaaatgtcagtgagagttttaagagaaaagagttctcaatacaaataaatttggagaactttgtgttgaacatatctgtacaggtttctttattaaaggacttctcagagcctttaaatatgctagtatgtactctcagtcaccaagagtgggctgtggtaatcagcacttcctgaatatatgggctattttgctttggagtctagtacaaaactagggcttcactataacatattttgggaaattataacatatttgaaataataatttacttctaaacgtaagaaataatataaatcttgtttaatcattccctttaaaaattgcttgtgtacaaaataccttcgaatctttcaaaacactactgatgttctataatcagcaactttcagcagtggcagtgtagtgtgtctgtaacttctgtattggacatgcaattcagggtgattaaaccaattggtctaagccaagattaccactttacatgatcgatccataaattgtagacataattaattgaatgtgtgtgtgtgtgtgcaaaacagaaagcatggagtaaggtctatcttcttgttgtcttcctctcatgtattctcattcaaaagagaataaataaatgggagtactcagaatatatctgtcagaaattggataaaactgagtatttctgcagcatttgtaattactttcagaagactggacaagaaatgcaagtctcc

SEQ ID NO: 7376 - DNA, 1829 bp, artificial
  synthetic oligonucleotide
cttgttgattatcctagcaaatctctcttttcattttacttttcttctttggttcgaagattctctctagaggcagaagggagggctgtacatttcaaattatttttaggtctttgattaactgtgccaccagaccccaggtgactattaatatactagtaaaggcggttaaaagaagacctgaggtcattcagtgagtgaaagaagcaaaattgaaagcatgagttttgacccagtgatatgatctttctagtagaccacatagtagaggcaatccaaaagggggcaaatgggaataagggacactatctgcacaaaaggttagaagacaaagctactcagcatggaattcagaattaaaatgaaagaacttacctagtgaactttcaattcaaccatatctcaataaagctcaatcctattataacacagcacacgattataaggctacaaatgtactgcagagaaaatcctgtgtcttgaaaaataaaagctcagtaaaacaaaagccaaaataaaaaagctatcagttatgcttctcaacatgagttttataaagcggtgctgctgtattaaatttttgtctgtgaccaaaagaaaatttcttgaatagcaaatgctccataaatgcttgtccaattgaattatctaattggctaatgtcaactttttaatatttaaggatcactggggattatacattgattagctaacaagtacttcttatccagagaaaactggaagctcatgccatagcttactaggatttttgcaagaggagacaaacagtcataagattgctgttaattatgtttccacttctcatgaattgtttacttttattatttacctatgtcttgaatggtattgaagcaagccatgtaagtccctttgtcaactgccagaagtataattctctacaattaatcagtaaaaagagaattaagcattgcttctttagaattaggaaaaacctgctgctgataaattgaatgcattaagaaattaacataccagtaaatgattgatcattacaattatctgaatttgcatttctagaatttcactgaaagaactcaaaatcattcttttaagatatttttagctatgtttcccaactggatgaagtataaaagagatatcctgcttattattataatgataagttcaagagtcttttaaacatgttcacaactggacattaaataaattaatccaatatattttaaaataggaactcatacaagggtttagggtttaccagctaattttttttattatctaccctgatgtataaaagaaaaattcatctgtatgtcatgaatcacaaaggcttgtaagccacccaactactaagcatcctgattaaaaagctggagaagagcaggccacttaaataaaaattatttggcagatgcaaacatctctatacaggcagctcataaaaatattactgaggagtaaataaaatagggcaatatcatctaaaatataccattctcactcagagctgaaagtaatagcttttgtttgaggacaaacaacaacaacactaataataagtattgataacaataagcaatattgaaagataattatgtgccagacattattttagtattttgttggtttgctttacttaaataaatatttaccacctggttagtgtgtcctaggcagtgttcaaacactgggactcagcaaagaacaaaatacaaaattccttgctctcacagaacttaatctagtatgaaagacagaaaacaaatgaatacaataaaaatatactaataagtataaatgtatagttatacatatttgaacgtata

SEQ ID NO: 7377 - DNA, 875 bp, artificial
  synthetic oligonucleotide
aaaaaagatgataattaggcccactatttcgcctaacataagataagtcatttctccttcaaaggggtacatattttccctcctaggtgtctctactgattggcagtcagtggcagatgagatactgtttccagacttttagttcccgggtctgtatactttattttatataagtcagtgcactgaaggatggtgctggctaaaaatataaattggttcaaaatgtgtttatgtcagttcatggatgatagattcaggtttttgtccttggcctttttctagtctcaaccttctatacactctccctgggtaatctcatccatcccctggcatctctattctgagacactgatgagctcaaatctacttataacaacagcccagatctgttctgaatcctagacacacttttccaatcgctgatgggaaaagctacctggatgtcataccagcatcttaaacttaacatgtctaaaaagaaactcattttcccttccaaacctgctcctcctgctgtgttccttctcttggtaaattaatcactattctctcagtttcccaaacttaaaactttaaagtcatccttgactctgttatttccttcaacctcaaccagtaatcaattatgaggttctatcaattcgaacacacttatatctcttgagtgtgtctcttcatctccacagacattgtttggacctctaatgcgattcttagctctagcctaattcagtggcctcacagatttttctccctgcatcccattatttccagttgcaatcaatcttctacactgctgcctacacttctacaattcccctgtatacacttcttatcctaaaaattacaattgatcatgaaattctccactaatt

SEQ ID NO: 7378 - DNA, 1607 bp, artificial
  synthetic oligonucleotide
tgggagtgaaatctgagttctttactgaggcatagtttctgaggtcttttcagggttaggtcctctaagtaagtggcacatgtaatttgatgcctacaataaaagcatcattcctacccaagccaaaagagccaactgtaaaccaaggaatagtgactctctagagttttagaaattttgtaaactctcattgactcaactaccaatcgtttattttaacttgaacaggctcaggaaggagacatacagggcaaaaaaaaaaatgttacctacacaaatgacaactgaaatcatgtatacaaacatggttttaaatacctgcccattattctattataaatgatgtactgtaatgtttgtaatgttttcattttgttggctttcagattttttccagtctttcatcattagtactaataagaaaaggattttccttgcatatgaatatttgtctacatcctgatgatttccccttggtaattttctagttacaagattcttgggttaaagtttaatagctttttaaggctctttgtacatattgctatttactttccagaaagatgatactaatttacactcctccagaagtctaactgtgagagtgcctgtctcacaacaccttcacaaaaacttaatttatttctaatatttgtgaatatgattgtccaaaaatctgcttttaacttgtatttttcaaatgtttattttccatgtatatttcatttcatttcctattctgatctttgtcattttcctttagaggtgttcattattgcttactgatttataagagatatttatatattacagacattaggcttttgttatatatgttgcatatattttccctatttgtgatttgccttttcattctgataatgatgctttctgactaggaaaaattattggttgctgtcaattgaaatccagcatctttttcttttgtgattttttttctatatgcttatgattagaaaatactttctcaccatcaaaggaattaaatagtaaattctatttgtttctattcttaaacttttaaaatatttaactcttaaatgattcaaaaattatttaggtgttgagtgtaaagtaaaactctaacatgagattttatggtttatacttgcctcccaaatagccattttttccaagaattatttattaaatgattattttcccctttgcttatgatgttttataaaaataatattttttcaaggatatctggttcatgttattcacctctccattcttaaaattttaccacactagtaattactataactttgatgcattttattatcttattcatgttttaaaaacattttaactattaaaatctgtttattcttccaaaatgaacttcagaataatcattttaaaagtaaaggtaatttgttgttgaatttatataaaacctaggaattaatttggaatgtactgtatctataaacctataatcaactaaacagaaaaaaacatatatttttaatattcagacatcctagtcaagaacatggtgtatgtctccatttattcaaattctactttatgtttctcgaaaaaaatttggtagttctcaagaaaatataagccttgca

SEQ ID NO: 7379 - DNA, 5117 bp, artificial
  synthetic oligonucleotide
tgtttttcagaaacattctggggaacaacctgaaaacttttaaataatatttagagcatggatttattttaggaattacctgatccctttttaaatgcatatttcgactttctttaatcatgaaaagttttcaacattattttgtcatacctgaaagcttttaattactcttaaaaaccccaactttgccatagtaaattatttaatgcatcacaaaatagtgttatgaacttgaactaaaatggcaaaattgggattctgtttctccagttatgtactttgagggtcttactatgccttatgaaaattcatttttccccacgttgcagatatgaagagcaaggagcgggggtgagcaagcaagcagatgctgggtaatcatggagcagaagttaaaggtgtggatcgccttttcattaattttgttttttaagcctttccctcttagactcttccctttcttggtaacactggagtatctactgctccagatcagaagacttcggactaggaagatgaactgggctatttcagccaaaaaatataatagagcagacatttgccatgttctcctcaaacacgttaagagtagcaattgattctcacagtacattgttacctggcttgttaattataatcatagaacaagagtctaaaattcaaggaagctgtctgcgacacttactcgtcacaaacgcgatcaattaaacgctaatctaacagtacctattagagtgcactgggatgtttcgtttccttttggtctttaaaaccaaatggctactaatttcctttctgtagcactgagaacttctctttgtatttctttgggccacctcaaaaacacctccaggttggtatcccaggaaaacaacggttaagttcaggacgtttactgaccaattgcttcatattggagatgtagagcttttctacccctattagcatatcgccagtagcagtgatgcagatctgctcaacccgaagctgccgacggcgagtacgagctgcaaaccagcccccgcccccgcccctactctcccagtggcgacacagacgtggaaacatctactagtggagtgagatcctctgtctccgcaattgtaaacaactgactgcatcgggttcactgaaatgtttaaatacactcctgactgcaaacacatccactcaccaagtagcgctaacaatctccccttctccgcctctaggcaaagcatcctgaaactaaattggcaatcctcctgttatggagtggaagaaagtgaggttacatttccccaagcctgcctagcgggtgcttggcgctcgcagatatgctggccgttgctgaatctcggggaccaagtctctggatgaaatgcggaaacacacaaacccgcacattggagcgcatggttaaagtcaacaccgacggctcctggagcaccgcctgggttgtaatgactatctcttttgacaaagattgacaaaggtatagggaggacgcatcgggtggggccctcgacggcggcgtaggttaggaggtcctgcagttcccccgggaacccgggctccctgagtgaggctcaaatagaaattcagaagcaaacaggtactaaagtgcgtcctagcccttgggcatattctctgcggagacagcaggacctggaccccagtggcagagccccaggcgaacgctccagggtgggagggatgccagagaagcgcccctttctttctttttagaccgagcctcccatcctcaccccaagcacccaggtccacttgttagagtgactgggctctgcgcgagagccgaggcgaggaggctccctctcagaactgaaggagttggttggtaaaagtgccgcctgggaagcccagcgagccctcgaagggcagcgtccccagggcccgctggaagcttgaactgcgaacaaggccgacctcccttctgccccagatggtccagagccccatggccggcggagaccgggagaagaaggatgcggaggctctgccacctcgggcaggagtcccagagcggactcaaccggccgctaacagccaggagccgccatccgccgcctgcagcctcggggcgaagttcgcctgtagtccttggggtagaaggttgggggtggcgggcgggagcgagaaggaatggggtgggagccaggagaaacgcacctacctattccaagcgcaagtttcggcggcgtccccaggtgctgttcccccgccccctcgccaggtgctcggctccgccgggcgctgccagtgcccgggacttagggcgtctcggccgactcctgcgggaaacgactgtaaatccacattactgttcgagctgccgctcgggcccccgcattgctctcctccggctgctggcagcggtgctctaaaccggcggccgccggaggcaggaaccgaacctagctactattgcaccagcggacgaccgctgccagaagggtgcttgcgcccagggtcctatgtgtgtgcgagagagtgtgaatacgtgtgtgtgtgtgagtgaaagagagtgttcgtgtgtgagagagcagaaggggtgagctcagcccccggggcactcggaggtgaactccgggctgagccgaagctcgccgcgctcccgggtgctgggcgtctgctcggctgatggctgggctgatgttgccgtggccgccgccgccgcgctctaaggctggtcgcggtggtgcaaaaaatgtttctccgctactcgagaccaaaaaacctgccctgtctactgagcatgcccggtttgacagcttcacagccgaggtttttttttttttctccttttccccaagactccaggttttagccgcagctgagatgggaggtggagggaggtggggggaggaggagagggagaggaggaggaggagaaagaggagaagggcttaaggagcaagtatcgggcagaggaagggaagtcgcaatgagaaagatcagggtgttatagggtggagaggggaaggagaaagctggatatggaagcagaggaaggaaatatggatcaacaaaatttagatttcctactacagtggatagatgcctggccaggtgactcactcgatgttttttttttttttttttttttaattactttctcctgagggtgaggggtggggtggggggttcggatgagtatttgtcaaccccaggatcagcctgggacagtgttacctagtcatgacatacacaaacatcgcgtgcacacacacgcgcgcgcacacgagcgcacacacaggagcacaatcactgcttctatgttcaaagcctcaggactgacttagaatgcgaagtcttttgccagtataactttggcaaaaaaaaaaaaaaaagggcggggggagagaaattgtttggtttccttttcttattctcctctcccccgccttccagaaaagccaaaagcccgtgaatgcggtgcataagcgacccacaagctctcgtgcgtctgtcggtgagagtgcaccgccgactgcgtcctgctgacagtgtgaccccagagcgccaaggccggccggccacatgcagcctactggcggcgcatcagatcagcagtaacgacgtccacctgaaggtggttgggggaagaggggagcgctaagggatcctgccctgcctggccgcccaggttcctgggctccctaaacggctccgcccctcacccagcctggcaccagggcacgtactcgggcgaacccagcgcgctgccccaagccctggatccctccctccctcccaaccctcctcagcttcctcgaaaaagcggagaagcggaatctgcacgcccagaaactcgcgtcagaagccttagtagtccgactgggcatgctcgggacttggggcgcttcgcatggaggcactctccagcggctaacatctgtccgactgggccagatgtgagtctgaagtaggaggcttggatgcacgctagagcaggctctggttccgggaggggtggcggcgacgcccacagcagtcttctttccggcttcccacagagagcaagaccgtgggagataccaagtgccgagccaggggagctgcacaaactggagaaataggagtctagcggattcccaggcctcctgccccgcggtgccaccccagccgtaggcaggtagggggcgcgcagagcagctagggagcaccgcgtgtgctcccaagggactgctgacctctaggtaaagaaaagagagcgtgaagagtcgaacattctttgggcgaaggacgtttactgatttttttttttttaagtaaagaaagaagggcgtgtgtgaatgcgtatatgtgcacgcacgttttaaattttcctccgcaagaacagggacaggagagcgagaagctattgccgagttgggaacccgctagaggttacaataaggcaggcttggagtcgtggctggtgctagttaccgggaagagttcctcttggcgcggtgggcgaacaccaaagcttccaactgttcccttccctgggtggcggcagctgcccaaggtcggcttccgggctggtctctgtgctcctgagcagggggaccagattcagtttcagaaagagaggtagtacagagtgacgccagggggagttctctgaaccgtgtgttcccattttcccagcttttgatataggtatttgcaaagagggagcattgtaagaccatcacaccaccaaggggaggaaatacaaagagctgaacactctagggggaagaatcagggaatcaagagcacgtttattcccatcgtcccttcccaacaaggtcttcagcttcaggcaggaatcatttggatccctgcggctcaacaccctcccactcccgtcccgccccaccgccctgccaacaaagaaacaaaagatgacaaccaggctctgtaggggcatagcaactgcttctatcaccggctctctgttgggctgttgagaaagcagtagtgaaaggatgggtataaaacctgtgtcttgccacaaatatgtaaacgaaaccttcctaaaacccactaccctcctacaaaacaaaaacaagttatttgtataaacatatatagatttaagtatcctaaataaagattccacattatgaactgcccaaaccctg

SEQ ID NO: 7380 - DNA, 2168 bp, artificial
  synthetic oligonucleotide
ttaacaaagacacacacacacacatgcactcatacacctttttatgtttattcccaaaactaatgtaattacataaattcaattcagcaagtgattatggaacatctactatattccaggaactgtgccagcattgggaataggcaaagaaattgagacttaaagaagctaagaaatgttcaaagatgtgtgaacaatttgctaatcaacaagtatatactgtgtgactgttaccgtgtatctagactatttcactcctagagaacaatatttagatgttctggccttgattttttaaatatatttttaatctataggttgcattctgtgagaagaatgcataatggaaaatatgacatgtcagttttgtttctaagtaccctcataataagaatgtaagtacaataatatttgtattagtctattctcacgctgccaataaagacatacctgagattaagtaacttatacaggaaagaagtttcattgtactcacagttcagcatggctggggaggtctcaggaaacttacaatcatggtggaaggggaaacaaacatgtccttcttcacatggtggcagcaaggagaagtgcagagcaaaaggtggaaaagccccccattataaatccatcagatctcatgagaactcactcactatcacaagaatagcatggaggcaaccacccctatattcagttaccacccacaggatctctcccatgaaacacagagattatggggactactattcaacatgagatttggtgggaacacaaccaaaccatatcaatattagaagactaaagtcaatatcaattacataaacaaaatcaatgtgcaccatctgaaatgaaggagttttgtttggttgcttgtctaatggcaagatgttttcaaaggcataatttcaacatgtactcgttgtggtagactattatttcctatttcaactgataacaacaccatccagagatcaactagcagagattatgagtagtgctggcaccttaacttttggctacaatgattggaagcaggaaaggtagcttaatgattttctacccaaacagcttccataaacagggctgtaaaattgcagtcaccagcttgctgcaagggagtgcccatttccggccagctgtgggctccccctggggaaagcagccaccttggaggaagcttatttgagcctggatatgaacagttggtggccaggattctgcatccatctgttcagaacagagtcagacacactatttttcacatacccaagtaaggctcaggaaaacaactggcaagccaattaaagtcttctctttacctaatcctatttagtatccaaatggaccctgtggagctacttctctggccagagtgcgaaggagaaacaaaatgcctttaaaaaaaagtttgggctttagcaaggcactttgtattccacacagcaagttctgctcatggaagtgtacattcatatataatatccctcactggaaaggctccatcaatgctgctttaccttactctcagaataaaatacatccctaatacagactaatcataaccttcagaaaccaaagcttctcaatagggtgcagtggcaattcatttgtattattgctataatggattcaaataactgcctaaatttaaatttatagatagttttaaaaatggtaccttggtccttaatttatataaaattcacttatattcactatccatacacataaaccaatatggcaataataataatttataccctcataaagataacatagtgccttcccttgaagatctgaaagctgacttaatgctagtgtttgtctttttattggaaatacttttaagaatattactttttagcattttttaactatcacagttgttgaaaaggggaaaaaaattgatttcaaaatgtaccgtgatttctccttaagagataaaattacactccaggaaaagaacttgaaaagagtatagaacaattagtattactcggttggcatttaaatgcacttgaacttctctctaactttgtgacctcattatcataatcttttaagtgaattattgtgattgacttatacaggtaactactaatttgtattgaaataactaaaatatttagtgcttctaaaacacatgcttaataatggccataaga

SEQ ID NO: 7381 - DNA, 1130 bp, artificial
  synthetic oligonucleotide
gggtaactagttcctaatgaaacccttagactaccatgtagtctaggccagtggtttccaaacatagctggtcattaaaatcacctggcaagtttaaaaatcagaaagattcccagactctgcccccagggattctggatcagtagatgtggtgtggagtgtgaaaattcatactttgaaaaactgcccaggaaattctgagaatcaaccaaatctgagatgcgctaatctaagttatcctgacatgcataatgacagggatttgttctcagttttgtgttctttagagacaattgagtacttaattcaggtttttacagtacaaatgcatcctccattgtggatctatattgtgaatataaatgatatctcattgtcagagactaaatcttatgtttaggaaagtaattctcaaactttatgtgctttcaaatcacttagggggcttgttgaaaatttgaatatggtcctcactcccagagatttggattcacttagtttgggatggggacccagcactctgcatttttaacaagtaccacagatgattctgatacagatgatctagggagtcacactttgaaaaaacactggcttatgtagtaggctttcagtaacctaaatatgttgcctttactatatgtaatcataatttcaaattagtaattcagatgaatatacacattctcacaaagagataatcacctcttcctaatgttttatactttattcaagtccttttaaatatggatcagaattaaatgggcctctttggacttatataggacaaagttgaaaagtgccaatgaattatattttttctatctttagctttggagagttaaacctaattttagaagagtagaaatggatcagtaaggattatgtatatgattatttggctcattagaacaaaataaaatatttggattgtctcctgaacatttcactatgaactaattatagctcctagatcaccagaatattaactgaagctggatcaacaattcttatagcctagtctttcttctgctttggcgtattaataactaaaatacaacacagttccctgtcagtcctgtttcatctttcatatgatttttgttaatagtctattgtcaggctaagtt

SEQ ID NO: 7382 - DNA, 945 bp, artificial
  synthetic oligonucleotide
aaactggctgaatgtattatttgcatgaagcatactccttttttcatattactaataacactaataggtaagatgatattcttatggcatcttagtagacatccttgtaaaatataatagactaacactatttggggcattggtttcagttgtacccattagatctaatttaatttaaaaattgaacttaaataaattacagcatatttcttctatctgactattctactcttcatggaaaatcaataaactagacttggaaaatgagaagatgaaattctcagatacttttattttggaaatttattcctgtgccaacttaaaaatgtgtacaagaacagggttttaatttaaagctatacttgatgtcattgagtacattttgtatcatgatgttctgatattatttctgtgggataataaggaatagaaattgggactgtgcaatgatattgttgaattccaggttacccttgcaacatccccaacattagaacgacgaattcatttgcagtctacttgctcattcaattgtgggtatatgttcagttatcaatactccctggattttaggactaaattactttacttttaccactagaaagtggaaataacttgctggatatggtgataaaatataaggctctccatagttcagaggaagagcttgcataataccatatttcttacctgcttctcaaagtagaaattacaatgaaatgggagattatgattaagaaacaaattgacctctagatatccattgagcacatgaaagtagcactctcagaccacctgagttgagctgattcagattaaatctgatccccaaaatggttttgatagaaaggtagtctcatcaaataacaattttcaaatcagtacattcaactctctggaaaaagccaaatcattttcatctgaatttgataacaagcttggata

SEQ ID NO: 7383 - DNA, 2796 bp, artificial
  synthetic oligonucleotide
ctggaagaggccctctcctccaggaacttctgggcgcggatgtcatagaagagcagggaaccatggccggtgcccacagtgatgatgtgctggtagaagctcagcgaccgcacgcctgtgccaccctctcgagagcacaggggccggatgttctgctggcgctggcgcggatccaggaaggagacgtgggactgagagcccacagcgtacagggacaactcatcacagtaggtcaggcacacattctctcggcagtagggcagcctgatggacaggagcctggatagtgtgctccgggctttccacaggtggaagtagccgtccaaggacaccgctcccagctcctggttcttgccgctgaaggccagggcccgtaccttgcggttgctggggttggtgctggccctggggatggcctccacatccctcggacggatgtgggcatatactgggagacccacctcgctgtgccaggcaatgctgccattaaacatgtctgggtccatccgccacagagccacggtgccgtcgcgggagccgctcacagctacggtgtcactcagccaggcgactgcgaagatccagtccttgtggccatggcggtcgcccaggcacagggggtccagggtgggcagctggtagatggccaggctgttggggttttcgccgccggtggccagaagcgtcttggagggattcagctcgatggcatggatgccgcagccctggtgggcctgggccagcccggcctccttgtcccgcatgagggggatgcgcgtgatgtggcctgactgcacgtccaccacaaacagcgtattacacttggtgccgcacaccacctgcctggcgttcagccactgtgacgcgaacaccttgttgagggtgcccaggtccagctggcgctccgtcagcagctcgggcagcctctggacggcgtagccccgcagctcgccctcgaagccctggagcccggctgggccccgcgctcctacctcccggcccttcagatagtgcaccagcctgcgacgcgtcgccggccgcttctgcttcttgggtagcagaggcccctctccgtccgccgccgctaaaccctgcgacgacgagctcccggctcccgcctcgaccgcgggcgctttccgtttcctgctacctgtttgctgctgggccatggtgggcggcgggcgatctgcagcagcggcggcggcggcggcggcggcggcggcggcccggcggcggtggcggcgcgtggcacccgtgttggccgtggcggcggtggtggggatggctgcgcttccgcgtcagccgagagctcaggatctctaagaccaagaagctggtgcgatcgcgggcgcccagacttcagtctgaggctcggcggcggcggcggcggcagcggtcgtcctggccagagatgcgcggcctgacgtagcagagccggggcgaagcgcggcggcaagggcggcagtggcggtgcagacctaggcgagagcgggaagagtgtctgtctggatggctgcgggagcgaagtcagtgtggggggaggacgacgctggggcccgagtgtgaagggcggaggcagtgggaggagctgctgggctggcgtggggtgcctgccgggtagcggaggccgcgcggggtggaggctggaagggggcggaggggagaagggggtagcggagctgcaggggcagagtcgcggagggccagcaccctaggtccccagtatcagacatgcgttgtttcgctaccctcaggacaacagctaactacccttcttaaaatccgtacttcagtaaaatctgaaacctaagatataatcaagcacggggctagaaggaggccgagccacggtctgcctggagaaaccagtgtgcgcttggtgtaatcttgggacacccttcgcttagattatacattgaatttggcaagggatcgggtgcgggggtgggggggtgtggggttcagcagcgtcagggagacctctaccctcgtgtcagacctgcagcttctccagtttcagctcctgggttgatgtcttaaacagtttccaccaaataatttttttccccttctcaaactgaagtctttgagcacctgaatccctgagcatttgaactgcgttccaaatgcagttccctaggccctgctttccacccgggtggtatcagggaccctttagtcagaaagcagcctcaggagcatccagggctgcagtgatgataggggtggagacatgggggtgaggggtgaagagaagggtttttctgtaaggcattgagttctttcgaactcagcccagggcgggtggagtgaaggggaagaggtccaggagaggggtacctccctctctctcctgggacggaaaggtcagcccaaactttcagtcataggaatcttggcagagccctctcttggtgtgggggcccccttgggcattggtacagtactcagaggaatgcacaggatttccacaggcacagatgataaagaactttgcaaagtgactaaatggcaaaatggtgagagtgtggatattcaaagcatgagtttggcagtctgagaagttacatgatccacacctgctctaaagctttagggcagtcaatcctaaagcaagcccccaattccacagtaataccttgcactgaaatgctggtggctgataccaggtctgcacaggccccaatcgtcctccacaaaaaaagtctttgttaagcgtgtttgcagaagtcaggtggtgagttaactgtccttgatcagagatcatgaaaatactttgttgctgtttccccccaa

SEQ ID NO: 7384 - DNA, 1241 bp, artificial
  synthetic oligonucleotide
cttaactttacaaagacaacttggtagcaatgctaatagggttttgtgagtgtccgctgtattgtgaaacacatataaacaccattatgaaaactggcacacatggggataaattatttgtagtaagagctacttgtctgttcacatacagctcatcaatgtctattttgttgccaacctaaagatgaatattagtatgggaagaatgtattgtaagaataactttaccgcatgctagtagatcaccaagtggaagttgtaaggtttattttttgaagcagccagacttgggttccttttgcaaataattgtcaatataaatatcgacaaagaacaaagaactgatcttttcttagatttagagcatttcttatcagttgatagttgtgaaattggatagactgaaaataggccatagataatgctccgatattagctaggtacataaaagaagacctggagggagattatgtccataaaattgattgagaaatcattctattccatgctctgaaatgttttaaccagatatatatgcctagttgctattttcccaactttcaataccatcttactcctagctttaaatgcataatatatgccaagccatctcaattttgtatctctatcccaaacctgtttgttcaacttcctgcttgacatcttggctaccaaaacagaacttcaaattcagactgtatgagctcaagttattgatttcagtccccatatacttgagcttatatagttccctgttttaatgaatagtatcgccatccatccagctgtacaaactgaagtcctagcaactatccttgacacacattttttgtcttcaggttcaatattccatcttctaccatttctcaaattcatttaattctcagtatttccacagctaccatcctttcccaagccaccttcataagtgattttcctaaaactacgcttttcctcctccattcaattatccaggctgtacccagagtaatgctcgcaaaatacagatctgcccatgtcactaaaatgtttttaaaaagataatgttttcctgttgtcttatgataaagaccaaaatcctcaatgcagcctaccaggcccagcatgatatgtgacttatgttctacagccacatgtcaattttttctcattacttttttgatccagccacactggccctttttcatttcctcactgatgtgaaataacttcatgcctcaaatcccttttgcatgctgttc

SEQ ID NO: 7385 - DNA, 1096 bp, artificial
  synthetic oligonucleotide
atacacagagatgattggaacaagttaaaactgttgcatacatatactatcataagtctcaattatatttcctgcaatgtgtaaattagcccaagatgccacattgaagttcaactatccacaaaccctttagaccttggcaattaacagtcttgacaacactgtgtcattaagcaaaactggggcaggtggtgactctcagtatacattcaatatgcagcatgaatgagtgaaaatattgtagctctttgggagcatcttttacagtcatattgagctttacttgtccatgaagttattgctttttcttttcatttaatatttttaattgatgtgtaataattgtacatatttatggggtacaaagtgatattttaatatgtatacaatgtatatgatcaatttagggtaattaacatatccatcatctcgaacatttatcatttctctgtgttgagcacatttcaaatcctctcttttagatgtttaaaaatatacaataaattatttttaactatagtcagtgttatagaatacttaacttacttctactatctaaactataatttaatatttgttaaccagcctctcaatatttcccctttccattcccctttccatcttttaacaaccagtactctactcgctacatctataggcactttttttttttttgctactacctataaatgcatgtctttctgtgcctggcttatttcattcaacataatgtcctccaggcttatcaatgtttgccccaaatatcattgtatttgtatatcttcttttgagaaatgtctcttcagatcatttgctcattttaaatcagattattattattattttttttgctgttgagttccttgtatattctgtatattaaacctttgtcagatatatagtttgtagatattttcttccattctgtgggttgtctcctcactctgttgatttgagagcattgaaaagtgattctattaacaaatatttttaagttgatatggaactttaaaaatgatgcagtgattagagaatccataaagtaagtcccttctcctgtcttatgaatgattgagctaattcagcatgcatatgc

SEQ ID NO: 7386 - DNA, 291 bp, artificial
  synthetic oligonucleotide
tatgcaggatccttccagaagagaagagggatcactagtgtatcacaagagcctcagtgtctgacatataataggctttcaataagaagtagttcttggatgaattaatggaatgagttattaataataaaaataatgttaaaaaacagtgtataaacaaatagacacatttctgcagaagggtttttgagaatgaagcccaatgactagagattaatgatagattttccataaaagttacctgcagaggcatctaaattggaaaggaacaagtaaaattatctctgtttg

SEQ ID NO: 7387 - DNA, 463 bp, artificial
  synthetic oligonucleotide
gcttaactgacaagcctggcagaaaaaaattccatacagaatgctgtgccaatggcaattgttttgttctcaatgtttttgtcttgttctcagtacagctctgactgttggtatttgaggaaaatgccaaacccttcctttcctccttttctgacatgtatactggatacccaccatatattcactgaattatgtggcccctctcagaaatattgaagcccccagagtgtcattaaccatgatctatggaggctcttgtcagaattagacaaaaagtaaaattatagctgtgtgttggtgccagtctagttaaaggtctgtcatctctgccattataaacctctatttcctgtgctttacaactcagctgagagaatttgccttccagtcattagagtagctgagagagtgtcaatgtttcaaatatatatttttttaatctggaagacaataaataaaatct

SEQ ID NO: 7388 - DNA, 1898 bp, artificial
  synthetic oligonucleotide
ttaagctgggctggttccacctggaaaacaaaagacgcacagagttaaaagcaaaaaaatgcagcatgaagggcagtcgggcggaactgaaaggtaaatctgtgtacctggagtacaaggcggtcatccttagctccagaggcctgcatagttcccatggaggcctgcagggagaggccccccagccacaaagagcttcatctcaggccagttgtagcagtgggtgtagagcgcattgggaaacacttccatgccaccaaagtaattcacccagaaatcattgtggttgagccagcctctgccacaggcaagcctgagcttcctccttgcaggtcccgaagaggactccagggtggcggaggctctttcctccaggaatttctgggcccggacgtcatagaagagcagggagccctgaccggtgcccacagtgatgatgtggcggtagaagctcagcgaccgcacgcctgtgccaccctctcgagaacacaggggccggatgttctgctggtcctggcgcagatccaggaaagagacgtgggaatgggagcccacggcgtacacagacatatcatcacagtaggtcaggcacacattatcccggaagtagggcagcctgatggacagcagcctggatagtgcgctcccggctttccacaggtggaagtagccgtccaaggacaccgctcccagttcctggttcttgccgccgcaggccagggcccgcaccttgcggttactggggttgatgatggccctggggatggcctccacatccctcggacggatgtgggcatatacggggagacccacctcgctatgccaggcaacagtgtcatcgaacttgtccgggtccatccgccacagcgccacagtgccgtcgcgggagccgctcacggctacggtgtcactcagccaggcgacggcgaagatccagtccttgtggccatggcggtcgcccaggcacaggggatccagggagggcagctggtagatggccaggctgttggggttttcgccgccggtggccagaagcgtcttggagggattcagctcgatggcatggatgccgcagccctgttggtcctgggccagcctggcctcactgtcccgcaagaggggaatgcgcgcgatgtggcctgactccacgtccaccacgaaaagcgtgttacacttggtgccgcacaccacctgcctggagttcagccactgtgacgcgaacaccttgttgaccgtgcccagctccagttggcgctccgtcagcagctcgggcagcctctgtaccgcgtagccccgcagctcgccatcgaagccctggagcctggcggggccccacccgcctacctcccgaaccttcagatagtgcgccatcgagcgatacgtcgccggccgcctctgcctcttgagtagcagcggcccctcaccgtccgctgccgccaagccctgcgacggcgagctctcggcgtccgcctcgaccgcgggcgctttccgtttcctgctacctgtttgctgctgggccatggtgggcggcgggcgagcggcggcggcaaggcgttggtggcggttgcagcgcgtggctccggagtcggtcgtggcggcggcgtggatggctgcgctggaaccgagccttcggattctgaggcgcggcagtggcggaccgggtgagggacgcgcgggagagggcggcggtggcggtgcagacctaggcgaaggcgggaagtgcgtctggccgggcagtgagagcaaagtcagcgtgcggcgagatcgacgcggggggccgagtgggaggggcggaggcagtgggaggagcaggcggtcgggcaggcggttgtgagcgcgtggggtgcctgaggagtagctgaggccgggcggggtgaaggctgggagggacagggagg

SEQ ID NO: 7389 - DNA, 212 bp, artificial
  synthetic oligonucleotide
ctgttgaaaatgctaatgatcaaatgtggtaagaattatctacataacaagtggctagacatgcttatctgcagtataagtgatgcccaatgtagaactttatgtttacttatgcaagggatgagaagtctcatcaagttgctgccagtaacttgttctgaacatttttttttctattggaccactaattaaataataatcataatcataat

SEQ ID NO: 7390 - DNA, 2385 bp, artificial
  synthetic oligonucleotide
tattatttcatatcactgcaagtgagtctacaattatctcaaaagtaattatttagttagaagtcactgaaaaccagttagaagcaattcacaagaaaaaatttagttttttcaatgtacaaaaatcagtagcatttctatataccaacaagtgttcaagctgatagtcaaatcaagaagacaaccccatttacaatagccacaaaacaaataatatacctaggaatgcatttaaccaaggtggtaaaagacctgtacaaggagaactacaaaacattggttaaaattagaaatgacacaaacaaatggaaaaacactccatgatcaaagattggaagaatcaatatcattaaaatagccatattgcccaaagaaatctatagataaagtgctactcctatcaaactaccaacatcatttttttacagatttagaaaaacaattctaaattcatatggaaccaaaaaaatagcccaaatagccaaaacaatcctaagcaaaaagaacatagccagaggcatcacattatctgacttcaaatgatattattagtctacagtaaaaaaaaaaaaaaagtatggtactgctataaaaacagatgcatatactagtggaacagaatagagtactcagaaataaagctgcacacctacaatcatctttgaaaaacttgaccaaaattagcaatggggaaggactccctattcaataaatggtgctgagatagctgtctaaccatatgcagaagaatgaaactgggaccctacctttcactataaaaattaactgaagataaattaaagatgtaaatgtaagacctcaaactataacaaatcctagaagaaaccctaggaaatactcttctcagcatcaaccttggcaaagtgtttacggctaaatcctcaaaagcaatcacaacaaaaacaaaaattgacaaattggctgttcacaagctctttagctaactaagagatgtttagcttactaagctaaagagcttctgcaaagcaaaataaacgatcaacagagtaaacagaccacctacagaatgggagacaatatttgcaaactatgcatttgacaaaggtctaatatccagactctataagaaacttaaataactccacaggcaaagaataaaaaaccctatcaaaagcgggcaaacacatgaacagacacttctcagaagaagacatgcaagtggctaatgaaaatttaaaaatgctcaacatcattaatcatcagagaaatataaatcagaacaacaagataacatttcacaccagccagaatggctattaataaaaagtcaaaaaataacagttgctagccagcctgcagaaaaaaagaaatgcttatacactgttaggaatgtgcattagttcagccattgtgggaaacattttggtgatttctcaaagaactttaaaacagaacgaccattcgacccagcaatcccattactgggtgtacaccagagggaaaataaattattctaccaaaaagacacacacactcatatattttcatctcaatagcaaagacatggactaaatttcagtgaccatagatgggggattggataaagaaaatgctgtacatatacaccagggaatattatacagcctcagcaagaatgaaatcatgccctttgcagcaacatggatgcaactagaggtcattatcctaagcaaattaacacaagaacagaaaaccaaatactgtatgttctcacttataagtgggagctaaccattgggttttcatggatataaagacgggaataatagacactgtgaactattagaggggagaggaaagaagggagaaaagagctgaaaaactacctattgggtactatgctcactacctgggtgatgggatcatttgttctccaaacctcagcatcaagcaatattatcatttaacaaacttaaacatgtaccccctgaatctaaaataaaagttgcaaaaatagctactggttctttttaaaaattttttttaaatgagacaaaagttttgctcacccatagcatgcttcacttctaactgtattttcaaaggattgatagagacatctcagaagcccaagccagtaattactgacataagataaagtggtgtactacttaaatatgtgttttacccatctctattgccataaaaatatttcaaaaatccaaaatgtcatgttttcaagttattctcaaagccgctggcagttgtaactgttggtaacattgattcttagtctgaagtctttgctaaacaacttgaacatggttctgggatttggcatgtaggtctgttagctcttttcaatgattttggatgacatccaagccaactcataaatgtaatattcagaacatactccttttt

SEQ ID NO: 7391 - DNA, 935 bp, artificial
  synthetic oligonucleotide
gggaagttaaacccgctagcaaagaggagccgggtgaggtgctctgtgatgtccctccctgccatacagagtttggtgactgcgtgaggcagggagtaaccctcaaagatggggacagtgcaagtgaccccatctccactgtccaccaccaggcctgtgacacaggcagaggcatagagcgctgccaccgcatgattagacaggtagaaaccaggcacactgaaggtctcaaacatcatttctgctagcttttctcgaatttccctaggattcaaagagggctcggtcataagtacaggctgttggctgggttttactccaagctcccgctcaaagagatgtttccagagtttctccatgtcatcccatcctgttaccagtccacgctcaatggggtagtgcaaatgtagggcctcatacttgtacagggcttcttgccccacgaagtacttctgattaagtcttgctaaaggcacattgaatttacaatgtcccaagacggagctgatgacatggcggggtccaatctctccagacaggcctgctttgcagagtcctgaaccattgtcaaaaattacagcaggaacatctaatgcatgtggattaaacatgtctgtaatatgttctcctggacttcccccaaataaagaaagaacacttacgtcactctctgagatgacaggcacctttagaattttttaaacttcagggttctgaagtttcaagttgtcacccatgtacagctagtaggctaccttcagtccaccaggacaccccatcctcaacctctgaatcttatctccattctgtaggctcagggcctgctgaggcaacatgaggggtgattgccctctatgtcacaatccagccaaggcaacaattgtcctcagtgagcatcagaggggccgggtggggcctctgagccaatagtactc

SEQ ID NO: 7392 - DNA, 1000 bp, artificial
  synthetic oligonucleotide
aacactataactataatataattactatgctctataacaaagtatagcacaataatataactcataaaaatgaccataactatataataaaaactataaaactataactacacttgtaactaaaattgagattcaatgcctagagctagtataactagacctatgattctacaacaataagcataatttaaactagcaataaccttataatgatagcactattagtaacaggatcactataaaattataacactcaatcacactgttactgtaataataacactctatagctataatactataacactatatttgtatctattactactacaatatacattataactgtaacactaatagtataactccatcaattatagtataataatagtaacactttaactgcaactgtagttctaaaaccataatgctaggctaggcccggtggctcacgcctgtaatcccagcactttgggaggctgaggcggggggatcacgaggtcaggagttcgagaccagcctggtcaatgtggtgaaaccccatctctactaaaaatacaaaaattagccaggcatggtgtcacgcacctgtagtctcagctacttgggaggctgaggcaggaggactgcttgaacccgggaggtggaggttgcagtgagctgagattgtgccactgaccccagcctgggcgacagagcaagactctgtctcaaaaagaaacaacacacaaaaaaaacaaaaaaaccccatcataatgctagcactactactataacactttaactgtaagtctaccactataaatataggtctaacactataattataatgttagccatataactgtaatgccaaactctaacactttaatcataattgtataaatatagggaaaattgtataatataatatgccactaaccatgtaactataactatagttacaaatatgttatttataactataaatattgctctgaacctacaactgtagccaaaa

SEQ ID NO: 7393 - DNA, 1313 bp, artificial
  synthetic oligonucleotide
cctactgtggttataagaggactgactccacatgaattggccttcatttcttaggcccaaagtgtctctctcacatgaatgcatgaatggcaggcctaaaagaaaaaaaaaaaaggaaaaattaacccacacaattgattgactcaacattggagggataaaaagtaatacatacttagattcaacttctgcctgccccaaagtacacaccaggaacccattgcttgcattgacaaatctcttaattagaagatggtatttgttctcaattagagaaacagattgagatgctccctttaaagataaaaccattgaaaagtgtgcagcagtttggtggaaaaagaggcaattaggcatatcacctggagactccttgcatttgcagcagtgaatgcgtaaacaaaacaattactccactcaagagatacttcaccatggctcagagagagaaggggatgaatcactgctgatgagtatttaagaaatgtcccctgagattaattcctatacacacaaaaagataatcaccgccatccacattaccttggtatacttttcctgaaactacactgaatttctggaaaataatatgaagatcatacttagaacacaatcagaagcaagcacttttccatgaatttactgcagcaaagaatactattttactcaagtagcccaggtgttttgtgtcatttcattaattcattcaatgagtagcacttattttgtgcacaactctactaaacacacaagtgtactcaaatatgtaaaagaataatccactgtcctccaggacctcatttgcaaaacatttggcaagatgttccattagaggaaaaaatcaagtccatgtgttacaaaatgtgtgctggggagctagtgtgtgtgtgtgtgtgtgtgtgtgtgtgtgtgtgtgtgtgtgcaggaagaagtctaagtctgagaatcatcagaatacattcttagtaatatgttggagatgagtcatacactagaccttgataagagtacagactttaaatttggctgcctttaaaagataccaaaagaacccattaaaaagctgaaaatccaatgacatcattacatctttttgtctatatgatgtaaaatgttcagcctaacattttaattgaattttattgtttattctatcacacagcccaccctacctttttggctgaatccaataggataatgaaatatgttttcagtcataactaacttatttatatagggcattcctgtgtgtaggcaacatgtgataacaggagctctacaaagatctgttgtccaggacaaataattcttca

SEQ ID NO: 7394 - DNA, 968 bp, artificial
  synthetic oligonucleotide
tatcctgaatgattatctcctgaaaggagatagtagttggaaatacagttgcaagccagggactgtgggctcaggatagtggtgtatctgggattgaaagaactcgctaacacacacagaaaaaaaatactttcattcttaagtttgcttcaggctggccttatgggatatctcctgttaaaactgccccattactaaatagtgcatctagttatctgggtttaaaatacactgtgggaaactgtcatgtcagattgttttctaagttgagctacatgcttcaattcagattgtagaggaagctctgtagtctaatgctgtcagacactagcctctggctattctaacaatttagatattagacccatattcacattcataaaatgaattcaaaaatgcatgccaattatcttttcttagttatgtaaaatgctatttctggtagatgggaagctgtggttgtcatattctagggttggttcttcagcataatttcctctcttcaaacagataatctacttacttatactaaactaatttgctctattccagaaaatattctatcagtaagatttattcatagagtgagatataccagaaaattgaagagaatgacactgtttttctattcttgaggtttcatctcatttcacttttacagagactgtgaaattcaattcactgtagctttcacacttttttctaccatttgccccatctcgtcttctgcattcatatttcctctaatttctcctggagatagagaataacaaagttggagaatgaaggcaagagggtggtggaggattaagagtaattgaggactagaactatccagttgctctttgtttcatcacagttactagcatcagtggttttcaaacattattctgaagatatcccaagctctcaggagagacttagagttccacataatacccaaaaatgggatctgaggttttaatttt

SEQ ID NO: 7395 - DNA, 4442 bp, artificial
  synthetic oligonucleotide
ctatcttaagtgttggataattgtaataatcaaataatgataaaatatcaggtaattacaatgtaatataatcaaggagtgactattgaatcacctttgccatatcccattggtagaagcaagtcacagcccacacccatgctcatgggacgatattacacaaaagtgcagacatcagggggcagaatatcattggagcatacaataatatctactacactgtccatattcaaaatttccaataatgtctttctataattcgggatcttattcagaagtacatgtgttttttacttgtcatatttcttccattacctttaataagaacatttttccaaacgtgtgtgtgtgtgtttgtgtgtgagtctttgatgatgctgacagttttgaggattgcaggttatttgttttgtagactattctacaatatacgtttgtcttattgtttctccctgagtggattcaggttgaacatttttgcaagaatattacataggtaatgtactcttctcctctcagcatcttattaggaactacataatgtcagtttgttccatattgacgattttctttgttcatttagttaaaagtggcttcagccattttccctaatgtgaaggaattttttttcattgagagtaatctttgaaacaatgtagtatcctactcctcaaaacattttaccatagagttttagcattattgataatcctttccataaccagtcattaaattggtgattgcaaatcaagattttctaattttatcttttcttctttaacataatttgatattcttctataaagaagatatatccccttctcctcccatgctacctttttttctgtgaatgtgaatactcttatgaagtcagaggtttttttaattcaatgtgttataaatcagttttgtaaattttcctaactttggcccctgagggccttattatgttggcctctacattcttttgttatgtttcctcagtttttaagcacttccttactttctcccataagttatttgctccaagctgaccttgcactttgcctggaattagatatttcctcaaggatcactgacttctggtagcatgttatatttggacagaaagatatggttgctgtatgtgttcattgctacttggggtgttaccccattattacttaccagatttctcgaaaacaaacgtgttttgtattcacacctgtagctgttcactacacccacttgaaatagactgaacctgactaaaatgcctgagagaaatatgacagtcaatctctttgcttcactgtgatctctaacaaacaggttattgataacttctgtctcaattatcacagaaattttaaacccagtgatggaataagtggtggtaaagaagaaaaatgagataggaagagaggcaagggagaggaagagaaggagaaataaatatatgcaagtgtggaaataaattttgggtgcaccccaggtctctgccttcagataatcactatttctagtggctggtaggtgatctaatcttagatacatggttctgcctactatctctatctccagccctgatttgtccctggaaatttagacttgtgtatccaactgcctccttttcatctctacttgaatggtaataggcttcttaaacataacagggaagaaacaaaaatatttcctccagcttcctcatcatagcaaaatacaagtctttcacctgttgctcatactacaaacttagaaataatccttgatttctctttcctccacctcctatattcaattcagtaagattcctagcagcactatctcctaaatatacacttaaccctgcctctgaatttagacttaaccctgcctccactgttaaagcctattccagtaatttagattatgatcatctttcacctagaattctctagttgtctcctaacaagatttccagttttctttcttgttcacctaaaatccattagccacaaaaatatagtaattgattaaaaatataaactggacattattctctgacttcaaactttccaatggttttattgttgtccaatcaaattcagactgctcatcttggcctacatggctatacgtggcctcattgttcttccttttcttcttgtttggtacaatccagccaaagtgatttctttgattccttaaacatgcctgtttctcatatcagagggtctccctgtttcctctacctctactcctatttctctgcatggctgaattattcttaccatttagaccttagtttaaatatcaccttaccaaaaaagcctttgaccatccaatataaactagggacttccagccaatctgtcttgtcattctattatttttatcatagctcttgtcaaaatctgtacttgtttaactttttacagtctgattcacccccactacaacgtaggggccacaggaacagagtcttcgtttgttttgttctcttttctatccccagtacttagaagagtgtctcatacataaaggtgttgagtaaaatatgtcaaataaatacatggaaaaactaaattaaaacagcaaatatgtgagggatgaagtagagtgaagaacaacttctgggtacatattatgtaaattgtgttgtcaactgagatgcatatatatatatatatatatatatatatatacacataaaacttacttttctctttcctcaagattcttcagaaacaagacaagagccatcactagtatatcctggcacagtttgatatatatatatcaaggggagtttattaattattcacttacatgatcacaaggtcccacaataggctgtttgcaagctgaagagcaaggagagccagtccaagttccaaaactgaagaatttggagtctgatgttcgaaggcaggaagcatccagcatgagagaaagatgtaggctgtaaggctaggccagtctcacctttcacatttttctacctgctttatattcactgacagctgattagattgtgcccactagattaagggtgggtctgccttccccagcccactgactcaaatgttaaactcctttggcaacactctcacaaacgcacccaggactaatattttctatccttcaatccaatcaagttgacactcagtattaaccatcacaccgtataaacagattcatgttaggcaaagggggcaggtggcagtggctattacgatgaaaattcttgaggtaaggtgggctttttgccagctattctcaaattgcatcacatagatgatcacacttacatcacccactgtcccttgcagccctacatggtaatcaggatgccccactctcttttggagagctattaattttatgactaacaattagccaacctgtttgggaaaagagtcttttgtgactattcttcaattgaattcatttagcatatgctcaagatcatctttcaaaataagtttgccccaatgaaaagtacagaacaggagaaaacagggaggaaaatatttatcccgtttacctttaaggataaacagaaacaccaccccaaaaaatatacattgtagagacctaagtatttgttatagtgacatagatttatatttcatttatatatttatatctcatttattctgaactaccccacagaatcagtaaagttatttgctatttacagagaagaaaatagagtccaagctgttaatttatttccaagacttcacccacatctacttgtctgcacagccgtgtttccaatctgtatgttttgcttaaaaatttttgctctaccagctatactatactgcttcaataaggggtagcagaatatctttaaggtggatgaatatataattaaaaggaaaaaatggattttaactttcaaggaaaaattttctctttcctcaggattcctcaaaaatgagacacgagccatcactagtatatcctggcacaatttgcctattggtgggctctaaacttgtcaaatctcctccacaaaacacatttaccatgaccaattctttaatgattccactctgaatgtcaaggatttgggacagtgaagtaagtcagactttgctctaatacaatgagagaacaatacagaactcagcataaaagggactgtttcagacccatctagaagaatttggttgctgaagtagcacaaagatcttactgggaggttatctgtcctatgagaatggcatagccccaaggactagatttgagtgagactctggaggatatctcaatttcattaaaaatatgttttatagtcttataactttccaacgttcaaaaacaaaaattcatttctagctgaaacttgatgtcattcttttctggctggaaagtgaagatttggggaatgggtgaaagaaatttattaagttgttaaaaatatatgatccaggtcttgtctagttttcacctcccgtgctcataaacac

SEQ ID NO: 7396 - DNA, 760 bp, artificial
  synthetic oligonucleotide
gactttctggagatgagtaacatattcaccagattttaaaatgtgatagtaggaaaggatttaatatacctaattatattgaggggttctttcatgccaagagctgttgtaaacatgctatgttataatgcatttactcctctcgacaaccctgccaagttggtattattattattactttactgatgaggaaatggaaacatagtgactttgttgaattcccccaatatcctatagctagtaaacaacagagttgggactcaaaaccaggttttactcattcaaaggcctaaagctatttcatgtactatattttaataactaaatcacatagctatctatcttttgataactaaccaaatattttcatatatatccttaatatctatatattatataaattgatgaaattaatgaaaagaaatatgacctatacattaccttttaatatcaaaaaggaaaatttctataactatctattccaacaaaccaacaagaacataagaaaatcataacaggttactccaaaagtaagtaaataccacttttattttccatctcttccttaacttcaaaggctgagaaacaactgaacaatggctatggagtttgagggagaaagaaaatgacaagataattgcatacccagccaagctattattcacctatgagagcagcagaaatatatttttagatatttaaggatgataaagtttactacttttcaacttagaaaaagaataattctggttgatcaaaa

SEQ ID NO: 7397 - DNA, 356 bp, artificial
  synthetic oligonucleotide
gtgaactgggtacagacataggatatactataacatcataaaacaaacagcagaatctaagccatccacacttttatatcccagcagtagtggagttcttcatcctttatctacctaaatcttctatgctgcacttctcaaaatatacttggggataagaacaatatatacttggaagacaaagaagaaagttttaaatacaataggaaaggaatgaaacactgtccatttgccttgtataggagtaaatgaaacatatggacagagtttaccaagctcattatgagcaatatcaaaagaaatagcataaaaatgacaaaacctccttttaaaatgacaaatgaaagtaatacaac

SEQ ID NO: 7398 - DNA, 1308 bp, artificial
  synthetic oligonucleotide
atataatccatttcactattttcagatttgtaaaaatggtgataataataacagctaccttgtatagaaaaacttctatgttttagacataatctaggtgctttacatttattatctcatttaccctacacaattaccctactttgtggaaagtattgctatccccatttcacattaaggacaaagaggatgaataatttctccgaaagtccacagtttacaggtgacagtgtcaagtaatgagatatacctagctatactgagatcaaactctacagcttatactttacttcatgtaatttcatgctgagaagagatcatttatactcaatgtacttgcaaattaaatcaaaatgtaaatgcatcaggggagaaaatttaataacttttcctcataaccaaagaaatattattttattgtaacaaatgagaaaataaagacaaaaagaaaataaatactacatagtgattggaaagaaatataagaaatttattattttgtatgcttcaggataagagaggtggaagaaaaatagtgatactgatattatcagcaatgttttatttctgttatttacgaaaaggatttgaaataaagtaaaataatgttaataattgtaagttttaggggcttatacaaagatagatggtatagtttttaacttcttaaaaatttggaaaaattaaattttccagtagtttcaatgcccaaagaaaataacttcaaatattttggcatatatcgatccagtcactagacacacacacacacacacacacacacacacacatacgttcacactatacgatgcttgtagcctatattttcgcttaaccctacgtttgaatatctttcccattttaacattatttttaatggtttcatattactttacatgaggcccctattattggatatttataatttttgagatttttcagttataaacaatgcttaaatgaatattctttcaactgaattttgtccacatagccatgattatttcattagcataaattcctcaaagtagaatccaacaggcaaagcatatgtacattgtcaaggcttttatatcatattaaagcaaactataatgtaaaattatagtgtatgtatacatatatacacacagacacgcacacacatatatgaagaaagaaagagagagagaagtaaatccctctttaaagtttcctgttttatcttttgaggactcaaaatattcacatatcacattgcttgaagttaggtacctgcagtgctggcctctgactctcatgaagagcttccccaggtgaaaggcaagc

SEQ ID NO: 7399 - DNA, 952 bp, artificial
  synthetic oligonucleotide
catccaagctactcttcctttaattcacgctctagattttgatgagatattcagatcgtcttccattaactatgactgataaaacgttttcttctgaaaatagaaaaaagtaagtatcattactgaaaatattgaggtctaagatgttaagtatctaatagttctaagtactatgacatgctttcaggcaacatccagaaaatagcttaaacaccattcattcaataagcatttactgagtacctacatggccaagctctgatctactgtatcactggacaaaacaaagtacctgacctcaaagaacttatattctaatgaggaaggatggaggcagctatattcaaataaattaaatcacttgttttagctgatgatattcaatgctacatagaaaaaattcacaggggcaggagagtgggatgctgatttggagggggtgcagttttaaaaataaggtcaggaaaggcttcactgaaaaaatgagatttgagcaaagacctgaaggagatgagagagtgaaccatgtggatatcgggaggaagagtttccaggctgagaaaacagcatatgcaaaggccctgacaagtgtgcctgatgtatttgcgaaaaagcaagaataccaatataactggagtggaaagattaagagagacactaaggaggggaggtaaaagaggttatgggggcttgatcatgaagatcattttaggccatgtaaggacttcagggtttactctgaaatgaaagtcattagtgtgtgttcaacactggaaagtcatgatccaaccaaggtttgacaagcagactctctggttgttgttttaagaacagttggagcaggagaaaaggtgaatgtaggaattatttgaaggctatttcaataatcaagaaaagggacaatagtcatttgcaccagtatagtagaagtggaactaaagagaagtaggta

SEQ ID NO: 7400 - DNA, 1673 bp, artificial
  synthetic oligonucleotide
tgacactcctcccattaagctcaatatgagtcagcattgatcatgggctaccaagaaaagctaatgcaatctaaaatatggtattaaatgtatggtatttaaggaagataataaagctggttcattatcctctggtcaaactatacttgaggtattgtattgacttctggccaccactcctttataaggatgtgcaccaactgggaaagtgttcggaagagggggatcaggacagaagcaattgagatcttgccagataatcataatggtaataattactacttattaagcacttatcatgtaatatgcttaatgctttacatgtataagctcacttagtactcacaaaaagagcatggctactctctgaggctcagaggtattcagtaacatgtctaagttcaaacagtaaataagaggtggtgccaaaatttggaccaatgtcttgacgattctactgtactatgttggacttttaagagagaaaagatcatttatcacatgccaacactttacacagattatctcgttgaatcctcataacagctgtataaggtatcatttttacaatctatatttcacaggtaagaaaacagaaacttgcagtggtttggaacctaaccaaggacacacagctagcaagtggcataaacaaaatatgacataaagaatggctggagacactagagatgtttatccagaagaaggaaattctagaatattatttgaagatgtaagtttgaaggaaacaagttcgaactatttgtaccttccgacgttgaaattataagatcaacctattatgctctgtacattattcatttcctttaccacatatgcatacatgtattgatttaacaaattatgttgcactactgcatgcaataaactgtgccatgtactgaacatgtgggtgtaaacaaaacagataaggtacctgcccttaggaaacttagattattattctgccttctcttacttcaccttctgccatcctatatttttcacccccttcaaaactcaaactcacctcaaaagtcacttttccctaccccaggaatcttcagtgatagattcactgctcttccgcccctgccccctataaccccaccctcacaccacacacacacacacacacacacacacacacacacacacacacacacaatgcttgcattcctttatctttcttgtattctattactttgctcttattgttattggtaatgatatatttcccctcattcattcctttgctcaattgttcactaattatcaagcacctagtatgtgccaggtggtgtcctgaggactaaagatgcgatggtggtcaagaatgacattacagtattattttgccttctcagatttattgtaaacttacttttatctttttgacctaccttccccactccttatctagctagctgcttctgatgcttttgtgtggaacaccttagggcctctcaaagctcagtttgaaacctactgaagatggtaaatctttcatctagtacaggaatcacatgtactatatcctggaaagttggccatcctggtttttaactaggatatgtacagtaaaggtgaacttactgattcttacaatcatctgttgtaatgtcatacagtcattttttttagattaaattgaactctatttcattctggtt

SEQ ID NO: 7401 - DNA, 1812 bp, artificial
  synthetic oligonucleotide
actttagcatgaccctatggcataaccatttgactttttttaggaaccaggttcagagaaacctgggttcaagtcctggctgtcctacttcctagctacaagatcttaggcaagagaatgtacactctgagcctcacatttcccatctacaacacaaggattctaatggcacttatttcacagaagtactgtgagggttaaataagatcatgtaaagtatttaatacttagcacaaaacactggtagttattgtagttattatcattaccacctattactgttactcagttatcttcaggattaccaatagagtgtaggataggatagtgattattaagagctcaggtttggcagccacacttgagtttcaatatgttccctaccactcctttgtgcctttgggtaatttgtttatctcctctgtacctcagtttcctctgtaattttataatagccgtgcctgcctcacaggattgtgaagattaagtgagctaacatatgtgaaatacttacaaatggtgcctggcacagagtaagtgccatgtaaatattagctacttttagtagtattttcataacatcttgagggcttggctcacagttcccaatggtgactgattttagataacagcatgttctcagtctgtgtttctaaccttactatccccactaaaagcctaaatccatccactaatgcttcatcccacaaattagggcatgaaaccacatctggtcattaagattctgtcagcaaaggcacgtgccatcacacttctccagaatccaaccctctgtcatctcccatttgagaatcactaagatactatagttgcatgtgtcatggtaaattatgttatatcaataggtatatcaataggacaatgcaaaaacagacacaactggttgtggcatgtaagaaaatgataaataagtcccacgaatttcaaaagacagttttctgaagagagggcaggtggtaaacctggaagtgaaatgaaaactgttcacaaattgaaagacagagtttcttcattccggatttgacacttggccaagttggaggtccacacaatttatctttagagggttccttctactctctcagtgtacccaatgtagggattggctcttgtggcaccccagctaggcccatcttctctagaaatgatcctttccccaaaatgccaccccacacccccctcagccccacccacacagctccctcctatctttctcccaaaacaaaattctacttcctcaatatctgacctgggatatacaagcctggtcaaagcttaaggcattgcacttcccagggatatattccatttttaaaacctctaagaacatggtaatgctttaacctaggaaaatgtttctctgagagaaaaaaaaattcagagaattttgatagacagagagatatgaagagattagactaaaagagacctttggtaatgcctattaaatttatttggttgtttttcagcaaatatatattgacactatgtgttaattctttcttagaccttggaactttagcaataaaaataagataaggttcctgcacttagggagtttacatcctataggaaaaaaataaccaagaaaatataattttagattatgtgagcaatatgaagggaatttatttagcagagtgatgggataaggggtaacaggcatgagagtgattgaatatttatttagtatggtaagagatgatttatttgaggtcatgacattcgacttgagatttgaatgatgagaatggaatctgccagacagaagtctgaattatgatggaaacc

SEQ ID NO: 7402 - DNA, 975 bp, artificial
  synthetic oligonucleotide
gtttatcaccatcaccatccctgctcctaatattcccttctttagtatctcaatgttagtatctctatttcctcactgataaaacaattaaaacagtttaggtcacaagctataatacatgaccttaaagcccaggaaagacaggcaagaaagattcaaacagaaaaatatctagtccagtagttcttgaaaactttagtgtaaattaaaattacctggaagactttgttaaaatacaaattcttaggcctttctcatcaagagtctacattttaaaagcatcacaggtgtttctgctgcaagtggcttatggggaggaatactgatcaaactgaacatcctaactcccctcaggattattatattaccatgccatatatattaactctggatctatttttaaaatttattttctaggaaaagaaaaatctataacatttaccaggcatcataataatcgcctattttctaaaaacttccacttagatttgatttttttaataatacaataccattgtaacatacactaagggaaccagctatttaaaggaaccctatggtgaatccttctgtaaagtgaaaacaattcccttgatttattgttgcataaatccagattttcatatctgaattcacctgctggggagaaatgttctccccattgtctaggtcctctttgctagccttctttcaatatgtggccttctcacaattctatgatttatatggagcaatttagagaagtaaacaagtagtgctgcatgtttaactagactgattggattgaagggctgccagtagctagcaagacaaaagataaaaggggcttgggcttctgtatagaaggaaaacaaagtaaaaaggaggaggctaccaccaaaagaagatgtgtacaacgctgagaaccgtaaagagatagagctatgaagctcaagagccctaagcttcagatattgtttttcataagctggagaa

SEQ ID NO: 7403 - DNA, 1149 bp, artificial
  synthetic oligonucleotide
tatttatatgctttattgcactgggtaggatcacctgtataattgattaaaagtggtgatcatgggcatcatttatcttttattctgattttaaaagaatgcttctaggccgggcgcggtggctcacgcctgtaatcccaggactttgggagaccgaggcgggtggatcacgaggtcaggagatcgagaccatcctggctaacacggagaaaccccctctctattaaaaatacaaaaaattagccaggcgtggtggctggcgcctgtagtcccagctactcgggaggctgaggcaggagaatggcgtgaactccggaggcggagcttgcagtgagccgagatagcgccaatgcactccagcctgggtgacagagcgagactctgtctcaaaaaaaaagaaaaaaaatgcttctaatggttcatgattaattacaagttttgctaaaggtattttgcagatactcattatcaggtggagaaagtatctttatattcctggtttgctaagagttatttatattgagcttttattataaatggaaattaaatttagtctaattctttgatcatgtggctttaattcttaaaactgatagtggtaaattgcattaaaaaaactatcattgaattcctagaaaaaaacttaaggttcttatgatgtattattctttttatacattgcttaattaaatttactgatgttttgttttttatttttatatctatgttaatgagtgatacaatctgtagtgcctcttccttatattatccttatctcttttcctgatgaggttatgaatagcctcataaatgagtttgggatattccttattcttctattttctgtgagagattgcaattatatggtgcttagatatttcatagtttacaattttaagttatgtgggtatgtgtgttttcttttgaggaagactttaataattcagactttctattactacctgagcctttttgataagttttatttttatagaaaattctgcttttcatccacatttcaaattcattgtcatgaggtcattcacaatattattcaatttcatttcaatatatactgaatctgtggttttctctagtttttctgtatttttactgcattctgtaccttctgtctttgtttttaatcaa

SEQ ID NO: 7404 - DNA, 995 bp, artificial
  synthetic oligonucleotide
catttcaaaaatactgggaatcattgcttcaccctctgacaaggttctaaatctatcacacaaatggctctacttcaatgaagagtgatttgtatccattgttttgaaactccatcaaattgggcagctctttccagaagacagtctcaagacaaggcatagagaggagtaccacattaactcaaactgtctcagcagcagcttaggctggcaggctttttcctcccagtattgcccatggtcactgaaaaaggtgactctggtcagagccagatacctaagattaacaccatctggttggggagattgttggttttggatttccatggcttgcttaagcccccctgaaatgctgactttgaagtccaatatgatgatatgtaaatagcaaatgaaagctggcatttgcctagtatacttccatgtaaatccattaagaaattcatttaatacttcaataattttaccatcctctttgatcatcttttgcatttcatcctgtaatgttctaacttctgccttgactgatctctggcctttttacagttctgagaaactgtatatttagatgatgtgagctgttttggaggtagctactttttttttcaatatgttttcttccttatcttttactcatttgccttgatgtccttcacgtctatttttgagaaaaaaattttaggcagatttattctgtgagtcttgtgctttcatgattgtacatttacttatcatatcttatgtcctgaccctcttccacatgcaactttcacttgcaatcagttttcagtcatgtattttaaaaaatattttgagcagtaaccatgctacataaactagaaactatatatagactggaccagataagcggaatgacaaaacaaacagatgacatcagcaggaattgcaaaataaataactttaaacatcttttcttccacaaaagtaatgagagcattggcaaaaattgtaagaatagactttctttcagaagt

SEQ ID NO: 7405 - DNA, 395 bp, artificial
  synthetic oligonucleotide
atctgagaggctatatgtgttggccaaggtgaatgagtagcagtcaggatacaacccaagtcttctgactccccagcttttgttcattacactaggccacactatcttattttatattttttatgtgataataccatttgtaagcactaactaagcactctatgtgtagtaactcatttaacccttatgataaccctttaagataactactattgttgttattcccttttgcatatgagcattttgaatcccagagaggtaaaacaacatttccaggatcacccagctaggacatggtgcagggatgattcaaagccagccagtctggttccagagtctttttatcttaaagattatgctatatgttatggtatctatctttctaggtgcatagt

SEQ ID NO: 7406 - DNA, 2374 bp, artificial
  synthetic oligonucleotide
agacttgtcccaattttaaccttcccaacagaaccatgtgcaactcaagggagcacagctcctctgtctctagcgccctagtgctccagccaatcaacagtggactctctggccatgttctccactggctagactagtggtcttaagacatttggccgggcgcggtggctcatgcctgtaatctcagcactttgggaggccgaggcgggcggatcacgaggtcaggagatggagatcatcctggctaacacggcgaaactccgtctctactaaaaactagaacaaattagccgggcgtggtggctggcgcctgtagtcccagctacttgggaggctgaggcaggagaatggcgtgaaaccgggaggcggagcttgcagtgagccgagatcgccactgcactccagcctgggcgacagagcaagactccgtcaaaaaaaaaaaaaaaagaaaagaaaagaagacatttgaagccggcacggtggttcacgcctgtaatcccagcactttgggaggccgaggtgggcagatcacgaggtcaggagattgagaccatcctggccaatacggtgaactatccttgccaacacggtgaaaccccgtctctactaaaaatacaaaaaaaaaaaaaaaaaaaaaaattaaccgggtgtggtggcaggcgccagtagtcccagctacccgcaaggctgaggcaggagaatggcgtgaacccgggaggcggagcttgcagtgagccgagatcacgccactgcattccagcctgggtgacagtgtgagactccgtctcaaaaaaaaaaaaagacgtttgaaactgtctggctgtctagtttcacttttatttccaaagaaaaataatcatggcatacttaagtcaaaccttaatgaactgcttagttagcatcagaggagtcactggatatgacacatgaatctgacctttttttaattcttcacaagtatctcaattcctgtatactctatcaattattcaggtttctactccggatcaaggttagtcatggcactagttcctaatctaacagctgtacagaagctttcctaccctctttcttcccagagctgtaatcaaatcgataaccacaactctggcttcctggcctggggctgatgccaccatcccaccacagccactagaagaatggcaatgctgagggctttatttttcacagaaagagatctcactattgatcactaaagcaaagaaaagctggtggcaggatgggggagctaatggaaagagatgagataaaatccagctgggcgtccctgaggtcattctgtggataactgaaggaagttcaggtgagaatctgagaaggcaaataaaagaaccccatttctgcaagcactgcacggaatatctgacagcccttgctgtcttggtgcatgttatcttttttccagctgaactacctaatgatcaaacatgacacacctcatgcttactagcctttgttcaggaagtattctgaaatttgctacccagctggaggctaagactgtgtacattcttttcactttactaggaaatgcttttttttttttttttttttttttttttagcagaagtgcctgtatgtgctattactgctgtgcctatgtgccttgctttatgcaggtaggttcaagaacagttccctcaactgtatttttgtaaatcaaattatatttcctccttgcagcacaatacaattacagagcaactttatcctcatttgggctctagcctcaactaatagaggcttgaagatttgtgtctgcttctgattcccagtccaatagttaatgctgtgaaaacaaaggcttccagcacaagagaccctgatattttggaggactcttttagaaataacaacaatgtcaacaactgcagctgtcattttgctgatcactgcctatgcatcactttgggcaggttacctgtgttatcacatttaatcccaggagtttttttttttttttttgagttaggtgtctttatccacatttcacaagcgcagaaactgggtctcccagagattaagtaatttgacaaagctcatgtggctacttagcagtaggacagggctaccatcccacagaagcctgtttgacttcaaaggtttgctctttcatatattccactacctctctagtttggtgtagcaaggtgaaatttgctgtcactttatctatagttgtaaaatgggggagggatatctaaatgaaatgctataatcactgcctggagtttagtctttactctgtactaacttgctgtgtgaattttggcaaacagctttgtttctctagttctcttagttctgtcatctgtaaatttaggagattgattcaggtaatatctaatgtcat

SEQ ID NO: 7407 - DNA, 1288 bp, artificial
  synthetic oligonucleotide
ttgaactgttgctaaatactaaagattaaatgagataaaggatagaaaagtggttgtccaaacattaagtgctatcaaatgaagatggttaatataattatgtttattaaagaggtacataaacattgttgagcagaaattgatggctctggaaataggacatatataataagaacatgggaaacaaagcttcattaaccagttggatcatcaccaccaccactatcaaatatcattttgtaacagtgtagttccagaatacatgttcccctcagaaaccccgaaatttcagcagcttgcagagtaagacctcaactcagctaatgctctattggcaacacaatatcttctaatactctttcatgttcaagtgctataatttgcattttaaaaagtctgtacctgcttttactgcagtaaatacaacacaaaagtctaccatacctttataggagcctttatttacctagcattagttatccttgataaattcgaacatgttcttagaagagataggtttttagttgcaactcgtgtaatgaaaagaatcagagacaacgcaggatactgattgtgtcatggaagtgtcaccattctttctgagagccaccataagctgaggcacagcagtaaaatgcttgagggaccctggctgatcccatcatagctggatggtagtttgctcttcgatttgtcatttcttgttttcctacgttttaacgtggtgctttgttgataccatattgccactttcttccttttcaatttccctcacccatttcatataccattgtcctcttttatgagaaattccttttctgagaacccggcttataatcaccttcccatttctatgcctcctttctgacatgtaaaatacctactatcagttcaccctcattcatttctgcagtttctcctttttgccttagatgctcattttctatgccatctcccattctcatttatatgggatttccctttctctttcactaaatgtggctttcatttatttcaatgaccttaagaagccctttatcctgacgtttctatgattgtgagctgtttattccatttttaatataaataattttgaaagtttagcagggagccttttttcatctcaggcagttaactgctttttttttttttttttttttttggctaaggtttaaaagaacctcattttgccagagtgttttgaaaatagtcatcccaaataatacaggaaaacatcctagttcaagaatttgttggagaatgcaagcttgagccaaaaaaagaattg

SEQ ID NO: 7408 - DNA, 563 bp, artificial
  synthetic oligonucleotide
atatttgcaactggctctcaagtagtttaggaacaaaaagcttattcaaatctgtatctgtagaaagagaaagaatacgagagaaaaggaatgtggtaaaatattaacattcagaaaagctgaatgaaagctatatgggaatatttgtactatttttgcaacttttctataaactctgaaattatttcaaaataaaacattaaaagtcaacgaactcatgggttaaagtctagaattaggaatcattatgtaactctttgataagaggaacatatgcaggctcagacaataataaactatcactgtggacaaagcacttgattttcctgaatctcagtcacagcatctttaatgaaaatgagctgattagatagtgtttgagcacaattccaattctaaaatgttatggttcaaggttttattatttgtccctcatcctctcctccttttcaactgtctaataacctctctcaaggaattatagaaataatgacagcagttaacatttagtgagtatgaattctattgtaggtaactttctaatttatacattatacataatg

SEQ ID NO: 7409 - DNA, 745 bp, artificial
  synthetic oligonucleotide
aggcttgggacccagacttgcctggattcatattcaagccttaactcttactagctctttagtttgggcaatttaaataactacttctttggaagtcagtttcctcatctggaaaatgcagataataatggtaactacctcataaatgtacatggaataaataagtaaatacatgaaaaatgctataaaaagtgtctggcaactagtaagcaacccaaaaatgttaatggctgttagcagaattaccttgttacatattgattatgatataaaccgattcaacaaacagcttcatagactttccagttcctacattccctggcaccagcacatgctttaacagaaaaggccttctctggatcaggctaataaaagatactgtttctgtcaacaaatcactgaaagtgacaacatcaatactgatttgaaagcaagatttggcccagatgatttctaatccactcaaactacctctagagaattcagggttgaatgtcataagggatctgattattctttgtgtgatgttgttttatcacagactagagtaggacatggccataaaggcccataagcaagtgatagggcatagaggatggaaattaaggacaagaagcccagtggtgtagcaccaatctatccaagtccagagatgaaacttgagggcagagacagaaatttaattgttagaaaagtatacaggttagtggttagaattaagctctggactcaaattgcctagttt

SEQ ID NO: 7410 - DNA, 2490 bp, artificial
  synthetic oligonucleotide
taatccaactgtgcttgcaaacatctggttcttgtagaattggagtattcttttatacagctgagccattctccctattttgaacttgactgcagtgctccactgttaaagcaacccttttgtcacaaactccaacagaaatttcagctcaactcatatcagagcatccacaaggcccaattcaaagaatctgaaataatgtattgttactgcaacagttgtgagtaccagtggcatcagagctacctgaggcatttgttaaatgcatatattccctagcccctaggatggaatgaattaaaatctccatgtttaggccatatggaatctccaagtggttttggaaatcaccgttttagtgcactcataagctacagtcctcttggactcctgattcttcaccagttccttgttaacctagctgccattgcacctgctttccagaatatgttccctggcagacaccaagggcatttcctgtcttttttacaaagctgcactaggcatctctggtgacattaaagttgaatgcctttaaaaggattttcctctgagaccttttaccttccctgattatcacatccagaagtacatccagcagcctgtgaaaaactctcccaagcgaaaggcctcgcagcaggctcagacctccaggttaagcaacatcctacgtgaccagactggaggtccgcacatacagaggtcctgactaccaacggggccaagagattgctcaaggtggttaacacttcaaaggtagcccatggtttcaagggtgaaggaaacaaacatcatagctgtcactccatatgtcttattccaaaatatctcctttaaaaacccctccagaccaagtgctggattctatagacggtgtcaaagacaaagttgtaaatcaggtgaggtttgtctcatgggccctcagcctccatgttctcttcctgcaccgtctatccagcaaggcctgatgcccttgagcttcccacagtggcatgtgggaagctctgctgcatgtgttaccccagcctggacttgcttctgacttcccctcctcttcctttgccctccaccttccagttcagggatcccttccctcagagctgtgttttctgagtagaatgtggtagatggtggatcataaaagtaaatatccttctgggttacagaaaaagttcaagagaggatgaatccgaactaaccattcactgtgtcccctggcacctagctaaccctggcgccagactgaacccctaacattgaccacagactgggccctctaactttggccaccatatgattgttatttgtggccggacgctaagtaagaagattttttagggtgtgtttttttaattatattttaagttctggggtacatgtgcagaacatgcaggtttgttacataggtatgtacgtgccatggtggtttgcagcactcattgatccgtcatctatgttaggtatttctcctaatgctatccctcccctagtcccccacccccagacaggccctggtgtgtgatgttcccctccctgtgtccgtgtgttctcattgttcaactgccacttatgagtgagaacgtgcggtgtttggttttctgttcttgtgttagtttgctgagaatgatggtttccagcttcatccatgtccctgcaaaggacatggaacagcccttcatgctaaaaactctcaataaactaggtattattggaacatatctcaaagtaataagagctatttatgacaaacccacagccaatatcatactgaatgggcaaaaaccagaagcattctctttgaaaactggcataagacaaggatgccctctctcaccactcctattcaacatagtattggaagttctggccagggcaatcaggcaaaagaaagaaataaagggtattcaattaggaaaagaggattttatttaaaaaaagttattattgccacagagaaatcttaccatgccccatcaatagagacataattcaaaggacacatcttatctaactgattataaatcaacactatcaccttgctttaggaaggacaccaagttgccaactgtaatttataatccatcagtaaaagataggtgggtgagaggcagggaggagcagcaacagaatctcttatgtaggtgaacaaataaattgaaataaacagagcctactccacctggacctcagaacctcgtggtccacaatatcaacatgctttttattatgtttgctaacataaccctgtctctactcataatgagaaaagaggaactgagccatgatgccggaatattcatgaaagtaaatatttataagcagaacagacaataaatgtttgagaactgtaaccttacaagcactcaaatatgaaacatgcaacctctgccatttgttgtagctttcagttgtgaagaatagttttaaaaataaaatttagtctcctaatgatatcatatttgaaatacaaaaaaaaaaaaaaaaaagatc

SEQ ID NO: 7411 - DNA, 1392 bp, artificial
  synthetic oligonucleotide
agattggaaggggataataggattattgcagtggcctgagcttggatggtggcagcaggaacagagagagattttggaagtacagtctacacaactggatgtcaaggattagaaaggggtaggtttctgacttgtgtgaatggaaggatggtagtccctgagattgtgaatactagatacagagccaaagttggagggaagttcataaattgtcacaaaggaggattttatccagaaacctttccccatcttgggtatctgcactgaaatgactgctaagtcatctctcacctagtgtttaaacccataattcagatctgcatcgtcttgcccctaaactattataataatcttctaactggtcactctgcctctagccctgctcccttcaaatccaccttccacgctgatgccagagggttctaactcaaaggcaaacttttccatacaacttccttgtttatagcccctcaatggctccccactgcccctagcataaagatccagtaccctcaaatgccatatgagccacttcatgagccatccccactaacctctccacattcatctctccaaccacaccaatctacttggagttcctaaagcactctagactgtgcctttgtttatggtgctccctccaccttaaatgctctttcctgtaccatcatctgcctggtgaacgcctacccaacattcacaactcaaatcatgcttaccttctctctgaagcctttcctaatatccataccatgatcagatttgtgcccctacaactaggacattcttctaccataatacctatagcactttatagcacttaattttatacatgtttgttcccctactagatgttgtacccctcaagaacaaggaccttggcagagttcacgcttagtaaaagtctattgaattaatggatggatgagtgattaaatggataagtgaatgaatggatttatgaatgaatgaagaagtagaggcaatactagaaaaaattagatataatacttaacatattcatattacctcacagtgcataacattttacaaaatgctttaaaaccttgtgtcctatttgtccctgataatattacaaaatagagaaggcaaacagatgacattactccagaagggctagaactcaagtcacctgggttactccagaattgtcccttcagttgctaaccaaatgccatgagaaagaaaattattaggtaataaaggttttgttctcttgcctgacctttttttcccccaaatcaactttttctccatgcgttgagttagcagccacctccaccatgccattttatgtttaaactttttgacgttcagcacaaagtcaggtcagtgttccctggccttgtcagcactcccagagcacagcag

SEQ ID NO: 7412 - DNA, 1818 bp, artificial
  synthetic oligonucleotide
acatcatatacttacacagtgtaactcattttcttgtcaaacatttgatcttagacacacggtagtatttaacttacatttctagacacacagaagcgcgcgcgcgcgcacacacacacacacacacacacacacacacacacacacacacacacacatcataatgcttaaaatgaaagcctccaggtgaatacaaatgttctctcctccacttcttagcttaggtagtcgcagatatgcttttaaactgttaactggaatattaaccacatatgactttagattacatgtttgtctaagacttcctcacctaactcttcaaagggactgcctgctgccatcactctcccacctcacacctgcctctaagctttcttgagttttctgtcacttccagctcagaagtgattcaaggttcacctcctctgagtcctccccaatttctaatttatactttacatttccttatttctgattcccagccactttgctattctttttccactgtcaatttgtcaatcttccccccactaaactaccagcactaggcattgtgtggttcataagtttccttcattggtttcatatatatatatatgaaatatatagatgtaattttttcctaacttataaggtttaatctaaggaggtagcatagtataatgacaatgacaaaatgcactggacttgaagtgtttacactccaaaatcttaagtttgagtctctttccgccacttactagctgggtgcattttgcagctttggtgtatcaatgaggtaaaggattcaggagagaaacgggctttaagtactaggtgcattttgcagctctcaagttttagtttcctcattaatagatttgagggctgatttagataaaggtactgcacactggagactgtatagtgaactgggcattctaatatgctttgtttggtctggacagtgttcaaatatttttaatgattttagatggagaatacatgctctgcttctccaaagtcccactccctaatgccttccactcacaagctacacctacgggcatttgtgtttagagccacaagattaggtgctttgtaagtaacactcttgcatctccaatggcactttatatcttttacattttttgctcttccaacagatacctcccactccacatctcccggccacagtaacatttcagtaaagcaaattctctgtgtcctgcactgtggtttgaacaataaaggttaagaaattgaagaagataaagtctaaacaagaagaaataaagattcattgaaacagctaggactcaaatttggttttaacaggcaatatttgggacttcagatgtctgtctggtcatgatgcacaaagaacgtgccccatccacatttgatccacaaccctcttcatcctcttgcctctcccagacgcccagtcactctacaagatgcaggccatcccaggataccctctactattccagcagtctctggccatctgaggctggaaacaacaaagagtaccacccaggtttcaatcccttcaaagaaaaaggctttaaaatgttcataaaagcagctcagcaggcttcttggatatcaaatctcttacaaaacaacattttgatgtgttaaatgtaaatcaattggaagcacatgcattcaatagggcctgaaatgtgcctaggcttaaaaataaaggaaaacatctcagtgcagcgtctggggacatttggcagctgcaaaattttggagggtaaaatggtttttgatattccatagaaactcaactatgatgaggcatctggaccctacctgctcccatcc

SEQ ID NO: 7413 - DNA, 1159 bp, artificial
  synthetic oligonucleotide
aacagcttaggagcaaagccctgatttgtgcccacatttgacagactaaagagaggcgctatatctattgcctctcacctcatctactgatcaggctgaggccaggaatagtttttgtctgtcttcttccaattgtcagtgattttacaaactctaaatcatatgtgttctttgcctttaaaaagatacagcctcttcagtctggaatctgtttttataaggctgggcctaaacctttgaccatttccactaaatgtgtaggggtgtggacctgaatgggtgggtggtatgtgtgagaggaaggggtgaaagagaaagggaacattgcaggggaaagcaaggctgttcagaggctggcttggaagcgtagctttgtggctgcatgttgcaccacacttctccttctgctacacaaccttctcttgtacagacccccaaccccccagggtctgcaatagtgaaagcagaggatgaaatggcatgggagcacctgcagcctgctccaccggatgggagattgggatttagggcgcaatctgaggctccttggagccttcccaggtaagagccctcccttcctaagatagcttgttccactgaagggcgctggctcctcctgcaggcctgtcctgggaattaccgcggttttcgtgtctgcctctgttctcatctgggatgaaagatccaccctaggcagtcatcctcaccctcccaactcaaggccccctccagaggggaagaaagaaccactgaggaaagggcctgccctgctcctgctcctggccaattactctgagcctaagcagcaaccctgttggaggaaggtttgatgaactattcatcacacttctaaataattcatttccctttgagggcaagcagcccacaggagctgtgaagttttcttaagttgacaccttttgagagatgaaaaataaagcaaaagcccccttttagagaaatcacagttgctttatatgccgtttcctgcatctctcttccgatgttacagggctcttctgttctgccccattccttggaattggtctcctattgttttctttgctttttgttgttcaaacgactccactttgtaggatctgctgtgctgacgcttccagcgttattcttgtctctcctggccctatgggcttccagt

SEQ ID NO: 7414 - DNA, 421 bp, artificial
  synthetic oligonucleotide
actgccaaccaacttaacctaatttatagagacagcactctacccaacagcagaatacaaattattttcaggtacacatagaacatttacaaagacaaaccatattctgggccataaaacaagtctcaatacatttcagaggattcatgtcataaaaaggatattttgtgtccacagtggaattacattctaaataagtagtagaaaaatatctggaaaatcccctaatatctttaaactaaataacatacttctaaataacccatgagtcaaagaagaattccagagggaaactagaaagtattttgacctgaataaaattgaaaacacaattgatcaaagtttggggttactgccaaagtagtacttggagggaaatttatagcactcactgcctatgttagaaaagatgaaagatctc

SEQ ID NO: 7415 - DNA, 1307 bp, artificial
  synthetic oligonucleotide
acatttagatgtgccattgatggtctgaaaaatcaggggactttgagaccatggagcaacagcaagagttaaattcaaggagattctcaaagccaataattaatgcatgctcattaaaaaatctatgtcaagactgttttgctgcagcacagagggcaaataaacattgaatgtcagtcttaccttcatgtgattaataaaatcatgattgcagaattccatttttattgtctcatatatacatttgtaggatctctgcagtcatgcatacacacgcttacaagttggggtaaaggactagggctgactcaatcgtccaaatgatcttagcaactagtactttgagctctctgatttggaactcaggacccagactaaaataaggcaagctaggtgcctagggcacaaaatttaaggaggtgctcacttccagggcatgcgtatgcaagttagtgcctccttaaattttgctcccttggggcctgctttgcctcaccctagctctgttgagaatattttcattcttgaattgtgatgctaaagttctcactaagggaataggaaggccaaaaaatgtggaatacctacaaaatcaagtgcagacatgagcaataacaacttaccggacacactgggcagataataccataaacccttatatctagtcgacagtaaggaaagagaggggtcagtataaattaatggcatgtctgaatatccatttctcaattccaaagcctagtaatggaactaagggctaaaaagaaactgccaagtaaagagcctacaggtaaaaagtgaaggatcccactgtgaagttctgtggtttgtgattggtgcattagtcgattgtaccagtggggctaatagaaactaaaactcattttttcaactaggctaagaatctgtaaaatcttaataatgtgattaatttgcttgtgaaaccttttacatacagagtccaaaagggaaacctcagctctgtctcatttacgacaaagtccaagtacaaaatagttccagttaggagttccatcacgcaggcaggtgtgaggcaggagacctcaggtcttcttactttgcttcataagacttaggctagattacaaactagcctctgttttaaaccctaacccactttatcttctcttccttcttccaccctaatctccaaggccaacacatgactacgtatgttaggactgagaaaagaacaggctaaaatggtgccaacttgagtcattattatccagctttaattggtacccaacttgagactttccagatagaagatcactgagtgtttc

SEQ ID NO: 7416 - DNA, 640 bp, artificial
  synthetic oligonucleotide
aaatcgcacatccacgcctaactgcctcacacctgtgcttgcaaaagtggcagaagcactgagcatcttgtgactaatctggaaaattgtctacttcaagcaaagtgactttcagtgtttcaggtaagcttctaacctcttttccagctacatgtgtgatttggaatgcacatatttgttccttcttcctggtaatctttcaactctaagctctgccaggtacaggactttcagatcatggctttatgctgagatccaaggaacagattacaatggtcagtctgaaaattagcacataggacctctctaagtgcagaaagaccgctagagagaaactgaaactcaactcattgccagactctgattttcaagtaataatagcaacaatttattatttgcttactatatgccaggcactgttttaaagccattatcctgtttttcacaggtaagggaactgtggcacatatatgctaagtaacctgtgcaagattgcgcagctaacagatgtgaactcaattaactctatgtggtttttcaaattaatttattcattaactcactccccttaacacaattcaaaatacttatgttaaacaaattattataatttgttgatttcaaatcaagagccttttaa

SEQ ID NO: 7417 - DNA, 1006 bp, artificial
  synthetic oligonucleotide
ggattctgaaggtccctttgggaagccaagttggtagccagagcacacagaagggaggaccacagtgctaatgaggccatgcttgccaatttgaagcccatgtgggccaattagctctgctttcttccgctgccatcaactgacccctgaactctggccactcacctcacagatctatgccacttgtcactggggtcagcaagagagtgcgtggttgtctcagtgaaaatttaacagagcatgtttccaagtgtcaccttgatgtgtgaggggcagcacaggaactcctcagggtatcaagtactgtttaacggtctcctggagtcctcctgccatctgtgcttcccactctgacatatcttatcactctctattgtctttgtctgcttgcctatttgttttctcccaccaaactgtgagctctttgagaacttatattggcttaacataagtattgtatcttacttaattctgtaaccttggcaactcacacagtatagacacatagcaagagctctgtaaaccttacgtgactgaatgaaggaatgtaaagggcctatctccagcattcctcaacaaggtttgacaacagctcagtgggtcagcaattccaccataaaaatctgcaaaaatttcctagaataaatgcatataattcactccaaacattttaacaggtaaatgcctttgcaaaaatattacctatgagccaagggacagatgtggatagcaacaaatcggtctgccagggtaatataagcacctaaagtttgtaaatcagtaacctaacgctggcttattcagtggcatatgcaacaaagcaaagcccttttgaataaaaaataaaatcatcatctgagtttacaatggagagtcgctcctttggattggaggttcctagaaggtgaagatggtgcttcatcaaaaggccatacacatcaaatgcactagggaagaaataggagcactttgagttctgatttcagcaataagtgagccgtactct

SEQ ID NO: 7418 - DNA, 774 bp, artificial
  synthetic oligonucleotide
aaaaaccctcacatcatctacaaagataaatcatggatggattcagccacaaagcatgaagggagaagaagttggaccaagcaaacacccattaactagaataggttttgagggagtctgaccacaatttgcagagtgggatctcagccaggacagttgggaatatctagagcagtgtttatagcctcaaacaatagtcagagggaggagagccaactcagtagcaagaacttctagaaaggtttcaacccagaagtgaagcacagtgtgcatcatcatcatgatatgtccatatcttaccagctgataaggtatcaaagaaatgggctggggcagactctaggaagagaaatttggcaggagttaggcaaggttctgcatgtggacttagccctagagggaaacaaggccaaattaccagacaaactgtacagtgggatatcaaagcaaaagtaacctagaaagggggcaaggagcactgcaattcaggggtgtaacgaacacacaaagctcactcccagctcagtgtttcaagccctgttaaattagtctgaggttgttgatatattttctgccattttaaacattgatttaggaaaggggtagggggtgatctgggcctgcaaacagggctcatcgattcagttgaaaggcactagggaaaacaaaagcaaggaagatgtgggaggaactgacaatttaaagatccattttcagctaatgtcagttctggccaacaaatcttcatattagaaaggcatggctaatgtcaaa

SEQ ID NO: 7419 - DNA, 1312 bp, artificial
  synthetic oligonucleotide
agtggacagatatgaatatgagcttctctggcttctcatgtatgcttcaattttcccaatatctttgtttctcatgaacaatattttaatcaatcactgattcttattaaacatccacaatgtgccattcttgtactagttgctacagagggttaaaatagtcttcattgacttcaaaaaccttcagctggggctggtgaaacaaaacttaaccccaaggaacaattagggagaaatatcagacaacatatagtcagggggctaaattgtgtggtataagccagcagttctcaatcttgttccccactacaacacatataacgaataatgtttcctatacttgaaacagtgtagtactcagtaaatatttattgaataaatgtgtgaatgaatcttcacatgcttaagataatcatacagtcgtatccaggattctaataatctcagcctttctcccccacccaagataacacacctatctgaatacaggtgattgaaagacatgtctattattggactaatcaacttgaatatatattatttaagtggctaccgcacatatatatacacacacacgtgtttattccagcactttatgtgtgtgtgtatatatatatatgggtgtatatatatatgtatatatatacacccatatatatatgtatatatatacacccatatatatatgtatatatatacacccatatatatatgtatatatatacacccatatatatacacccatatacacccatatatatatacacccgtaaatatgtatatatatatacacccatatatgtatatatatatgcaatatatatacacccatatatatacacgtgtgtgtgtgtatatatgatagccacttaaataatatatataattatctgcaccaaattaaaacatatttcagaactagtattgtaacaccgtggttaagacttgtcagagactttaggtgctataggagctcagtgaaaacagagattattatgagctgaagtattaccaagggccttcataaaggcaaaggaagaaaaattaagaaaatagattgaaaagctacagataagccatgaggagtaggaagggaagaataagtatagagtgggcaggaagcagtgaggatgcagacctgaagtggaggatcattgctggggaacaaagggaggcaggcttgggaagacgaggtaggattggtttattgcaggctataggaaccagtctgaagcactcagagtgatccagagggcaacagggagctattgtagagactcaagcaaagtccagtggaaaaggtgtttgtgag

SEQ ID NO: 7420 - DNA, 461 bp, artificial
  synthetic oligonucleotide
aaaggtatttcccccaaaagaagattatgcatatactggtttatcaggaaggagagctgggtgtatactttgatagagccagagcatttgggtgttaccatactgatggagagtaggtgtgaagaaggtagtggcttctggagttggaggtggagtgggggttggagcaggtcctggaagaacttgtgagagggcacaaaatcacataatcactaaatagttttgccaagagccagtcctctgggcctttcccatttctaagtgtcacacaattccttcttattttatactcgaccctgaaggactctgaacgataactaggcattattaccttgatagggttttaatcggccttttctcataattgtgaaaagcagagaaagagagacacaggaggagatgggaacgtaagaaaggtatggggacaggagagaacactttttcctcactcccgatgttgc

SEQ ID NO: 7421 - DNA, 6583 bp, artificial
  synthetic oligonucleotide
gccaagctggtcactcctagaaacatagtggaaagttcaatctggcttgagttcctagatggctaacctttatgcccagcctcagagtctaccccaaggccccacctaggcatagagatgttcacgtctgcatattttggcagagcacagggactagatttaccagacccaagagttcaaacagtggctctgctcagccttagagctgattccaaggacctgcccagggagggaaatgcccaccactcagcatttcaaaagagcacagaggcaaaggccaaacctgcccaatccaataatccaaatagtggctctgcccagcctcagagcccacaccagggtccttcccaggcagggagacacctgccactgcacatttttaatgattatagcttctggacccatccatctcaagcagtgactccccctaatctcacaagccagcctgtagccttgcccaattgcaaaacccaaatagaggaaacagccaggaaatataccctgtgacactgcctaatcagaggtgatggcagtgcccagccagcagctccacctaattataagagctcagccagtggtctcagcagacagtgaagcccagccagcaactctacctgacctcagaactaagagagcagcccagccaactagagagcccaacagcaagctctgcccaccaggatcattagcaactggccaatccagaatcacaggctatactccataatgaagattgatctctgccaaacacctgtaaaggctgaaaaaggtggctgtctcctcaaatgtgtagagacagcaatgtaaggccaaaggattatgacaaatcagggaaatgtgacaccacaaaaagaaacaaacaaagccccaacaatggatcctaaagaaagatctaccatgactgatgaagaattcagaataatccccttaagtaaattcagtgaaccacaaaaatataggatagaaaattaaataaaatttggaaaataatacatgaacaaaatgggaaatttgacaaagaaatataaataattttaaaaaataaaaatcctagagatgaagaagatgactgaaataaattccacggaaagcttctgtagcagactcaattaagctaaataaataatcaatgagctagaagagcaaatatttgaaattattcaatcagaggaacaaaaagtaaaatgaatgaagaaagcccacaggaattatgggatgcatcaagagaacaaacattttcataataagaatttcagaaggagaagaaagaatgagagccagaaagcatgtttaaaggaataatggctgaaacccttccttaaatgggaaaagatgctaacatttaggtatagagaatatagaggtttccaatcagatacaacccccctcaaaaaggtcaccatgacacacaaactatcaaactatcaaaaatcaaaaacaaagaaaaaattccgacagcagcaataaatttttaaaaatcacatacaaaagagttctaatacagctatcagcggacttctcagcagaagtcttacaaagcaggaaggagtgacatgatatagtcaaagtgctgaaggacaaaaaaatctgccaaccaagaatactgtacctggcaaagctgtccttcagaaatgagggagaaataaaagttttcccagacaaacaaaagctaagggacttcatcaccactagtgctgctttataggaattgctaaaggaattttgttaagctgaaataaaatccactaattaacaacataaaacatatgaaagcccaaaattcaataatataagtagtacagagccatattcagaatattctagaattgtaatggtggtacataaagcaatttgatctctaatacgaggtttaaaaagcaaaactattaaaaacaactatagctaaaataaatcatcaatggatacaagttacaaaaggatgtaaattttgacaccaaaaacataaaatgatggggggtaaaggtgtagagttgttgtacgagatagagttaagttctgatcagcttgaaatagcctattataactacaagatagtttttctaagcccctgggtagccacaaagcaaaaatttacagtagatacacaaatgtatatagaaaggattcaaagaataccactacaggcttggtgtggtggctcatgcctgtcatcccagcattttgggaggccaaggtgggcagatcacttgaggtcaggtgttcgagaccagcctggccaacatggtgaaaccccatttctactaaaatacaaaaagttagccaagtatggtggtgtgcacctgtagtcccagctactcgggaggctgaggcaggagaatcacttgaacccaggaggtggaggtcgcaattgcagtgagctgagatcatgctgctgcactccagcctgggtgacagagcaagactatgtctcaaaaataaacaaataaataaataaacaaacaaacaaagaataccactacagaaaacaatcaaaccacaaaaaaacaacagcaggaaaggaagaaacaaataatctacaaatcaaccagaaaacaaactacaaaatggcagttatgtaagtccttacccatcaataattactctgaatgcaaatggattaaattctccaataaaaagatatggctgaatggatttaaaaacaaatctcaactatatactcccttcaggagactcatctctcttttaagaatacacatagactgaaagtgaaggaatggaaaatgatattccatgcaaaaagaaaccaaaagagagcaggagtagctatacttatgttggacaaaatatagacttcaaggcaaaagatataataagagacaaaggacattatataatgataaatatgtcaatttatcaagaggatataacattttaataaatatgcatccaacattggagcaactaaatatataaagcaaacgttaaaagatctgaaggatgagataaatcgcaatacgataatagaaagggacttcagtaatccaatttcagcaatgaacagatcatccagacagaaagttaaaaaggaaatattggacttaaactacactttagaccaaatggacttaacaaacatatatagaatgttccatccaacagcaacagaatacacattcttctcaagtgcacatgaaacatcctccaggacagaacataaattatgtcacaaagcaagtcttagcaaatttaagaagattgaaattatgtaagtaacttctccaaccatgatggtgtgaaactggaaataaataacaggagaaatcttggaaaattcacaaatatgtgaaaattaaacaatatgcttaaacaactaatgggccaaaggagaaatcaaaagggaaattttaaaatatatttttaaaaaattatgttctttgcaacaacatggatgcagctggaagacattatcctaagcaaattaactcaggaacagaaaaccaaatacatgctctcacttataagagggagctaaacactgggtactcattgatataaagatggcaacaatagaatctggagactactagggggtgcaggagagcaagggctgaaaaactactattaggtactgtgctcattacctgggtgacaggatcgtttgtaccctaaacctctgcatcacgaaatatacccaggtaacaaacctgcacatgtacctcctgaatctaaaataaaaggtgaaaaaaagaaataaaaatgtttccaagccacaaatagggtatttcagagtaaagtctcaaaagtccagcaagattaatgaatcaaaaaataactggtagatttttctgcacacttttttcagttaaatataaagacaatgacccatgtggctgttagaatatccttatattaccagtgttttaaaactgccaccttgacttataagtaacaaaattatgatttagagaaaaacccactttttggtagtaagagtaaataaatactttgaaatacagtagtcagagactccaccaaaaactgttataactaataaaagttgcagaatacaaaatcaatacacaaaatcagtagcatttctatacactaatagtgaactatctaaaaaagaaatcaagacaacattcccatttgcgatagctacaaaaaataaataaaataggaataaatttaatcaaggaattgaaaaatctgtactctcaaacctataagacattgataaaagaaattgaaaaatacacaaataaatggaaagatattccatgttcatggattggaagaattaatattgttaaaatatccctactacctaaagtggtctactgattcagtgcaatccctatcaaaataccaatgtcatttttcacagaaatagaataaacaatcccaaaattcatatggactcacacacacaaaaacaacccaaatagctaaggcttgttcttcttgagcaagaagaacaaacctggaggcatcatactacctgacatcaaactatattacaaagctatggtagttaaaaaggcatgggactggcataaaaaatacacatattgaccaatggaacagaatagagagcccagaaatgaacccacacatttacaatcaattgatttttgacatgggtgccaataactaacacaatgggaaaagaacagtcttttcaataaagggtgttgagaaaactaaatatccacatgcataagaatggaattggacccttatatcatacacaaataaactcaaaatgcattaaagacttaaatgtatgacctaaagctgtaaaactattggaagaaaatataggggaaaagctccttgacattggtctggacaatgcttgtttttaccctaaaagctcaggaaacaaaagcaaaaatagacaaattggattacatctaaccgaaaagcttctacacaaaaaagaaacaattaacagagtgaagagacaacctatggattgggagaaaatattttcaagccatacatctgacaagacgttaatgtccaaaatatataaagaactcctacaactcaacagcagaaaaacaaataacccgactttaaaatgggtgaagaacctgaatagacatttctcaaaagaagacatacaagtggccaacagatttatgaaaaattgtcaacatcactaatcattagggaaatacaaatttaaaaccactgtgagatattctctcacacctgtcaggatggctattaccaaaaagatgaaagataagtgttgaggatgtgccaaaagggaaaccacagtacgctattgctgggaatataaattagtacagtgcagccattatgtacaactctatgtacattcctcaaaaaactaaaaacagaactaccatataatctagcaatcccacttctgaatatatatccaaacaatttgaaatcagtatgttgaagagacacttgcactcccatgttcattgcagtgatattcacaatagtcaagatatggaagcaacctaagtgtccactaatagatgaatggataaagaaaatgcagtacatatacagaatggaatactattcaattttttaaaagaaggaaattctgtcatttgtgacaacatggatgaacctggaagaaattacactaagagaaataagccaggcacagaaagacaagtaccacatgatctcacttgtatgtgagtctaaatcaaactcatagaagaagcagagaggagaaaggtcgttaacagaggttaggaggtgaggggaattaggagatgttagtcaaagcatacagtttcacttagatagaaggaatgagttttttgagatctattgcacagcatgatgactatcgttaataatgatataatgtatatttcaaaattgctaagagagtaaatttcaaatgttctcaccacaaaaatgaataagcatttaaggtgatggatatgtcaattagcttgacttaagcattttacattgtatacatatatcataacaacactttgtaccccataaatatatacaatttttaaaattaacaaaataaatattttggttataaaacatactttttatgtaaaaattttaaaaaataaaagaatctattacattttaggcaccatgctacacacttaggatgcaataatagccaagacaaaccctgccctcaccaagcttaagggctaaaatttgggagacatacaattaaaacaattgcaataatgtgtgatacattttgcaagagattaacctctcaagtggctgtgacagtatggtggagggacatttattctggatttaggaaagggtgtgaacttaggaaaaattcacagaggtgataaaattacagctaaaaccagaaggatgagttagcctagtattgtgcaggctgtgaacatggcatatattggaaactgaaccaatttcattacagttggagtattaactcaaaagagagagatctggtttaaaaaaaataagggtggataagtcgacaaacaccaggtcatgaaaggttttctaagacgcgttaagaaattcagacatttttcttaggcaatgggaagccactaaaggcttttgaggagggaagtgacatgatcagatttatagtttaaaaaga

SEQ ID NO: 7422 - DNA, 343 bp, artificial
  synthetic oligonucleotide
tggaactgacaacactgagattaattaaaagtctgtatatggaacagttgtctctcctcaccctccaattccccacacaaaagaatataattaccaggcttctattccaggcaagagaaaggaggattactctctggaggaattaaatagtcctagagcaaacgcctctgccttatgttccttgagggatccctaccagatcagcctaaagtgacccactagttgacaagctttacccaagcacagagctctcaagcagttgtttatattttattgcattattgttatatatgaagacacatagggatcaccaggcatttgaaaaaaaatttgtaatgaaaaa

SEQ ID NO: 7423 - DNA, 2006 bp, artificial
  synthetic oligonucleotide
tatgatttcctcatctttcatagcaaagtcaatcaatattacttaaaattggaaaaagaagaaaaaatacaataacaccacctcaatgtttttttcatcaattttttcccctcaaccttagaaggatctgttagaaactgatatttttatgaggaataaatatttttccaaagtttaccattccttccactttacctcattttctccttattttgtgaaattctactaaacataaattgaataattttgattaaaaataaagaaaaaaattagccgggcatggtggcgggcgcctgtagtcccagctactcaggaggctgaggcaggagaatggcatgaacccgggaggcagagcttgcagtgagccgagatagcagaactgcactccagcctaagcgaaagagggagactctgtctcaaaaaatatatatatgtatatgtatatatatgtatatatgtatatgtatatatgtatatgtatatatgtatatatgtatatgtatatatgtatatatgtatatgtatatatgtatatatgtatatgtatgtatatgtatgtgtatgtatatgtgtatatgtatatatgtatatgtatatgtatatgtatatatgtatatatgtatatgtatatatgtatatgtatatatgtatatatgtatatgtatatatgtatatgtgtatatgtatatatgtatatgtgtatatgtatatgtgtatatatgtatgtgtatatgtatatatgtatatgtgtatatgtatgtgtatatatgtatgtgtatatgtatatatgtatatgtgtatatgtatatgtgtatatgtgtatgtatataagtatatatgtatatatgtatatgtatatatgtatatatgtatatgtatgtatgtatatatgtatatgaatgtatatgtatacatgtatatatgtatatgtatacatgtatatatgtatacatgtatatatgtatatgtatatatgtatacatgtatatatgtatacatgtatatatgtatatgtatatatgtatacatgtatatgtatatatgtatatgtatatatgtatacatgtatatatgtatatgtatacatgtatatatgtatacatgtgtatatgtatatatgtgtatgtatatatgtatatacgtatatacgcatgtatatgtatatacacatgtatatgtatatataatattgccaggtgcagtggctcatgcctgtaatcccagcactttgggaggctgaggcaggtggatcacttgaggtcaggagttcgagaccagcctggccagcatggtgaaaccccatctctactaaaaatacaaaaattcaccaggtatggtggtgggcacatctaatcccagctactcaggaggctgaggcaggagaatcacttgaagctgggaagcagaggttacagtgagctgagatcacaccattgcactccagcctgggcgtcagagtgagactccatctcaaaaatatatatatatatatatatatatatatatatatatattcatctatcacgtgtgtgtacatatatatacacatatgcatgcaatgagatatctggaacactacgaatctcatgctaatggacatttatcagggtggtgagatttgagacggttttagctcccaacttcttactttgaatcactagaatttttggtaatgagcttgtatcatttttagaagaacaattaaagtccttttgaaataagatgtatagagtcaaacatctccaaagatcttcaagctctaatactttatgatttaatattctacgaagcaaatgcatatccataattcagtaacaaaaggctccacattctttttttaaaaacaataatatctcactaagtcatctgagtctcctttgatcactgacctttgttgaggctcaaggcctggtggaaaaatactagatgacttcaaataaccttagaggacagtgtgttctcattaaccagaagcaatttttttaacacaaatgaaaattttaaaa

SEQ ID NO: 7424 - DNA, 1716 bp, artificial
  synthetic oligonucleotide
cattaatgggaaacttccaggacaaagggcaaagcacctgtaagatgaataaaagagggagctgaaagtttctggattgagttactaagtaactttaagccactaaatataaacatcttcgaaactagcaaggaattttattaagtagttagggttgctatggtggcaaaagtctgctttatttcatcatcaggcacttctttctgcttactgagggatatgcagtaaagagttataaaaattaatgggatattactatccttactattcagtagcctaggactggtcctatggtttatagttggtacaggtgacaggtggcgaacttctagtggtataaaaccatctagggagagtatttttaaaacacagaagctgctagagcaaataggtaaagggaggagggtggtagagaaaaaaaaaatgtaagttcaaaacaggccttgtactaaatataaaaacactagagcctagtaacaaagtttcaacacagcacatttttcaaacagaatgcaatcccctgcacatatttacattaaacctgaaccagcaaatcctgaaagatgggatgcacactaagacttctacggaaatgaagtgctatcactattagattttccagttcagtaacactgtaacttactggggcttactcctagttagtcatatcaaacaggtagttcaataccatcgtaatgcaataataattacgccaaagcatattgattttggaatgtcccagtggtcaatccctttcaattctctattataaaaggaaagccttctaagttatacctcattggcatatgacttttcattgctcccaaaaagacacttatccatagctatatattcaaaacctaagaagttattttgcatctttttacttctaaattatatttctttatctgaaaatgtgagtcacattgagagaagttgtagctctagttcaataaatgacaccaaaatatcaaaggggttacctgtagtgtcatgatgaaaggtcagagaaactttgctccctaaaaaaaaatgtttttaagtgtagaatagcttttgcatggtatcattattaagtagcaagtgtttttctggaatatattcctttcttacctttttgccttctctcccaaattgttttttatgaaagttaaaatcctacctctcttaatttcagtactaaggattttaatatatttagttgttgaacagaataataacaagagattgttttttaatccttttcattaaaacaaatttatgtgtcctcttcaatctgtaggaatgggaaaaaactgacatttctatttcatgaaaaaaaccaaaatcaacacataaatgctataagttggatctggggtgtgtttgttgttcgctttcatttcttttgtttttgcaattagcatagcaactgtgttttccaggataatctactgtaacttctataaaatctctcaaaaattgttacctttttatcataaatgacctttatgtgtgtaaatagcaatagtattcagagctatgataaatttctgacaccattaaagattactaaccatagcttgtagatcaacctgtgggttccagtctgaatcatatagtataaccacatcagcacttgccaggttaattccgagacctccagccctggtacttagcataaagatgaatttgctactattaggagcattaaaagcctctattgcttcctttatt

SEQ ID NO: 7425 - DNA, 674 bp, artificial
  synthetic oligonucleotide
gaatgttatttttagagttgttaaaacattgcctacctacattagatgtggccttaaacattaagtcttataaaatagctatcaacaaccaaaaaatatatttcatctatacttatttttataatattactgcaaaaacaacccctcagaggaaaaaaaaatccatttcaaccacctgttaaattcttgaaagatccaaggttataagagtttagttaaaattaaagctaaaatatgtattttagtaactaaaaattaaataattaaatgtattatagcaagcaatatgtaagtataactaagattatgctgcttaaatatgtgatatcttcatgcattggacaaatattcttccctttaaagtgtattgacatattacacatttcattaatgtgtagcatttattcatatgtccaaagaaggagaaagaaacaaaaatacgtcaatctggctttgtgactggatttctctcaggtcacaaagccacagtggtattaccactgatattttcacctcataaataaatatttctagcttaaagcactttattatgggacagagagcaccgaaccaaaatgagatgtgacttctagtcctaactatgacatatagcttccctgatcctttatttcctcatctgaaaatgaggaggttaatttattcaacagaaaata

SEQ ID NO: 7426 - DNA, 3973 bp, artificial
  synthetic oligonucleotide
tttattggtctcccgttttttcacaatacaaaattttatacaaaattcaaaaatttatacaatctggaaattcgacaacctctcctgccatacaaaaggcagtttggcactcacatttgcccagtccagggaataaaaggcacacagacatttccgaatttcacaacatttgatttatattgatgcttggtattacacccacttttaaccaacaatattgtcttactaatccaagtaccgcgtagatcttacaatgtgtatgttttctacggttttcatttagcactacaattgtccttctgtttagtcaaccttgtaatagtaaaatatgtcacagaagcaactgctaaatttaaaattactcttctcatttaaggcgaaaggtgttcattttcctcaaaagcttttcatttggtcgtatagtatcatataatgattcagacaaagccacttgagatctctaaagcataattacccacctttttaaaattgcgatatgactactcgtaaataggaaaaaatccacacataaaccattagttatgcaattttatcatacatcaaaaatgcttatgccccatcctatttttatgtcaatttttcaacgttttatagttttatttgcatgtctcgggccacacgaaatgtgccttatggagataatacatattttctggattggctttaatatgtgtcagagcagttcccttacgttagaagcagctcatcttggcgacgctgagttttttaaaaattaaaggagaaaaaaaaaaaaaacctgtgtgtgtccaggagccagcagcgcccactaggagagggaggcggaagcctggaaagcttggggccggattgagggaccattggggtggccctggagtgaaaccctataccgtcgggggcggggcagaagagggtgagggtgcagatgttggaaattttcctaagccagcgtccacggttcctcagtttgggggggcgggggggtacgacgcagagagctcctttcctcggggtgacacccccacctcggcaggcggggttcaaacgaacaagggatggtttttttcctgccatccaaaagaccgacattgccaatgaaagaaagaaatgtcttccctgtcaccctccacccagcaaccaccagcaccttgaaattcaaattacaaaaaaagccccagcaaaacccctttagcgcgagtgtgggattgaagggcccagatttcccaggcagaggccgacgggaaggcggggggagagggagcgagcgagaggagagggagaggcggaggctttttcctgcacagccccatcccccaccccgttacccgagttccgggaaggtggagggggtcgggggctgtcgaggggctcccgagcccccaggccccgggagagcgggcacccctccaccccgcgccgctcccgcccgcgcccagccccgcccccgtcctccaggcggcgagaaggaaagggggaggggagcgaacgccaggcggttccgccgccgacccccgcacccgccgcccctagccccgcaaagctccgcgggtacctgtcggcgccgaaaggtcagggtttgggcccctcagaggggccaggcacaggatttgtccaccacacacacacccccttcctatttacctccttcttcttctcgcccttctccgtggccgcggtggcttcggtggccgcggcggccgctccctcctcctgagaggtggacggcccgggctgctcgtcctctatgaccacgatagtggcggtcgcatccgcggctgccacggtggctgccactgcggcagtgtcctgctccatgccgtgggagcgggaacgagtagggggacaaggcaggggacgagggctcctgggcggcggcagtggctgcactggaaagagctagatggagcaggggtggggaatcactccgcttccaaccccttcgctcaggcccccccttctttaaataaccctcaaccctgccccacttccgtccacccaccctacgtcatggcctccccccgtcactctccccccttcctccaccccccccccctcaacgatcgcgagactccccttccccacccagagcccgggccggccccgcacgaccaactgttgcctgagtgtggggcgcggacaggggtggaggcgggaacccacaactcgcggccccctgaaaatctcctttcccacacgcccccaacagtgagcctgagctcccctcgcagatgcgtgcagaacgaatcctctttcccttaaatctgctctttgtacctcggggcgctctccccttcttgcacaaagaacttttcctctgctcctaactgtactgtagaaggtctttttcaccatttgcaaagcgcggaacccctctgggactgccctttcccggatccctaaagaggtaggattagcggtgctgtttccaccttcctaaattctgcacaaagagaagcactccttgaatctcttgattgcagctgcaaacacattcacttacaaggcaaagtctgactctcaagttttacgtatatttgctctattttcacctctggtacctctcaggtagccaatgtgcaggaacacttctcttaccttcaccactgcatttttaaattcctaggggacaaggttacccaccgaacctggggcaacatgtggtaggcactcaatattagcaattgaaatgaattactgtgattttttggcacaggttctatttgcacctccattattatttggtaataatacaacacataatatgaatgatcatggatataaaatcatttcgtgatacagaatcaatcagtgtccatcagcaggtgaatggttaaggaaaatgtggtctgtatacacaatggaatactatgtagccataaaaaagaatgaaatgtcatttgcagcaacataaatgaaactgatgtttattatgttgcacaaaataagccaggcacagaaagacaaataacacatgttctcactcatatgtgggagctaaaaagttgatctcatggaggtagagagtagaatgataggtaccagaagtctgggaagggtgtgtggggttgaggcggatcaatgaagagaggtcagttaatgagtacaaatatacagttagatggaaggaataagttataatgttcaaagtagagtagggtgactctactgaacaaacaatgcaatgtatatttcgaaatagctagaagagaggacatgaaatgttcccaacacatagaaatgataaatacttgaggcaatggacaccctaaataccctgtcttgagaaggacccttaaggacagcaacagtggaggatttatttttcaccatgttgcagctattgaaagatagaattcctctttccttgcatggggctgcaaaggagaaaagctcaagaaatatttgttgtgtattggtgtgtccctgctttcaagtcagttttgttccactgtatttctcattgtcagtgtacattatttcagttacatcgtgggttaaatgcacttttgtgaggaaatctgggaaacacatccctttataacaccttttttttgtggggacatgtgttccatgttccaaaaaaagaatttaaaaatttatttgggggcagaacatatttgtacgttggcaattttccatgcatgtataatgcaatccttccttttcaagatgacgcggctgaaagtgctaccaagtatatgaatttggctggaaaggtcgatgcttggtcaacagaccttgccacaggattcatgtaaatattgccctttggcttgtggcaacagctgctatttacagagcatgtgctatccttatttgtaaatctgcctaaaattcatgatctgtagactttgttcaacaagagtcatctcatttctgagcctactcaacaccttgctctatctgctactactttccccaattatgtcttttcatttgaaatggtcttggattgctctattccattggggtt

SEQ ID NO: 7427 - DNA, 451 bp, artificial
  synthetic oligonucleotide
atttcacataaacacagaataatttttagtacatcttgtacaatacttgggatgtacttatactaaaaaaccattgtctattatctgaaattcccatttaactgggtatccggggtttggttttgtttcactcttttgttttgtttctaaatctggcaactcgaccaagagttttcccagccctgtgcctcttcaaggctttctctacagagcagccagaatgaacatacagaaattcaaatctacccaggtcactgccttgcttaaaaccctgaccacctcccagctctcaactccatcttccactgtttccctaagcccacagcatgcccccagcaaaccaaatacactgttgcctcttaaatgtgccccacatccttctacacactcccatccctgtccagccacctaaagaattcaaacatggttatcaaactcaactaccacccct

SEQ ID NO: 7428 - DNA, 1668 bp, artificial
  synthetic oligonucleotide
atgtagaagccttatataaactgtaaagcactgatcaaaggagtgaagctaattattaattagttttaaagaagccatccctaccatcaaagatcttgcagggattgggtagcaattcataagagattatgacagagggctgagctgtgggaggcagtagagagcagttgttaagagcagggaccttggtttctagctctggcacatcctagctgtgtgactttgaataagtcactgcccctctctgaacctcagtttcctcagatgtaaagtaaggatgataacacctccctcaggacctgggaggatcggatgaaatggtacacaagaagaatgagctagcacagggcttaatacatagtggtgcccaataaatgttggctgtagctagggttattaagagatcagcagccattacaaagggaaggaggggtcagggaaaatctcctatgggagattaggcttgaatttggccttgaaaacaggagacaaatttggaatgtcagaaaaagttgcatataagtaagtcttgccaagcactgggggaacaaaaaagtaaggccccaaagtttacttccatcctctctcctagatggtctgaaaagatggtcatgcaggtggcctggcccaagaggggcatgccagtgagaagccatagggaaactgacatagtgacatggccctcctactcctgctgaaattcaaacctcttcacaggcagtcgagggagaactctgggccaagctgtgcggtctacctcctactttgtgacccagggtggccctgaggccctgggcctgtccctctagccctcccctgataaatcagtccctaacatgtgcctcttggttgtcagtggataaatgcatgactccttccagggaactggtgtgcatttcagtgggggctttctagaaacaataccttacctcccagagtttcccaagagcagctggagctcttgttttcttacttgaaacctcagtggattcctccagcagtttaaatcttcatcgtttgctgaatcccaggacccaggaagcacagtttgcacctgtcttaatacccaggactcactggggccaccttcagccttggagacaagatgggccagagggagaacagctggtggcccacatctgcttttgcttttgtttggacaaagatgatgtgccatgtccttttctctgtcactgtgcattggtcagaatatgtggagttatgctgcaataacacagaaaccctgaaatctcaggggtttaacacaagaaaggcttatttctggttctcacaaaagtctagtgcaggttggatgacacgtagtaaggccaacctgaaacatgtggcctcctagaactccacagcagggggaaagacagatggagaagtaaatagtcttagtcagcatgggctgtcataacaaactagcatagactgggtagcttaaagaagaggaattcatttctcacagttccacagctggaaagcccacagtcaagacactggcagattcagtgtcaggtaagggcactctttctggcttgcagatggctgacttctcgctgtgtcttcccatggctgagagagagctagctctctggtatctcctcttacgaaggcactaatcctattggatcagggccccatactcatttaaccttaattact

SEQ ID NO: 7429 - DNA, 2490 bp, artificial
  synthetic oligonucleotide
ccacctctttcctttaggagggtacgacagttcccagtggcccaacctcccagggcgttctcccagagtgtggagggcgggggcctaatctgcatttgggacaaagcctacccggtgctcgagtgttgttgtcatggaaactcaaaaggtgttattagcatcttttcaactcagtggccctgtgtggtccagtccatgcaatcttagcagtagcacaccatcaccctggcaacccattagcctagtgttgttaccatggaaactccagtaaggtcgatcagtccgggaagttcccagaggagataggcactgggagatctgcccagcagtgcctactctgagggtctcccagctgacagtgacctgctctgcatacactgacagtagtttaggatcttttccggagcgagctaacagtccatgtgacaggaaagaatttggccctgcagactggcaggtctatgcctcgttaccatggaaatgctgcttgtcaggatctcaaagcacagtgcaaaactaactcttccaggagactgaggctggcaggaaaggaggctgtgagcctgttcttcattcacatgcccattcattcattcattcgttcattcagtatttagtgcacgctcattaatacagtgggcactgcgtatgtccgaggctctaactggagcaaacaggtgggctcaccaactctcttcaattgaaaagtatattgaggtggaggggaccatcttacttcctgtgtcaacctccactggaggaaaaggagttgacatgcccaaaggaatggaatcggggggtctctgtgtgtcgaggggtacagggagaatacttgctttctgtagcctcctgtttttcacctatcccctgcttaagccttcaggaaacagatctttgtgtggtctggatcaccaaaggcttggccagacatgctagaagtttccagcagccacagctaagtgaagttagaacaggctacgttgggaagcaatgagctccccatcactggagatgtacaagcagaggcaaaaaatcctgctcagtgagggccatgtagagcccgcagagcacaatgattcagagctcagattctggagccagatagccagtcttcaaatcttggctcagtttaccagctgtgtgactttgggcaattcacttaatcatactgagccttgatttcctcatttgtaaatgggaatgataagagtttcttcctcatgggcttgttgtggggatgaaatgcgtataatatataaagcacttagaacagtacctaacatataattgctcaagaaatggtagcttgtattatcccttgatggcccaactaaagtccctgacaagcttgggattctatatgactatgggtcactaatcttcctgcacacggaaaatcagaaagggactctggcaagggtaagattctgtgctgaccagagagctggctgagggtagcacctctgagctttgagctcatcaccacttgcgtgcttccagcaatagttttcctttccaagtacttttggatccatgtctcaattgggcctaaagacaacagcaaagggcacagttaccatcccctgtgatagataatgggaagtaaagctaagagcgggagagtggctcacctaccaagtggcacaactgggatggaagctttctctctgtcacaccacctcacagtccccagggccgccataaggggaggacagcagttgggaaggagcaagtcatgggctgggcggaggaggagcccagcatgacaataacctatgaaaatcagctttccactgtctgcacttctgcaaggaggagttgaggccaaagccagggagcagaagggggtatttcctagaaatgcggcgggagtggctggtgtgctccacccatgggcaaaggacaaggctcggcctgcgtgtgagcactcacttggagctgaacttggagcctccagagctcccatccctctgagctcactcagaaagctttccctttgggcaaagtccaagggggtcattcaactgtgatctgacacttctgctttcaacttaatagctcaagtatttaacggatggctcatggcctcaccaagggattttgcttgccgagactagcaaggtgggctagtgttttcatgccatttggaggagcaatgagaaaggattgtttaaaaaaaaaaaaaactttgcctgagaacaagagtaacgccctaactcatggcctcatgaagctccaggttaaaatgcacacgttacctgggagtatgggaattggacaggggcaatagtgaaaaatctttaatagccagcaaggtctggacaccaactgattagaatgtttgctggccagaaacacgctatagggatgcaccagcccagatagaggaaaacagcagccctggatgtgggccttggcaggggccgggtgaagggagggtttgctccctgagaggtcccatgagcacacgcaggaatcagatctgcctat

SEQ ID NO: 7430 - DNA, 1790 bp, artificial
  synthetic oligonucleotide
atacaaacaaagtcattatcaaatgtatttattgctgaaaacataacatttttcaagaaaggcaaactggctaaaaagtcctgaaagtgttcaaaagtagataaaatagcagaagacacccaccaaggatacaaaacaatttttagtagcgatcctgcatttaatcagtatgttcttaaataaactgctttaaaaaaattcttcaaatgacactgccaaaaaaattaggacacccaaacagatgccagaaaacctgtaagtgggctggattttatgtgacctggtcattaagcatagggattcattttgtgagctcatggcaaatcagtttgaggccagttgacctagaaccgatttgggatgcaggcacttacctccctgcacgtgcaatatgtgggcatggggacacccatgacccccaggggaaaggaatgcccctcctgaacatgacctccaagagtaagggcgaactgtcagcttttaactgtttattataaagacatatttacacagaacaatctttacaaacattgaacacaggggaagggaacaatttcttaatgaacagggccttaatatctttgtataaattagtataagaatcataaacaaccactttaaataaggcagcccccctagcccacccactaccctcttctgttccctatctcccagctttcttagccatcccccactttctccccttccccacggggctgggcttggctgcaggtcatggcaggccgatgaggcaggagacacagaaaggaagggggaaagaaggcccaatccctgatgggggcgtcagtggcagaagagactttctgggcaccgaccagtccccactccaagcatgagcctttaagcagcagcagcagcagcagcagcgttagcagcagcataggtaaaggggcttgggggaggtggataggcaaacattggggctattgtgggacttggggggccctgactcccccgtccccacacacacaaagttgggcatcaggctcttgtcttctctttctccctcctgggaaccctgctcaagcaaaaggggagaaagccccctccaaggaatggctggtgatggcccctcacggaagctagggcctcccggggagagggtgctattcctgctgcacttcctcccatctttctttccttccttctgttcctttgctttcttttcttccctccttccttctgcccttcccttccttcttctcccctctccgcctcccccaaaggaaaagccctggaaggaaggtccggtcaacacgaagggaaggccatggagtccagtgattgaaggctacctcggactcctgaaaaccaccctggggttgagcggtagtctcagtgcctgagccgcccctattagagtaccctgggtctgggaatgctgccagttatgggggcagctggccagttatggaaccttccagcccagctgggggaatggtgcagcaggggtaggtcagggaggtgggagcagctccagccccacaacaggacagttcacagccagcttgcctctcccttcccttcccctcccagccacccccagccccagcctcgggaaaaggcacttcatttgctttgaaaagacatcatcaagagggaagagggcgtcataaagtaggagatgggagacctggtccccatcccggctctgcaatgactctgagcaggtcactcccctctccaggcttctgttttgcaggcgtttgcctaagaaggctaagtgaccttcaagggtcctgtcagctctaacattctgtgattcttgg

SEQ ID NO: 7431 - DNA, 11163 bp, artificial
  synthetic oligonucleotide
tctattttccttgactgcagtattttaaagcaaatcccgaacatcacgtcattgtactcctacatcctttgatatgcaggatgacccacttgtgagtactagggagctcatatctcgcccctgggtgtctcatcggtggttaggcatctctagggcgccaagtcctcccagtggatggggctgggccaggcgggttaagggggagaggtctctgactcagcctgcctcatgctgtgaccagatttagagacctgagaccagatttagagaccaataaatattgcatgaatatttgagaatgaataaatgaaacaatggtcaccttcagcagcatgtctgtgcaccaggaggggggtgggctgttgcagttggtacctccccaccaatgccctacctcctgaaattcccagatcacaccctgcatcctgtgtctcatgtaaattccttccatttcaatcccagctggcttctattctgcactctggggctcctctttacatctgtccacatctgtcaggaggcttagagtagaggcctcctgacaccagactgagccctgacaatggaatccaagtggtgcagggtatccttgggtgcagtgagggaaaaggcatgcaggccgactctcgtgaagcctgcagtccatgcagggaagctgagctgccacccccaagacaagcctggctggtggtggcaggcagtgtgtggagatgagatggtgctggggaagaggcagccaggcagggtacttgtgcaatgtccagtacaggcctgtgcagatacagcatctgaggccagagataatgaataacagtctctctccccctgcacaccatctgatttgcctgcatctagatccctgtccctcgagccccattgccatctacccaggaattcccaccacttgctcacagtttccatagagcctcccattggctgctcacaccccaatcatacccctggcagctcccccttcccctctgcctctgcctccaacatccccacgctctgttccttccttggctccttggtttttgtgagtcctcctctgcttgcacacaatttccaagtgttcagcctcctcttgggccaaaagtgggtgggtttggccttagggccctcttcccccaggcttctgagcctgcagttctccccactcacacccagacatacccaccccctccacacacacacacataaacacatattctccaagcctgcaccctccttccctctttccccaagaaaaattgccaggcccatgaggaccccgctgttgacttgggtcatttggttaactagccacacttccgtgccaacttatcccttaaattcataacctatgagaattaaaagaagaattatcttagcactttggagcagtaagtatggatggaacaagggggctgcttctgtctgactgtcatagagctaccctcttggcgccatctgtgagggggctggggctggagagggaaaggaaggaaagaccttcactaagctccccactgcagctgcttcagcctctgccttgagttctggggtccccacaaggctcaccctgatcactgagggcggatctgaatgatgctgataaggagcaggggaaggacctaggggccttgtgaagtgaaccaagtcaacacttggctctcacctctgcaccttcgactgctgggggtgcagaagggatggggcagtggtgcaggccattgtagctcagggtggtggcagacatggagaagagaagcatggtgccaggagggggagggcatcatctccaggtgctcagattgtgagtgtctggcagtcagaaagggagggctagaggccatatgtcaggatggggagcagggttggtggctctggccaggaagatgtctagactctaggtctgcagagaagaaccactctgagctgactgaacccccagccgggccctggagagcagccccaggcttcttgcatccctcccattgcgttggggactcattgtcctcagcatcaccgagatctgctggctcctcccgcactctgagcccgtcacccacctgtttcctacttttgattctgagtctggctcaccatcagataagctgacatctgaaaccctggctttatgctgtccaaaggaacaaattagaggctgttgattctcatcactgcagaagtcttgactgtaaaaaagaattcccctttagaaatggaggccagccctaatgcacttaaatattttcttccagctcatttgctacgtaaaaggaggctggagcaatcctccaaacaatctcgagcctagagagattggagccattgcctgctgaagtgccatcagccacgaagctacaacatctccacgctgagaaccacagtcagggggaggacaggatttgactttcatgctatctgaactccaaccctgccaatgcacaaagaggtacttgcgacttttcaggaacatgccagtctcatcaggaatgacgcacctgtttttcctctctcagtctggcctgtcttgtgatgactttaaaagcccaaacgtatgctccggtggggaccctgctggcaatgcccctccactgctctgtggtcctgcatgtgtctctttgtctgcccagccccccatcccagtcgccttctccagggccctgtgctgtctccagtgccagctttgctgccctgggatacatcatgctctgtctggtggccctctgcttcccttgccttagttctttgcgaggagaggcctggctcaggttacacgggtgcttagtgctgaggactggggatggagtagagatgcccttccctgagcaggaggggtacagtaggctctcctcacactcccactgtgactgcaggctttgagctgggcctgcggagggggaggagaaggggaaaaagaggggtgctcagagaccgagggacacttggccctggaccaggagttctcagactcacaagagcaaagtgtatcccaggtcaggaggcagtggaggagtgtacgtggtggtagcggggtgatgagaggcagcgtggagaggggtcgggggtggacatttcaagtcaggacagactgtggagaggaggaagtgtggttttcaggctggaactttgactggggactctggctggggacagcatgccagtccgggccaaggacaaagtggttctgggattcctgcttctaacccaggacaggagccagcgggagcaggacatgtgtacctggacccttggctggtggccacttccagggacatgcccttccttggctccaggagaagtcagggagtagagaagtcagtgagagccctgaaagtttccagcacgaggcttgagcaaaatgtgagggcaacgaatttatccaaatcacagtggacagatgacctaatgaagacgggggaattaaagcacgaagtggcaggctctggaccagccacatggtgttcgggcatcctggctgacttcccttcccttgaaaccagctctctcccctttgctagtactgtcccaatggctgggacccaggagggtctgagtggttgtctattggccaggggtctccccacagcctctggggggagcaccaagtgtgcagatccaggagccctaccttcctctggaacactctctgcacccagtcttcttcttccctgaaggcaccaccctggactatttgcctgtggtggtattgtgcaagtgtcatgccttgccaatgacaccagatggtaggctccctgaggataggctggtatggtgtatcattcgtatcttacattcgtatcttttgctccctctgttacctgcctgacaggagtttctgtggaaaaagcctacccacttcttactgtggtggtggctcacttcgtgttcaggtcttgaatagagaaatcaccggccagctacctggaggcaggaggtgccagccccaaccactgcacctttctgagaagccaggcagtgttcccagagccacagcagggccaaaaagcaagagcagagaaaggaggtggcctgcgatgagaggcaggcagagctggctgggcccctcggaggctcctgggctgcatgccatcctcctgttctggagggtttggaaccacttagggccctgtgcccttgccccaggaaactcactgccctgccttctccttctttctgctcccacctccctgtgactccagccatggtcctggcgttagtccacctggtcttggccttccccttgtgtggtgccaggcaggcagcaatgacagccagatcataggactgtggcagctggaggtgggagctggcagccccaggagacattgacacagaggacaggcagcctgggatggggctgctggggcgtggttggggaccaggctaggggcggacatgggcactagtgccaagtattggcaggtgagggcaaaaggactcccctttcctgagctgcagggaggggtcgggtcaggtgctgtgcttcctcctttggtgcctagcggcagggagactaaagtgaagcatgtccgtgcctgggacagaaaggaaggctggagccaggatgtaagagaaccaagtctctgggggtgggatggaggctatggggagggcatcctgtgcaggggaggagaccagccaggaccttggggttagggaggagaagaccagcccagcccggctgggcccggccctgcctgggggaggctgcctctgctcacacatgcaggccgaaaggagcaacagctgggctccatgccgccaccccctccgcgcactcctgcctatgcaacaagtgtcacgtctgcatgttggcacatcatccccggtttcccgcgcccctggactggcgggaggctcccagccttcagggaccagaagacgttcaacatgggagcccagcccactcgactctggtcagttccttccatcgatccacgagggagcgggcatgtcccccgcctccacctctaccacgcggggtgcagggcgtgggacacgcggcgcacacctgtggtcctgagctcctgggactgcgagcgacggttaggagggacaaggtgacgggcaggtgatgccaaaggccgagttgagccccgcaaaagaagcagtccttgtggccagccgccccatggctcggggcgctctgtcaatctgctgcctggcgctggccggcgcgtggctgctactgcacggctcgcgccgggctccccgggaggcggggagagtgcgaatagggcggagggaaaggagcacgccggctgcagcccgggcgagcgggagggcgcgcactcacctccacacaccgcggtcaaggagagccagagcagcaggagcgcctgcacgcagagccgcagattcatgctgctccttgggccgccgcggccccggcgagccggcgcgggggaggagaggtcgggcgcccggaggccaagaaaggcgcgagccgcggctggcgcgtgcgggcgcagagctcgggaggctccccggccgctgagtgtgcgcgctgagccccgccgctcccgctggccgcctccgctcttctgcagcctcctctcccgccgcggggcagcgccgcgaagctggcctcggcggctccgggagcggcagcggcgagctctttcttagcggctggctgctcggccgcggctgcaactgcccgtgaccccggctgccagagagaatgctccccgctcactccaggggctgcattttgtagcttgtggcttggccgcgagcccacttggtcatgtggtcatcgggagggctagagggggggcaggaagagggagagggagcgagcctcccgcaccgcccccctccaggcacgcactctgcagccccagcccgagcgtgagcgcgagagggaaccccgaggtggccccacaacaaaggctgcgcggcctctctgacaacctacaaccgctccccggacaatgcccgcctggccgggggccagagggtttgcagagacctgaaggatttcaaacacaggaagcatttggggcggtggaggggcacacttaaccctttctcaccttgcttccttaacagctgtcaggaaacctgggcgcttagggaaggactcagtctgggttgccttcactcacgccctctacctctgaccctggtccttgcccttgccgctggccagcttcaagggtttggtcaagacaaccaaacactggccctcctctctcctctgcattttcaactggctttgaattgggggtgactgcctaggcttgtgcccaaggcttgattaattgcccaggcccctcatgttccctgcatcccccaggaggcaccctctacctggaatgcccccaccccacccttccgtgagcaattcattctttgcagcagcacctcaaatcccatcgcatccagaagccttctcaggataacactaatccagcaggggccgcccatcagctcctccccactgttgggacatgggacagctcctatggtctaccctttcttgttccctggagctgtcctcattctagttccccatcaacgtaagaggcaggtggtttacccaactccacacagtcaaggctggattcattttgcgtgtacttgcgattccgctttagaagcgggtcctgaagttgtttgcctttccagactcgattgttagctgcttctatagcttgggagctcccaaggcatggggctgcttccctcattggactgggaaccccctaaggtaggatactgtcttctcactcttctggatctctccaaagtccccaatatcttgctctgcacataggtggcactcaacacatattaaaagactgaatcgaaaggtgtctccacctttcagcaagccaggcagtttgcttgaagtgttaagtccagatttacacaaaagatacattggacagggtgcgtgtgtgccataaaagacatgagagaccatggcatatttaaaatatctttgaaatgttgcaaaaatcctatatatacacaatgtatttattatcagtctctctccaccagaagggttacctccacaagggagggatctttgctttgttcacagctgtgtccccagacctagaacagtacctgcgacatgactggtactcaatacataattttgaatatataaatgaaattttcaaaaacatctttactgcctaaattcaggtagcaggaagggaataagataaggttctcattaatagcctatggcccattaaccacactcaagtaaaaaaaaaaagcatgtgaagcatggcacccctcttcatccttgagacccaggatatgagtagcagacatgggtagcaggagaccattctcccttcactgttcccctggaaagagtttgctttctttctcttttctttttctttttttcttttttctttctttcttcttttttttttttttttttttgagaccgagttttgctctgtcgctcaagctggagtgcaataccctatctcagctcactgcaacctccgcctcccaggttcaagcgattctcctgcctcagcctcctgagtagctgggattacaggcatgcgccaccatgcccgactaattttgtatttttagtagagacggggtttcaccaggttggtcaggctggtctcgaactcctgacctcagatgatccacccgcctcggcctcccaaagtgttgggattacaggcgttagccaccacgcctggatggaaagcattttctaaccaggaggagaaacacctggcttctagtctccaccctcatttgctgtagggccttgccatcatcacctaaacttactggggttcatggaggtgataatctctgctctacccacttcaaagttgttatgggattaagtgagataatgtgcctgaaggtaccgtgcaaattaagaataagctcttgcagggttgtttttaggaaacttggtgctccaatccttgattgggcaagcccatgcacacccaaataagtgtcccccataactaggttaatagaagccttcatatttaattgcacctttactagggtgtgtatggcatattgctaagtggttggaacacatagcgctttctaatacaatagccactaatcatatttccaatgaagtttaaaattcagttcctcagttccactggccacgcttcaattgcctatatgtggctagtggctactgtattggacagcacagaatagaatcttcaatcactgcagaaagttctattggttagagcattcattcattcttcttttttctataatccattttcccaccctacctagccttcaaaatgtacaaggtgaggggaaaaaaagcataaaagcaaaccaatagaaattcaagccaagctgaaggcatgcgtttagagtaagatttaaagatctgacacttgggagaatcattttttaattgaatccttctcttcatttaaccaaattacatccatttttttttagaggcagggtcttgctctgttaccctaggctgaagtgcagtagtgcaatcacagcccaatgcaggctcaaacttctaggctcaagtgatcctcccacctcagcctcccaagtagctgggactacagacatgcaccaccataccaggctaatttttaaatttatttatattttttgtagagactgagtcttactatgtttctcaggctggtcttaaactcctggtctcaagcaatcctcccatctcggcctcccaaagtgctgggattacaagtgtgagtcaccatgcctggccacatctgttttcgtagtcccagatccaagatttcatctttctttctcaggacacccttgcccacagtgactttgccctctccataacagctatggctgtacctgtcattggtaggtcctctcacagtgcatcaggaacacttttgcatctgcacactgtgctctacgggcctgctgtaattctgcagagaggacccatcaccaccatatccattcaggggtcaaggcccatgaggcaaggaacgcagctctgattgcccactctgaaccccttgtaggctcccagatatcttaatatcagattgaaatgaccagttttcgaatatctgtatctatttgccagactttaaggtcactgctgtgatagcacctagcacaatgcctggcacataattgatacttcataactgcctgtcaggtgagcaactgtcggcccaacactgtgctgtcttttgttcaggatactattgaatgaatatcagcaggataaatgttttaaggcataagtctccaatccctgggccatggaccactatggctccctgttctattaggaaccaggcctcacagcaggaggtgagcagcagatgggccagcgaagcatcatctgtatttacagccgctctccattgctcccattaccacctgagctccaccttctgtcagatcagcagtggcgttacattgtcataggagcacgaaccctattgtaaactgcatgtgtgagggatctaggttgcatgttctttatgagaatctaatgcctgatgatctgtcactgtctctcatcacccccagatgggaccatctagttgtaggaaaacaaactcagggctcccactgattctacattgtggtgagttgtagcattatttcattatatattacaaaaaaaaaatagaaataaagtgcacaataaatataatgcacttgagtcatcctgaaaccatccctcctaaccctagtccatggaaaagttgtctttcatgaaaccaatccctgatgccaaaaatgtggggaccactgtttcaaggtatttctctggagatgggaaggaggtacatgaaactgtccacactctcctgccctgaggcagcaagtagctgtaaaatttctggaaatgttgctgcatttggggctcaggacctgtggtcagcagcaagactcagtttccagtcaaggtgagggacaatcctgggggcaagggtaggactcagtgcattgttggggacagaagtgagatagctgacctatgtgagttcaaagtgtgacttgcccccctcatcagagctatccacatgctattcagttctgcttattgtcctatgtcaccaccagccactgctgttcagttgactcatccacgtctcttgtgggttaaagtgaacagtgtgaggcattaaaaagaactcagcttttggagtttcacataactgaattcaaatcctgcccctcaaccccattcgttagctgtgtgaccttgggcaagttattcagcttctctgaggctcagttttttcctctgttaaatgaggataataatggtacctaattttttaagtgctaaggtttgaatgtatgtgtccctccaaaattcatatgtttaatttttttgtttttgtttttggagatggagtttcactcttgttgcccaggctatagtgcaatggtacgatcttggctcaccgtaacctctgcctcccgggttcaagtgattcccctgcctcagcctccagagtagctgggattacacgcatgtgccaccacatccggctaattttttatatttttagtagagatggggtttctccatgttggtcaggctggtctcaaactcctgacctcaggtgatccccccgccttggcctcccaaagtgctgtgattacaggcgtgagccaccacgcctggcctcatatgttgaaattaaaagcccaaggtgatgtgttaagaggaagggccttttgagattgattaagtcatgagggttccaccctcatgaattaattagtgctcttataaaagaagttggaaggggcaccctagttccctttttgcccttctgtcccttatgtcatatgaggacacagtgtttgaacgctccagaggaagcagcattcaagacaccatctagtaagcacagactgggccctcatcagacacagaaactgccagcaccttgatctcagacttcccagcctccagaactgtaagaaataaatttggattatttataattatccagtctcgagtattctgttatagcaacaggaatggacaaagacattatggttgggagattaaatgagataatgtgtgtaaaatacttagcacagtcccctgctcattggatgttagttttctcctcttcctgacctgcttctccccccacctttgggtctatcctctggccttctgaaactgatcaggaagaaagggct

SEQ ID NO: 7432 - DNA, 1939 bp, artificial
  synthetic oligonucleotide
catatcttgaatgtggtagtggttacatgactgtttacctttgtttacctttgttaaatctcattgaacttgtacacatcaaagggtgaaattatgccttcataaacctgactttaaaaagtctcaggccagaactgctctcatttgttaagatgaagaaatcatttacaagcttgtgtgctttgttgtttatttcaaaattacatgcaacacacttcacaatgaccagtgatgcctgtgcccagtgggaggtccccgttagatgctcagccacctccagcgatgaggagcccatcacttaatattgcagcccatatcattgtcaggagaattgtaatagaaagttcttgattaggcctgtaatcccagcactttgggaggcctaggcggacggatcatttgaggtcaagagtttgaaaccagcctgcccaacatggcaaaaccccttctctactaaaaatacaaaaattagcagggcgtgttggtgcatgcctgtaattccagctactgggggtgctgaggcaccagaattgattgaacccaggaggcggaggttgcagtgagccaagatcacaccactgcactccagcctgggcaacagagtgagaccctgtctcaaaaaaaaaaaaaaaaaaaaagaaaagaaagaaagaaagaaaagaaaaaataaagttatttattaggctactagttagctgtgtggccttgggtagattacttcctgtctctgggccttaatttccttataagaaaagatgacctctgagatcccttctcgctctaacattctaagtctctaaaactgggaatttaagttttgacctggttttgccttctggagtcacacagaacttaaccctgtgtgttgccaacagtcagccagcccatcgtacactagaagtcagctagcagctcagctccctagggcaaacatcatcccctggcctttcccattgtcctaccaagaaatggaattgcaggatctggtgatggttaggatcacaggatcaggagtcaagcagcctggagtctgactgtggactttgccacttcccaccgtgtgaccttaggcaggtcacttgtgcaatcttcagtgtcctatctgtagaaagggaattagtagtaccagcctcctggggagagggcgtgggcattaaatgaggtaatgtgtgtaaatcaggatgtgtggtaggcaggataatggactccccaatatctgcacatcctaatccccacaacctgtgaatatattgtgttacagtggcaagaggaaattaaggctgctaatcagctgactttaaaatacggagatcagcggggcatggtggctcatgcctataatcccagcacttcgggaggccaaggcaggtggatcacttgaggccaggagttccagaccagcttggacaacatggcaaaaccttgtctctactaaaaatacaaaaaattagtcaggtgtggtggtatgcacctgtaatcccagctacccgggaggctgaggcaagagaattgctcgaacccaggaggcagaggctgaagtgagccgagatcacaccattgcactccagcctgggcaacagagcgaatctccatctcaaaataaaataaaatagagagattggggaataatgatcttggattatccagagaggcccaatatgatcacgagggtccctataagtgaaagacagaggcaggaaagtcagactcagaatgctgcaatgtgagaaagtctccaccagccattgctggctttgaagatggaaaggcatcgtgaggcaaagcatgcaggcagcctctcgaagctgaacaaggcagggaaacagatcctccccttgagcctctaggaggaacgcagacttgctgaccccttgattttagcccagtgggactcctgttgaacttctggcctacagaactgtaaaagagtacatttgtg

SEQ ID NO: 7433 - DNA, 1175 bp, artificial
  synthetic oligonucleotide
gaaagcagctgtctggaccgacagtcgctactggactcaggctgagcggcagatggactgcaactgggagctccataaggaaggtagaagggccgcatggatttgttccccaagtcttgggacctggactaggttcaggaaggtataggtgagagcgtgcatgtaagaccatgctgggcctctatggggagcttaggaaatttgaggccatcactgactttcaaggctgatctcaaggaagacacacatggtaggaccatcagacagaacccctggctggagagcctggggctggccctgaaggtgacctctgcattgcttcctatctttctttcagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaagaaatggaccttggtagaaggaggggcggtgggactataaagatagagcatttgaaattgtagttgcagaatgttttgcaatgaggatgtattcatggattgtgtaattaaaatacatttaaaagaatcagtacaaatattttaaaattcatgagtgcagagacccaacctagaagactcagtgaatcattaaagagctagtggatgaataggccaggatgtgcttgaacccagaaccatcctctgtgccctggaaccctgccaatgatgatgctggaatcacatggtaaccctcttctggaaggtagcttagaagggtcaaaagagttgggagggcttctgagtttaaaaaaaaaagggcccctgagaatacaactcccggagttctggggcctcagacagctggcaagcccattcccccaaaggggagtcctcatgaatatgtactgaaaggcttgtgctttagaactggcttctctgccagcctgtccaatggcctgaacatcaccattccttttgactgtgacactgaagccctgataaaataattagtgcccaagagaaggaccacccacagccactggcaatgaaaaagacaagcttagccaatttgtggcagtcagtgttagagtaggctcagggcattaggcttggaaagcagaaagaggatgagaaacatac

SEQ ID NO: 7434 - DNA, 3425 bp, artificial
  synthetic oligonucleotide
gaaacaatgtttatggaaacaatgccataaacaaagccaagagatgtgtgacaaatatctcttggctttgtttatggcattgtgagagggtgagttttcttattttaccatgagctttttacaaatccgtaagacaaaaatagacaaaacaggaaaaaatagggcaaaggacatgaaaaggcaattcactaaaattaacaccaaatggtccacatgcatgtggaaagatgctcaagttcatccttaaagaaatacaagaccgggcgtggtggcttatgcctgtaatcccagcactttggaaggccgaggctggtggatcacctgaggtcaggagttcgagaccagcctgaccaacacggagaaaccccatatctactaaaaatacaaaattagccgggtgtggtggtgcatgcctgtaatcccagctactcatggggctgaggcaggagaatcacttgaacctgggaggcggaggttgcggtgagccaagatcatgccattgtactccaacctgggcaacaagagcaaaactctgtctcaaaaaaaaaaaaaaaatacaaatcagggccaggcatggtggctcacacctgtaatcccaacactttgggaggcagaagtcagcggatcacttgaggtcaggagttcaagaccagcctggccaacatggtgaagccccatttctactaaaaatacaaaaattagccaggcgtggtagtgtgtgcctgtaatctcagctactcaggaggctgaggcaagagaatcgcttgaacccgggaggtggaggttgcggtgagccaagatcacaccactgcactccagcctgggcgacagagcgagaatctgtctctaaaaaaagaagaaggaaaagaaagaaaagagaagggaaaaaaaagtctctttcttgctcagtttccttcctgagaacatttcaggcacacacagcgtatgtatctatctatgtatatattttgaaaatacaaacaaaatggattctactgtacatacttttctgcaccttccttccctgccccgctgccccttacttaatagtaaacctaggagagtggtctgcaatagcgcagggagatctacctcattcttttgaagggttgtcgaagagcctatagtatgtggatgtcccatgatttatttaaccaaccgtggatattgaggctgtttccaaatttttactatatttgccatcaatgctacaaatcactgtataaacatcttggtgagcttttgggactatatccagaaggtacatatctggcgtagggatttccaagacaaaaagtacaagcatttttaataggtaatttgatagatattgtcaaactgccctccagaaaggttgcaccaattgtactttctccaacagtgtgtgagagtgcccatttcctcacatactcactagcactgagaatcatcgaagtcactaatttttccaatctgataggtgaaacatggtattctattgttgttttgacttgtatttctttttttctttctttctttcttttttttttttttttttttttgatggagtctccctctttctcccaggctggagtgcagtggcgagatcttggctcactgcaacctccgcctcccaggttcaagtgattctcttgccttagtctcttgagtagctggaattacaggcacacaccaccacgactggctaatttttgtatttttagtagaaacagggtttcaccgtgttggccaggctggtcttgaactcctgacctcaggtgatgcacctgccttggcctcccaaagttctggattacaggcgtgagccaccacacccagccttgaatttctttaaggatgaacttgagcatctttccacatgtatgtgaaccatttggtgttaaattttagtgaattgctttttcatgtcctttgccttattttttcctgttttgcctatttttgtcttatggatttgtaaaagctcatggtaaatatgaaaattcaccctctctctgtgatatgtgctatatttgtcacacaactcttggctttgtttatggcattgtttccataaacattgtttccattttctgtttagtttagtcagagttattaatcttttccttcatagcttctggtcttgcacagaaagactcttttccaccctgagattataaatgaattgatataggttttcctctacatcttttgtggtttcagcctcccgagtagctgggactacaggcgcccaccaccatgcccaactaatttttgtgtttttagtagagagtagagacggggtttcaccatgttggtaatgctggtcttgaactcctgacctcaaatgatccacccacctcagcctcccaaagtgctgggattacaggcgtaagccatccattgcacctggcctctttttttttttttagagacagggtctcactctgttgctgaggctggagtgcagtggcacgatcacagcccgctgcagcttcaacctcctgggctcaggtgatgctcccacccttccacctcagactcccaaataactaggactatagatggacaccaccatgctcagctaatttttgtgtttttttgtagagactggtgtattagtctgttctcacattgctataaagatactacccaagactgggtaatttttaaaggaaagaggtttaattggctcacagttcccacatgcctggggaggccttgggaaacttataatcatggcagaaggcgaaggggaagcaaggatctcgacatggtggcaggaaagagagagctaacaagagcagggaaaactgtcttataaaaccatcagatcagccaggcgtggtgggtcatgcctgtaatcccagcactttgggaagctgaggtgggtggttcacctgagcttaggagttcgagaccagcctagccaacatggtgaaacctcatctctacaaaaaatacaaaaagtatctgggtgtggtggtgcccatcaataatcccagctacttggaaggctgaggtagaaggatcacctgagcccaggaggtagaggctgcagagggccgtcatcgtgtcactgctctccagcttgggtaacagagggagatcctatctcaaaaaaaataaaataaaataattgaaatttagatttctgggccctgccctaaggattctgcctccagtaggtttgggaggtgggccctggaatctgcatatttatcatgctccctaagtgctgttgatgtgcgtactttgaaaaacacaaacctaagtctaaatttccagaatcaggagggaagcaccaaaggtggagcactaagtggcagacaagggggctggccaagagaagggactctagaaggctcaggcctagccagggtgtccagggttgatgaggcccagctccttgtgtcctccgggtggagtgctccttccttcccttc

SEQ ID NO: 7435 - DNA, 2252 bp, artificial
  synthetic oligonucleotide
tggtaccacctcccccgtcaggcacgactcccaggaagtcctcactccaaagggaagccagcagaaaagccagccaggctcaagaatttcaactcaaccctgaatgggggtcacctctctctgaaaggcggtcaagatacttggggctgtccctgaggttggaggtaggcttggcaaaatgccaccctggagggccctgaaactcgatcacccaaagaacatgtgtttgtcctttccatctccctgggctgagagtagccaactgggcccaagacccagcaccatctctatagtcctttgtgattatctcctcccactttggactaaaactgagacagagggaccctcgcacaagggtctgggagccaaaggcctttcctcccagcccccagactgcagattaatgacaggaaaaggccttgggaaagagctgcaattagagggcaggcaggcagtgaatttactcttccccaacaaagccgacttccggccccatgcctgccctcctgcttgctttccagcctcaccagtccccagggtttcaggggcgactcttagcctcctggtctgcagatcaggctgagggttggtggagagaaggccacaataggccccatcggcctataaatagcagcccagcctgccctccttgggcccaggccagcccgatgcccaccctctctccgttccctcttttccatgcaataagaggaggaagttatccaggcagctgcatcctagccatacaagaggaggaaataaatggaaggtggaggagagaaggggaaagaaagggagaaaaagaggaaagaatagtgggaggggacaaccaagaaaggaagatggaggagatgcaggtgaaccagagtggtcaccctgtggtcatgcttcccctcccccacacccacctatggcccccttttcagctccccagggcaacacagaggaggctttctgacagaggctgcaggcaccccacccatcaggccccaatcgtgctagcgtctgcttggcctgaccactgacctagtttctcatcaactaccttgctgtgacttttaggaatgtgtgacccctgacccccaattgctgacttggctttggtcaagacccatcaagagtactaaactgctacactgcagtccccaggagttggggccaattatttgtgtgtgtgttggtgggggacaggtgatattgcccctgccctgggagtttgtcactggacacacacaacccctttagtaggaaagaggatgtgaaaccttcaacgttgtgtgggtttggggcttcagttcctcaagcccttatctcgggtgtctgcagtctatcccactctatctgtctggccatctgtgaaccctggttcctgtgtgtatcttctggtcttgactgtttatcttgatacaggctcagccttaacttcttgtgtcgagggcctgtcccccttacctgccttgccctggtttctggctgctaccttgcatgtgcatgcatatatatttaagaaagctcactagactgggctcggtggctcacgcctgtaatcccagcactttgggaggctgaggcggcagatcgcgaggtcaggagatcaaggccatcctggctaacatggtgaagcctcgtctctactgaaaatacaaaaaattagccgggcctggtggcaggcacctgtagtcccagctactcaggaggctgaggcaggagaatggcatgaacctgggaggcagagcttgcagtgagcagagatctcgccactgcactccagcctgggtgacagggcgagactccatctcagaaaaaaaaaaaaaaggcaagctcagccgggcatggtggctcacacctgtaatcccagcactttgggaggccgaggtgggcagatcacctgaggtcaggagttcgagaccagcctgaccaacatggtgaaaccccgtctccactaaaaatacaaaaaataataataataaaataaagctcatatcctgaaaaacatctcatcaacacagaccacaaacaataataggtcatgcctaaaagtccaaacactggcaaacgtcactattgccagctcatcacattagtggctaagattaaaagctgagaagaaaaagaaaatggtgtctttcttctaccaaattagccccaatcacgtatgtcctaaatctgtgggccccttctgtgaataagcctctactgtgcttttccagaaagtgtcatgccaggtcttgctggcttctagtcagattgtc

SEQ ID NO: 7436 - DNA, 1209 bp, artificial
  synthetic oligonucleotide
catacacatttgtaggctcacacaaaagtgcagagatttacatattaaattgcatttaaattagaaaatagatttaaaaacaaaatactttttttctccaacaaagtaaagagatttggtcagtaggaacgggtgctttatgggtaaaggcaggatggtcaggacagggagaatggaatttagctgctacggaatcagaatccacctctaacccaacctcactcctggggtaaaagcaaaggaggagatgatgatctcagctagggccaggaaggcctcagagctgaatggacatgaagaaatggctcaccacagccaatttccacctgcccccagaggtttgggatcagtgccaaccatcctggcctgggaaagtagggtgcataggaagcttgaggaagaaggaggaaggggagagttggagacagtgtcagccattgaaaagaccaaacaatttaaggcccttttcccctgggaacattgattctttaatctcccctctgatcagatagggacagtcccagctggtgcatggtatgaatgggacagatcttcaggccaacatcttaaacatggaagatttattaaggaaaagaaagagggcagggagtatgaaaaagcagaaaatcatttcacactagagataagagatttccactttgacccttcccatcagaaagagaaagcttctctgtctgacctaagggtcctcaggagaacacttgaggtaaggtgagggaggagagagagccatctgagcccaggagaggagatgggctgagtacttattaaaatggggttcatatgagtgccaagttacctggggaaacctaacaacttacaaattctccaggtttggctttataacttcaagaaaaaaaactgagagaaccagaaaaagaagcagacaggagagggatctgagtcagtctctccccatctctcttccaatctctctctctctctctctctcaagaatgctcaacttaaatcctgttaaaaggaaaaaggaagacatggaaaaaggtctgggagcagccaaatttcattaattccaattaactgggaagtatgagatgggaattgatagggagtcttgattatacaccacctagaaagaaatatataccatcacttgtaaaagaccactgatcaaatatttccaagggggggccctgatgagcctgcgttaataactaagacttatta

SEQ ID NO: 7437 - DNA, 806 bp, artificial
  synthetic oligonucleotide
ttgaaaacagagttttcacttggaggcagactataagtggatgagcaaggagcagagagagagcagagaaagtaagctaagaaaaacgcttacctcatcagcatgggaagtaagcaagctactggccattcaaagcaaacgtttaactcctggttatatattctctgcagtttcggaacaacccccatgaggtcttcccctagctccctgccacacacacaacttcatggggggacacaagccaagttttatattagactaagcagtttttgatgaaggtgcacatatgtactgaacctgaaggatgattttcgtgacttttgtgtttgcttgcttgcttatttttaacaaaatccttcatcttaagttgcttttttaatgatttacttccttctcctaaaagccaagggttgggggaaaactggagaactgaaggatctggcagctgagttcagggtaattaaggttcttacatatcactagcttgtggattaccctattttccactactccttttcactggtacagattaaccaaaaagggaattcagaagcaaaaatcacctccacttatcaggaacccaaaggatgcaggaaaagcatgaggcttcatttcatgaacaagccaagtgaaattaccacactaacagcaaataggaatcttcctggccactgcccatcactaagatcattcttgaaaacaaagaagtaatgtctccaggacgcaaactgccctggatgtatagtctccaatcaaaagccttaaaaatcagatgtatctgattggccaccaaagagagcttaatt

SEQ ID NO: 7438 - DNA, 2291 bp, artificial
  synthetic oligonucleotide
tgctgcctattatattatgccccaaactccacaggtcagtattccaaggctctccattaactggccttatctaatcatcatcataggggccctgtcttccccactccattccagaaacatcccactaattaattaccctgaattagctagcttcttgctactgcaaatagcctaaggtacctcctttgttcttaagcacaataccagcaccagcatctctgaggagaaagatttaggagtctcttctttccctcaataacatctcaactgatgtcagcatgttggggaacatccctgttctctgggcttgcttttcccaaaacagaggatcactatatttaattaagactcatcctcaaaagatgggagaggcattcagtggagactgaaaatgtgaaactcattaccacaaaaggaaatagaggctgaaaatgtagagaaattctgaatgacagaaccataaagaattattaaaggagccaggcatggtggcttacacctgtaatcccagcactttgggaggccaaggctgttggatcacttgagctcaggagttcaagaccagcctgggcaagatggtgagatcctgtctctacaaaaaatacaaaacttagtcaggcatagtggctcactcctgtagtcccagatacttgggaggctgaggtgggaggactgtttaagcccaggaggcagaggatgcagtgagccaagatcacaccactgcactccagcctaggcaagagagggagaccctatctcaaaaaaaaaaaaaaaaagaggaaaaaaaagaattattaaaagaaagcaaactgccgccaggtgcagtagctcacgcctgtaatcccagcactttgggaggcagaggcgggcggatcacctgaagtcaggagttcgagaccagcctggccaacacggagaaactctgtctctactaaaaaatacaaaattagcaaggcgtggtggcgcatgcctgtaatcccagctactcaggaggctgaggcaggagaatcgcttgaacccgggaggcggaggttgcagtgagccgagattgtgccattgcactccagcctgggcaacaagaatgaaactccgtctcaaagaaaaaaaaagaaaaagaaaagaaaaagaaagcaaactgttcaggagatacaacccaaggaactcttgggaagaactctctctcaaggaacatacttcatcaggaagttaagtttagctaagtactgtaacagattgataccaaagaggcaactatgcctttctaaaactcatttggttagtcaagtcacagacagaatccgaagctagataaagccaagactgacctccatagagtcattccccagagaatgcactcttggttacagagcacaatatagtcactttttcctcttcccaatctcacataaggatgctcttcaggaacctggaccttgtcactgtgggcactaacattctggtatgtcaaagtttggctttggtctacatagtcttgtgtctcctcaaacctagtaagttcatattatcaggtctgctttttctatttcacctgtctgccagacacacctcctctttcttttttctattttatttatttatttatttatttagatggagttttgttcttgttttgttgcccaggctggagtgcaatggcacaatctcggctcactgcaacctccgcctcccaagttcaagtgattctcctgcctcagcctcccaagtagctgggaatacaggtgtgcaccaccaagcccagctgactttttgtacttttagtagagacagggtttcaccatgttggcccggctggtctcgaactcctgacctcaagtgatccacctgcctcagcatcccaaagtgctgggattacaggcatgagccactgcgcccagcccacactgcccctttcatcaggataagtcactaagtaacaatgtacagagcacacattgcttgatttttctccaagccatcctcatcttggcagcagggaccaggagtggccacagcagtgatgatcccttgttaactcacaaagctcctgataggcttccctgttcctgcaaggctaccagaaatgccatgctgcaataccatcagttctctgcaaagatgccttcattttctaggagcataagcttgggagacccaaagagcctagatgccactgggtaacacacacactagctcgcaagaatctggaatatgctggcctagtatttggtactatgtacactttactaaagcatgtgtgtttgaatatcttcaggattccatagccaaagggt

SEQ ID NO: 7439 - DNA, 3596 bp, artificial
  synthetic oligonucleotide
tgccgagtccgaggccgcccccgccacccttctctaatccttgtaggtcccactttcccctgggcagttctcctcctgcatcggtagccccgtcccgtctgtgcagcccccaccgtggtctttgggtcatctcgaagagctgcgttaaatccctgccctcagcgctgcacacacgcccatccgcctccaccctcgggtccccgcaccacccccttttcccgtgtcggctcccccttcccctcccgagaccgcggaagctccgacccccttccctcgctgactgtccatccccaggacccccgtccctgtgtgtggccagtcccagcggcctctccttcgcggcctcccttcgccttcgtggccagcgtggtggagcactcccgccccccttttctccgtacccccgcgctcccttatgttgtcccttcttgtccctctctaagtccctcccacactatgcccccccgcggtacacacacacccctccccgcgaggcgtcccccggcgcccctcccctacccccgctcgtctatgcccctcccacccaccccgtccttttgtctcctctttggtctctaagtcccccgcccctccctcgctcccgccctcactcccccgagcacgctcttatcttccccaggtcccagcgccccgccccgcggccgcgccccgcggccccctcccttccgcggccccgtctccgccctccgcgctccgccctcccccccgcggctcctgcccgccagcccggccggcctccggttcccgggtcgctcctcctgcggcagccgccgctccccgacccacccttcccgggccggcggctcgcgttcccgcgcggtctccccacacacgcactcccgccgccccgctccgctcgctcgctcgccgaggccctgcagcggcccggcccagcgcagcgcgcagcccgcagcccgtcctcggggagcctcggcgccccgtggccgcaggcacctcgcggacaggcgggctggcggcccgggagcgcgaacccgagccgggctgggtgtccctcgcccagcctggccctcggaagcctcgcggggcgcaggggcccgtcggaaatgtttgggggacgggccggccgcggttcctcccgcagcccaggccgggccggcgcgtcccggggagtcgccgcgaccttatctccgaggatgacttgatccggagcctcctcccggctcccgccccaaacctgtgccaccaacgcgcgaagcgcagctgagactcgcggctggcgggaggagggcgggggactgtcctgaaaatgcccaagccgtgagggatcctaagccgaccgtcagacccggagaggcgaggtctagtgacacgtccctgccacccagggaaagagggcgagcccacgccaagcgccacggatccctgcctctccgcccagggttctccccactacgcattgcagagcccttggatagacctcgccggacccagagtgagggacgtggctcaagtcgacagaacacccagccacccacccacatgccaatagacacttttaaaaagtctgatcgggtcgggctcggtggctcacgcctgtactcccaacactttgggaggtcgaggtgggcgggtcacgggaggtcaggagttcgagaccaccctgaccaacatggcgaaaccccatctctactaaaaatacaaaaattagccgggcgtggtggtgggcgcctgtagtcccagctactcgggaggctgaggcatgagaatcgcttgaacccaggaggtgtaggttccagtgagccaaaatcgcgccactgcactccagcctgggcaacagagtgagactctgtctcaaaaaaaaaaaaaaaaaaaaagaataaaaagtcttcgatgatgcccaagttgaccgtgtttcctcgcccgaacctcttctcccaagccctcactcagtcttacctacttacccaccagactggaagctctttgaaggggttcctgtttgttgcagtggctcactcaatggatcccttgtgattggtggacaagtggatgtatttgttaactgctcgcctttgggatctgtgtcattgtgtgacttaaggttgtaaactcgggagggccaggaccgggtggggattactagctcgtgccaggcacagcatgatacccaaagggatgggccatcaatgctttttgagactgatgtaactaattatgcaggaggcagatgcctacctcttggtccccagaactgccagttccagggctaagtctgagtgaggaagaaacgaaggagctgtcttagctcatccctaatgggaggccgactcgctgggactagatatggctgcagtcaccacacgaacacaccgggtgacgtgactttctagtactaggaatactttgcagggagccagaaactcgactttaactccagtttgcaactggagctgggaggcagaaagtagccaggtttttctcagtgtgaagcaaactgtcccgtgtaaggatcaaacctgtagttcttcatccattaccccaaggtcgacctgaagcccgatctgtcagaagagggaggctgcaaacaaactggacctgaggtcaacagcacttaccccaggggccggggggtggggggtggacagtggaagcactccttcctcccatttacggatgcaagattcaccctgtactttgcagctcatttgtaacctggtcgctttagagttggtccagctccctgcccacctcacacctccacccccagccagacgggtcctctctgtccttcctcagccctacactgtcttcgcccaagtcagcctgctctaaatggacaaggtcagtgatccaagcagaaactgaaatagtaacaatcggacagtgtcaagagactccggcagagatgcctcggagcgcccggcctcctcctctgccttggcacagatgttcttattgtcctggaaagaaataccaaattccctccccaagcgtgaagcgaggatactctgggacttagcctccaaggacagagtcgccttcccagcccagttcccctgccccctaatcagactgagatagtcaccatccctcttccccatcctagccaagacttctccccctcaccaaggagattatggggagtggggctggagctgcatgagaagattgctaaactgttctacagtcctctttagggactgttagcacatcaaaatacatatttggaaaatgctcacaattaacactgggagaaaaacagtaaacacagtgtcactttgccaggctcaacagttttgttttgttttgtttaaatgctaatggcctcaaatggggagcagcatccatcagttaaataaacaagccattagactgagactagaagtgtcaacacatgactaatctactaattgggagaaggcatggtgtagtgaggagcaaggcagcaaagcatgctggaggctgtggagtggacttgcttacacgcagaagcacgtggggttggagccaacgagacctgagtttgagtcctgcctcgatcagttgtcagctgtgtggccttcagtgagttatttcattttcctgagccgctgtttcacattctgtgaaatagg

SEQ ID NO: 7440 - DNA, 1968 bp, artificial
  synthetic oligonucleotide
cctctggcattttgctagcacagggcacagacccttccactgtcagccttttctgtctgtccgtgacctcctctccctctagagtaaaagcttccagaaggcagctcagccgtttggcccatctcagcagcttcttggacctagtacagtggactcctccgccagcctcatttgttgttgcccagtgaaacggacagagtggaatggggcctacccagggccccaactcccagaaggcttggagtgggggactgtagggtcctggagattccagattccagaggccctggggaagccccctgtggataacagggaattgcttgtattttgcaagctaaaaaggggtattaaccaggcccaattacagccccactggtcgtttcaggagtggggaagcgtcaaaactagctgcctgggcagagtgagatagcgagaataaagggctccttctgccggaggacgggctctctggcccccattcggtcactgggtcccccaagtgtgaggccagagagttgagactggggaaaataaggaaagggaagaggagagccgggccgccctcccctcctccctcccgctctcctttctctcgcggtccacgctggcctccctcttgggctctttgtctgtcggtctgtccgtcggctttctctcgcgctgcctctctgcgcgctcgctcactcgctcgctctctctctctctctctctctctctctctctctctctctctctctctctctctctgcctcttcggctcacgtgaccgcttgctctcaacggctccgatcacctcttcctgaggcagcacctttcggttggtaacaggagacactcgcttgttgggggcaggatgggtttccttcctccgctttttcctcctggccttctcgggcagttccagccgcttctctctggcgcagcctctggccctccacccctccagcctctcccagcccccatagtgctcgtttactctccccttcccctccgcaccacccccccacgcccaccggggcctccctcctccccggcagccagcccactttggggagggggcttcggcgcaggggacagacaaaagggcctggacggacccgggggcacccctctgcagctccccacaaccacgtggcccctccctcctcgggcagccggcagcttccccctcccctgcccagccggaggtctggggagttcgggccccgaagcatccttccgggcctcgctggcgccaatcgctccgccgcgggtgctgagcctccgggtgcttcgaataccaaggaatgcaccgggcatgggtgggggacatgctccgggggcggaggcagctttttcggttcccaggctggagaacggccagccaaagggaggagactcggcccccgccgtcggaaggttcccggtacagtggggttgacaagatctccaacctcagggagctccaggtctgataggagagacccagtctctctccctttagcagttcaaactcaacagtaaggatgaatccaaaagtgggatgaaggtgccctgcaaaagcagagctggcctatgtattcgtgaacttctggctgaaccagattgtttttgggccatgttgtccagcacttagcgagctgcccttcccatcctaccaactcctgccaccaaaagttggaatggaaagtgagctccttcccattccataccgtggtaaaatttaaacaaggccattgaagatgaaggttatccagtaaatcagccaaaacattcacaaaacattctcaaagcagcctctgtaaatgcactcttagctagggtctagagccatggcactagcctggccctagataccatgtgtatgcattttagagtcttcggaggtactgttcccctgagtctccccctcgccacccgctgaccacttaataccattttagtcaacaaggctaagtcccctcaggggatatgcctgtggccagagcc

SEQ ID NO: 7441 - DNA, 6055 bp, artificial
  synthetic oligonucleotide
gggcagtaatctctgaagtgggcccgagtgtgctgtgtgctctatctcccatctcgcctggtcctatgtctaacatcaacccccatgcgagggcataagaccaatttccttaagatacaacgcaaacatgtggcagagctgaagagtacggaataatgagagatggaaggagtggaagcgagatggggtttcgcgcaaggggtgtggccccaaaggaaggtgcgggaaaaggtaggggttaaacctctattcggatttaaccaccttcctggatttaaccatctttccaaagcttctcctctctaacgttgaagcgggagctaagtagcagcaatgggttccctccccacctcccccccacccccgcaaccttatgcagccgatcttaaggaccaggtactgaggaatgggctgtcctttccgacctgcacccctcaacgattgggatcgctttagtttctccctggagtcgagcatttgcctgcacttaaaaaaaaaaatcccaaacctggaccccctttggggagggggttaacagtttccttaagttttctctagtctgagtaaagaaggacttccttctactcgtcctcaactatcccctggggcttcagcggggcgcgagagctcgggtctgggccgggggccgagcaggctgcgctgcccctccaggatttcctgcactcgacgcggcgaggccggctcgaacttcggcctccgacgaaggcaactccgcttccctttaaaatgcagcaactcccggcccccgcccccgcccctcgggccgcctcctccccctccccctccgcccctgcccaggccccggctcctccccgagccctcggcgtgggggcctccttgccacctgcccgctgcccatcccacatgcaaagcgtgaccgccggggaaggaagccgagcgcgcgcgcccacaccggccctgcgccgcggcgacagcgagcagctcgcctactccgtccgtctgcgcttacccagcatgcacttccaggccctgagctatctcggagccgcagccccggggtcagagcggccggaagaaacaggaagtttgggacggtcctagtcgtggggccgggagtcctaaaagacaggccctgaactccgtgctgcctctcccttcccccgctccctccctctggcggacttccctggggtccgtttcgggggctggcctgaactccgaaaatccagatgtgtttgggggtcattcaaggcacactcccagggttcccttcgcggtagcatctcctggctttatggatcgaggggtgggaggaggagggagtgctcccgccctggtggggtggtagtccccgagggggcgttgtcttctgcccgccgagagggggaaggacgctagattggggtggaggttggggggctggagatttgtctcccacggccaattcctgggcggatagggcagtggttagaacctatggcggagtccggacttactggctctccttcccactgccagttagctttgctctaatctgccctccacattgacttaggctgccccattaccctcagcactatctcacagacctgcgctgctgctcaccaggggcaccgggcaagggagccccattcctagtgcagagaacacaaagggcatgccctgttgaaagtgatctccattcgcacacccctttggccaggcaggaaggagtggactctcacttcccttggcttccctctcagtccccaccctacctcagcgttagctaaaccactgacccaagcaacctcaactgtccccacacgagcctctcgctggccagtagctgaaaggagtgtgggtcatggttgatcccagtgggccattttgatcccagtatgccatctggccaatccttttcggcttgtgcagactagccgtttgggtggacatactcattctatagcttcacactcccagccagggacttttcccttcccgctcactagaggtttccaagttctccttgatgtagtcgactcattgcatcttcctagatttgctgagaggaggtggtggggagtgaagaactaggaagaatattttggaggtggaaaactgtagatgaaaactcattggctgtagaatgaatgtaatgattgtaaagtgagactgtcatggccatcacagacattcccaggcagaattaattgggctttcccctgcgctcccatagattaggatttatacctctattatcacattgtattgtaattatttgttgacatgtttctctcccccatagatggggagctcctggagggcagagactatgccttatttatctgtagacctccctgcacagatccttgcttacaaaagagatattgaatacatgtactagaaatggaaggggatccaacaggatgaccttcaggacctcgttcagcgctaatatcctgtgatgcaacttaaacatgtgcccacagatgttctcacgttcacataaacacacaaatacacaaaataccatcatgccacagtcggggtgtcactccttggaaagtgaacagatgttacatgatgccaagtaaatggccttttgaaagttgaatctccaaacctaaacatctgaagtgtcgacaggcaacgtcacaactggttgggctgattttgtttactgccctgactttttaagcaaccacagccctacataatagaaacagtgaggatttgagcttgaaaaggccctgagatgctctggtacaagtcttttcattttacagatgagaaggtccctggtccaaagtcagacaggagcagaaatgtcagtcctgtaattcttgacactcggagcttgcacgtgtgacacgtttgtatgcagacacctgcctgaacctgcacacatggctgctgacatgcatagacgtggttgcatccccaaccacgtgtgccaccacgacacaggggtacacccttcccccaaaacttaccaagcaagtgaagatggccctatccccgtgtagggggaggcagggctggctgctgctgatcagagaagggaaggcaggggtcacctgggctgggcagcccttgccagagtgtgaaggggaccgagaagcccataggtttgcagctgtcattgaatgtgctcggctcacccagctcccctcggctcttctccgtctctcggtctgcagagggcgaggagaggagacgctcccggctcattccagcgagccgtgtgcacgctgcaggcgtggtatgtgagtaagcggcgcgcttccagctgctgccttatactttgagggctgacaggccgccccctccccgctaaacaaaactgtgtagtggggccgccctcacccaccactggcctctcttcacacgggcatgattaaggcaaccaggaccgcagcaagcccttctcaaaaggagagaaattatggctttttctccacctcgcctgactgccttttcctaggggatctcctctctcagacccacctccaactggaaatctacgcagagttaaccccctacctgcctcagatagcctcactacagcacactcttgtaacactccagtggagagtttgcaccctaaccatgggtgcctgcttatatttcccattagggtcctgtctcccacctccaccccattcaatactatcatccctgtcttacctttgtatagtgcttcatagctttcaaagcactttcccatgcatgtcttatttcacctttaccacacctcataaggcaagtattagtagcttcactttagacaccaggaggctgaagctcagagaagataagcaagctgcccaaggtcacacagttgatgcattggggtagagcaggtctacaatcttcatctttgactacaaagcacactctttgtccactctgccaccctaatgcccagttgatatccagctccccaaaaggagggggctgtcattctgcttcttttttcttttaaaaattattattttctggccaggcacagtggcttatgcctgtaatcccggcactttgggaggccgaggcggatggatcacttgaggtcaggagttcgagatcagcctggccaacatggtgcaactccgtctctacaaaaatacaaaaattagccaggcgtggtggcgcaggcctgtagtcccagctactcgggaggctgaggcaggagaatcgcttgaggaggcggaggttgcagttagccaagattgtaccactgcactccagcctgggcaacagagagagactccgtctcaaaaaaaaaaaaaaaagtaaaattattattttcattttagagacagggtcttgctatgctgcccaggctggagggcagtgactattaacaggtgcaatcatagcacagtgcagcctcgaacttgtttttctgcttcttttatacctccagagcacctgatataggactggctctgtacatgctgggcattcccaggccagggtaaccagacagacccatgatacaacctgccagcgaatcccggaaactccaggacaggagacacttgcaggctaatggtggtgtgcaccaccagagtcttcggcagctcacggcccttctatctgccttaagttgctggggcagagagcagtgccaaggcagagaggaaggagaacatccctccgtgtagaccccagctcttccctccccctctcctctggggcttcagcgggtccggagctcatgaataaagctaatattggaactagtcgtatactagttggagaggggctgttgtctagatcctcccttgcagggacgggttgtgccaatagaatgccccgaggccccagccctctcgtgatggttggctggaactaaggcacccccctctctcgcccttttatgagtctcagctgatttccctggagggcggccccactagccagcgcccccaacccgctaccggactccctcactatacctgggccccgccccaactgtcctcaggggcggggccagccctagggcaagctggggcaggaagtggttgcaattacacacactcccgccccgcactggctgccactgccagagtgacaatgctaactcggccggccccaaacgtcagggcaagggctaagaagaggactcaaccagagaagctcctgggctggaacgaagctcttttcctgagagaagggagtttccgaggttaggcttggttggaagcctcagcggattgttggtcacatccagagatgaagggagggggtcgtgggtctccttccccacccagacatggcagtcactcacaccgtcatctctttttaacctggccactagctgacagcagcttttcctagctgcttgggccccctgctcgcaactgccaagacagacagctctgatccctcctaccaggggaagatgggctttgattctctactactgcaaacaaccacagcacagtggtttctatatcccctactcctccttcgtttcttaggcattcccatctggggcggctctgggccaggtggagagcgtgactggtatggccacagctatgggctgagaaccatgtagagagagggatggatgggggaattcgagaatgtttgggtgggatgacttcagaactctctgggttgggctttcactgaaagcatcattagctcaaaaaattggggctacattagaggaatggaggtagaagggggcagtgaagaaactggacaaatgaaagaagatactttaggctgggcatggtggctcacgcctgtaatcccagcactttgggaggccgagccaggtggatcacctgaggtcaggagttcaagaccagcctggccaacatgatgaaaccctgtctctagtaaataaaaaaaattagccgggagtagtggagtgcacctgtaatcccagctacttgggaggctgaggcaggagaatctcttgaacctgggaggtggaggttgcagtgagccaagattatgccattgcactccagcctgggcaacaagagcgaaactctgtctcaaaaaaaaaaaaacaaaaaaacaaaaacttgagtatgtgagggaatggggatggatgagtgaagtaggtttc

SEQ ID NO: 7442 - DNA, 504 bp, artificial
  synthetic oligonucleotide
ttctttatgttcaggttgtgggttttattcctaggcttaaatgaagcaggcgctctcaagttctgaactttaaaaattccttatttttttaaactactatggagcatctactgggtgccaggcactgttctaagtgcttaacatacaagaactcatgtgatctttataacgtttgcttcttcttcttcttttttatatacagagatgagtttcaccatattgcccaggctgatcttgaactcctgacttcaactgttccccccgccttggccacacaaagcattgggattacgggcttcagccaccgcgcctggcccttataacgttttcaggaggtacttattagcccccatttcacaaatgagggaattgaggctcagagaaaagtatgcaaggcaatagcgctaggaagtggtggagccagtattcaaaccatgtctgtctaacttcagagattgtgtgcttaatcactgagtgggaagagaaagactaaaagagacccag

SEQ ID NO: 7443 - DNA, 10155 bp, artificial
  synthetic oligonucleotide
accaccaccccctctaatgttaaaaaaaataataatttttaagaaagaactttgtttagagcctaggagtctcagggaagaggagagtggtcagcaagctgaagggcttgacccggtgaggcctctgggttgatttcagcccctttcctcattttcactcctttggctataaaatccaaaaaagttgttggttgtttacagagttcagtttaaccggacatgctgtctccccatccacacctggggctctaagagggcagagaccaggccatttgttctctgggagccagcacttagtatccagtactctgtaggcagctggaatgtatctaccttagcaacccttcttgcaaaaaaggctcatgcctttgaaatttactaataacaaatagaggcaaagactcctcccctaccccgcttgtcctctgaaacataaagtgaaacactagagagctcacagtgtaacacatgtaacacatggtcactctttcctgcagtttgcacagctctttctgttcccccgcacccccccgccccacaacccgttccctttcaagacgggtaacttagaatgagccctttggcagtcctgagagcctaacttccaaaactaacttcaccttcaattgattgaggtgcagggaacaaagggacaactagaagcttcaaatttgcttcattctataactctaaagatctaaaccactggaatttttttttgggcggggaggaggtgggggcatagggctgagctgttttaccagcgagacaagggctctgatcacagaacaaagcagaggattaaactaattgccctatggatttagttagaggttggtttggggcctaaattaccctgggaccccccagatgtcctgctttatctagtaagtttcaggagggcagggcccaggcccatgtcacccttaggtctctgtgctacacctagggaggttggtgatgctgacactgataactcctgcatggtcgggcacggtggctcacacctgtaatcccatcactttgggagcccgagactggaggatcgcttcagtccagcagttcaagaccagctgggtaacatagcaagacctcgtctctactaaaaatgaaaaaattggctgggcgtggtggtgcatgctgtagtcccagctacttgggaggctgaggcaggaggatcgcttgagtccaggagtttgaagttgcagtgagccatgattgccccactgcactccagcctgggcagcagagtgagaccctgtctcaaaaaaatccccaaaaaccaaaagcaaaaaaactccagcatgaatccattagtttatggtatacaaaactctttcctgtccatacctcattgctcacgggatgttcctgtgagggaggtagggcaggtgcattgatatccatatttaagaggtaaagagaagacccaaaatacagtccgtagtatcaggctggcactactcagtcaaatgtcagggattgcttgaggtcccattgctagctatggataaggaaggactaggacctggttcttagaactttcccaaacaaccctctttccattacaccaagctgcctctctgagagtccaggcctgggtcagtagatgttactgatgggagaaataattaagaaaagcaatctgcgtgaaaaagactattttggcattacatggaggcgctataccatactgaaaagaaccctggatgtagagttagaattactggggttgagtcctggctcaggaactcactagccatgcaatcttgagcaagccactcacagatgcacatagactcagtttcctcaattacaacatggagagttatagtgagaaacaaatgaaataacacaagtgaaagagttttgtaaacaatccaatgctgtacaaaggtaggtattattattatggttatgtcatggttctagcctcaaataaaataatcattaatatctacattcttcgcaaggtttcccacagctctccccaccctgctccttggtttctcatcatctcctgtagggcaggaagcctggcccccaacaggaaagggctcagaggagctagagcttcaaccaggaaataatcatcttgccccaaccttcgtttcgccagataaatgaggcagccaaatggtgagacacagactagtgcaaatcgaggtgttcaggatctgtttcggcctcaaaccaaggagcaaagtagccctaaagccctaagggctttcaagaagtggagatttagtaatttctgggttaattaaaatcagcgatgacagtaaattcaacttaaagcagaattggtgggatctgcatcatcaggccccatagaggcgattttctccttaatcatgcattttgagttcatatattgattggcttaaacagatcatttccaaatcttcacgttccccttgatgcaacttaggccaaatattttttaaggggtgtgtgtgggtgtgtgtgtgtgtgtgtgcatgtggtgtgcaggagtaggggtggggtgcatgagaggttaggagtggccaagtagaatgtcttgaggagaggttcccaaagcaaaataaaatggccagcgccttgtccacgttgctggcaatagcttttgagggtggtgaggacaagcaagaggggtcctagaacaccaggcctcaggcaacagaaaagccactgcagccttagataacttgctccaatgctcacccacatccctcacaccaggtgagggagacataccaggcaagtctcaactgccatctctaaagtacttccaaaggagagaagggacatcggagctgagagatggaacctctgggcctagcagaagcgaggtggagtggggaggaggaggaggaagacattaatctggcagggcttccttctagtccaaatgaccctctgacttcctcagcatggataaatatctaacaaataatatcaatatatctgcacataaagacttttttcgaattcctgctattcatttcaaattccgtttacaaagcactgaatcctccaggaactgctgggcacctcccctaataccctctaggctgaggcgatgcctttgaagtccctgtcatgggctcagggctggagctgctaagaaacaccctaagactgagagcaaatcggccggcagcttcagctccttcgcaagctgctagctgctagctgctctcctcggagtcaatgtaaagtcatgagagttcgaatgtggaccgcaagcttctcagcccttcagtcccagggatggcctgggatgtaaacacacacgacggtttattcctttggccaggcagagagtcgttagggtaaagggtaagggtcaagggagctcggattggtgactgaggagcccaaggaaagccggcagaagccgagtcctctagagctgggcttttggctctgaatcgtgcaggcttcccactttacacagacctttcatccccttcctccttcttcctcactcgggtctctcgccaccgacccctacccccccgcctccatccccagatgcctccacgcccaggtggtgttacccactgagggtggcccagggggtttgcagccgggggaggttgccaccaagggtgggccgccctggagacgagaggcaaggcggcgagccctggcattttcctttccccagcacctgtcccacttcggcgccggggctggggctgcgcccgcgggcggcctcggagcttgagcgccagaaccacgcactgaggtcgcccagggtggggaagtggggggccgggggaggggcggggcatccggcggggaggtctcccccaccgcatgcaagaccctttgcccccccacaacatacactgaggctaaaacggggatgagagtcacacagagcaggagcgaaatctttcgctctccgacccgaacggcgcgttgctcgaccccccccttcctggagccaggggctggccgaggaaggtggctccgttcttcccccgtggccagtgcggggtctgcggctgcccggcgaggttccggcttccccgggactggcagggggagccccgagaactgcaggcccgcccccccttcctcctcctccttcccctcctcccccacgtgtcctccctgagcccagcagcctgatcccagcaccccccgccacctccctcctcccgcttcgcccgcttccccggcggcgtggagaagagcaaagttgcgacagcggccgggggctctgcccaggtaaagggggcgccgtgaggcgggggtggtgggggaacggtgcggccctgcggcgggggcggggggaggataaagaaacttgcttcccgcggcccccaccccgcgtgggttccgatcttgcgtggaacgagcccgcgtggcgagtcgcggcaacactgccgggaccgaggccggcacctggacccggacccggaccgcgcgcttgggccggctcggcgggcgcaggcagcgggccaggccagcacccaggcaagggcggggtgggtggccgtacaccggaccgaatcggggactccggtggcgtgggcgcgggccgaaccccgaccgggccgagttgggtggcgaagtaggacgtggattcgggggcggggcgcggcgggagggggaaaccaggcctggccagactggcctgggcgtgggggcggggggcgagttcggggcacttgctgggctctggaccgagcggtagggcggggcggcgctaggggctgggccggacccgcagggagagggcgaggggagggagagccgggggtggagtaggggcgtggagttgtgagcggggtctggcctcggccgggggcgaaggtagatcggcggggccgcgagcggagggagggaggcccgcggcggcgcggcggcagcgaaggccagcttccgcggagtttgtgcccgggcttcccgggctctggccgcctcacgcgcacaaatggggctaggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctaggggtatgtgtttttgggggtggacggcgacgggggtgggggatactttccttcccgtggcggcaacctagttcgtatcttattcctacaaggtagcgtcgcttcgagtcgcatggacattggggtttagataatttaccccccacccaagcgatttaatggcttttaagcaaaaggcgaatacctggatttccatgggagggatgaggtttgaagattgggattcacccctagctcacttccactaccaacccctctttcttgtgagccacttccacgggtattcaaatctgggggggaggggggacgggagtattaatatgcttctctatttctacacagggtcggcgtggcgaaggacggctagccttggagggaaagtagccaccagtccaactcgggtcgcccccaccattatttcggtgagggggcaacgctaagaaggggatactggtgggtaggggcccagtataagggagggggctgggtagtcgtccccagaaggactccgtgtcttggcggggagagagagaggcgagccccggcttcaggggaggggttccggggagggagatgggggggtggcgacgacggtgggggggggagcgggaagaagggggagtcacgccctgcctgcaaggggagcctccctcaggcccctgggagaaggggactgaatgcgtctgttctccgctgcccggcagaggagatctggggtctcgagatttgcacactggatcggcaccagtggcctgagaaagtcaggtcggggcataaggtggagaacgttggaagaaagagagagaaccctttggccgcggctcactgaccctctcccttcctcaacctcccccttcgaggggcgtcgaggtggggggggacgtggggctcctgcagccccgcagattgagcgcctccgcctctcccaggagtctagctttttgcccggcttgctgcagccactgctgcctccctctccggaatccgctcggtcctctcagcgatcccctcctcctctcctcccctcccagtgtcaccggggctgcttggctctgcccccttcgccgccgcttgctccctgctttcgtccctccctctcttgctcgctccctcccttcgcctcctcctccccattcccccccacccgcgtaggccgcattctgggagttgtagtccggtggagcgggggttggcgccgcccgcggacccagccggactccacttcccgtcgagccctgcgaccggcacccactccaccaggcttcgctcgcacacagacacacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggaggtcggtggcgataaggggcggaggggggcatcagatcggggcagtattaggcgggtggcggttaagagggagtaagagggagcccgggtggcggcctgagcctccccgcggagccgacccgggaacaggtgcgtcttttttctctctcccccaatccctccaccccttttgactccccggctttttcgtatccccccacccgcttctttctatcttaagcctttctccaaccctgttccttcttttccctgcggccgctcggcttgccccccgggggcgccgtcctcttcgtgtccccggacgtagcgctccctggagctgggtatgtcttcgcccctcccttcgggacagctcccttccacttcccaccttcgtaccccatcccctgacttgccctacccccttctcgacccccttctctcttagccaggtgagactcgttcgccacgatccaagagagtcttcttcccggctgggcgggggtctccatggaaacgggggtcggttgatcctgggggggaaaccataggaattaccccactcctcggaaagggaggtggaggctatggtcttgttaactacctgactccaacccccgatccaaggatccgacgatccgaagggaggctggctagcagggcagggcgagaaaaggcttttttttggggggggggggtgtccgtgatgaagtgttgaagagaccgggagaaaatgccctccaacctcagaggggaggtgcgacgggtgctcttcagggctgctttcttcccggcgctggggtgcgggaatcgtagggtaaggggtacccctaggtggcggcggggcctgggttcgggagtgggagtgctgtgatgggggcaggggcaattatccgagtccctggaaaaaaggcgggggatgacttcggagcgccctggctccgctgccctcgctctaggggcgggggccgccgggccgggcgcggcggggagggggcttaaattgaaggaagatgagatcgggggcaattcatactagcaccggcaagccagaggggagatccggcgtgcaagccctccacccgcttcgcgccaggcctggaggcaaggggtcggcgagcgaagccgagggctggaaggagggaggctccggttacggggccgggtttcgggatcaggggcaatcccccggcccttggagaaggagggagagggatggccgcgaaccccagggctcccccaccccgggtcctaaggggcgtgagggacggacagcaggcccagcggagctggattcgagcggatcgcggccggggagtgggagggcttagtggtgggcttcggggggagcagtccggcggcggggcgggcgggcggggcgtggggctccggcgggcggcggggcggggccgggggcggcgctgctgccgccgccgctgccgccgccgccgctgctgctcctgctggggccgccgcagccgttgccgccgccgccgccgccgcttctgggcggggaacggaggccaaagagagtcccgtgccggggcagagggcgcaggcggcgcgcggtggggagggggccgtcctgggggcgggggcaggcgggggggtggagcccccgacggggggcggtacgagccgggacgacgacgacgaggagccccgggggccgggtgcatggaggacgaggtgctgggagaaggaaggggggtgtgggtcccgcgactggcctcgtgggcttggctcctcgaggttcggtttcgggacagagccctgcaggggcgccaagaggccggggaagggatagggaggtgaactggtcggtggagggggccctcctcgccggggtcccgccgagaggaaggctgggccagagggacgtccggggcaaggctgggaggagccggccgcacctcggctggggatttcgcgttatggaggtgcgggagattgttgtagggaaagacgtggtcgaggggaaaggtgggagggaaacactgcaaacccgggaggccaacagcacaggcccgtgggggtgcccttctattccgctcgcacctcctccctccctgagtggaagcactatgtttttgttttattgttttgaaattttcaatgttggctgatcgaaactgtcgatggggtgatattcattcttggtgtctcctggagtagacagtaaagacaggcatcctttggcgagcaagcatctagcccagggtttagaggctctttacgttagtgtgggaagggggcccggtaactttgtgccacagcttgactactgttaaggcagtttggaggtcgtccctgtggtacagaggtggagtacaattgcaaaaatcttcagtaagacttctggagatgagttgtaggttagcgttacagtggttagccctgtggttctttcaacttagaaggctctttctcaaaagcacgccgttgagttacatgggaaaataaatgtggattgcatttggggttgggagtggattaggttgattataaaatttcaaggttggaagggagttttaaggttatttacttttctgttgatatgtcctgtccttgaatgttggaattgagggagctttattttggggaagatggtagatggcacagtggaggatgtctggtgcacagtttagggtactttaattgaatggtgatgtcaccatgtggtactaaagatgacagtatgtaggagagaaatttgggggattccactggggattaaatgggataacctaattttaagaatcatcccggggctccaaatagaagcaaaaggctggggaggagcctgtaaaatttcgatggaggcgaaaagttagtagcaaagattgaggtagctgggaagagcaaggggcttggtgagtcaagttaagagaatctgaaggttgatagtagagtttagggatgtggccatcttgactaagtcatgaggatgttgttaggcggacatcttttgacagggcaacttaggcaactgcccttggggcagatgtgagggatgaaaggtacaggccttggggcacagatcctgactaaaattgaccttaagagggctgatcctgataccagctttgcaacaagggtggttaggtttcttttcttttcttttttttttttagatggagtctcagtcgcccaggctggagtgcagtgctacaatctcagctcactgtaacctccgcctcctgggttccggtgattctcctgccttaccctccagagtagctgggactgcaggtgcccgccaccacgcctggctaattttttgtatttttagtagagacagggtttcgccatgttggccaggctggtcttgaactcctgacctcaggtgatccatccggcccagtttatttttgtcctggctgtaagtcattgatgaggaaggagaggggtttcacctctcccttgtctgagttcaggaggatttttaaaaaatttttttagaataggccaataaggaagggacagcaaatttttagaaaaggccaataaggaagggacagcaaaacaaatcgttggcatagggcagagaaaagctaaggccctggcaagctctgctgc

SEQ ID NO: 7444 - DNA, 2523 bp, artificial
  synthetic oligonucleotide
aactgaagtttcattctggtcaagagtaaaatttaactctgtgtttctatccccgtaattcaaatatgctgttctagttttcttttttattctaagcagaagtgaccttttccccataaaacataaaaaaggatcttttttttaaaaaaaaaaagtaactgagtaactgcaggctgcatgtcaaggtcatattttccctggtcaatgaattatgatgaatttgaatacagctgatatattatttgtaaaatgtggtaattttcagatttactcatcacagtatgtgaggcaggatacctcttcatttgtattttaagaaaaccttaagctgaaggtccgtgaggaatccagagtaccaaggagcagggaaagctttgtgttttgggcttctttaccgtgggtctgctgagaaacaaaatttggttacctcattactaaggtatgcctagaaatcatagtgttagtgccatttaagggtactgttgagttttgttataatgctgatgtccagggacaaggagaacaagcagatttttgcttttccaagttttgtggagaagtgcaccgtatatgactatgatcgcagaggtgagttgatgcactgtatacctgaatccatgagatgattatcttctgataatgaggctttactcagtttaacttggttgtaccacaccccagttagtatagtacagtggttctcaaacttgagctcctcagaattgcctgggggggctttggagaccgacaacctcaggttagagtgcttgctgttctacttcttagctatgtggcaggaggcaagtcacttaacttactttcgttcttttttttgacagagtctcactctgtcacccaggctggagtgtagtggcatgatctcggctcactgcaagctccgctgcccgggttcaagccattctcctgcctcagcctcgcaagtagctgggactacaggcgcccgccaccatgcccggctaatttttttttttttttttttttttttagtagagacggggtttcaccgtgttagccaggatggtctcaatctcctgagcttgtgatctgcccatcttggcctcccaaagtgctgggattacaggcgtgagccaccgcacccgtctttttttttttttttttttttttttttttttttttttaaccggagacagtctagctctgttgcccaggctggagtacagtggtgtgatctcggctcactgcaacctccgtctcctgggttcaagctattctcccacctcagcctcctgagtagctgggattaaacgtgcccaccaccatgcctggctaacttctgtatttttagtagagacggggtttcaccatgttgaccaggctggtcttgaactcctgacctgaagtgatctgcccacctcaacctcccaacatgttgggattacaggcatgagccaccgtgccaggtcttcacttaactctctttgtttcttttttttttgtttttagacagagtcttgctctgtcacccaggctgaagtgcagtggtgctatcttggctcactgcaacctccacctcccggcttcaagcgattctcgtgcctcagcctctcgagtagctgggattacaagcgcccagcaccacgtccagctaatttttgtatttttagtagagatggggttttgccatgttggccaggctggtctcgaactcctgacctcaggtgatccttccacctcagcctcccaaagtgctgggattacaggcatgggccaccatgcccggcccacttaactttgttgagcctcagttttctcatctatacaatggagatgataataccaatttcacagggctgtgaggattacacaaaatcatcccaggcccatagtaggtgctcaataaatgggacctattattttatatatatatttttttctttttcttttttgagatggagtctcgctcttttgcccaggctggagtgcagtggcgctatctcggctcactgcaagctctgcctcctggattcacgccatcctcctgcctcagcctcctgagtagctgggactacaggcgcccaccaccgtgcccggctaattttttgtatttttagtagagacggggtttcactgtgttagccaggatggtctcaatctcctcacctcgtgatccgcccgccttggcctcccaaagtgctgggattacaggcatgagccactgtgcccggccctattattatattattatctaatttttcttgttcaattgtatcctattatgttatagtaaacatggtggcagcatgaaaactatcaacagcttctcagtggtccccttatatcttgattctctgtcctctttcttcatattcctgttgtattagtacacatttggcatttacaacatgctaggaagaaagcttgactcatcactgcatctacctttgaggtggaagtggcggcttctttaacagctatgctgtaacactgctcaatagttcaggacaggaactgaggagtgtatatccagttgaaactctaggg

SEQ ID NO: 7445 - DNA, 2040 bp, artificial
  synthetic oligonucleotide
gggctggactcaggtgtgggtatggctggagtggccaggactgctgttgcttggcctggttctgtggttctctggcagctgccttcgacggcagggattctgctttcgaggtgtcatttcaggcagggtgggagcttgcaaggggagaatgaggatgcagcccactcccttttgtatggccaggaggggaaagaatgtaaataaatagcaccttcccatgtggggttgcttgggggaagtgctgcttgtttccccttgagtactccccctaaaaccgtccctggcaagtctagtgggaacacgcttccccctggcccaaggctgggcataggtctcgcttttgtggtctcttaggagttgatgtgaaagtatgttttccctttccttcaggccctccctccctccccttccccgagaccaccctgactgcatctaaagcccttgcctctccttacagtcatttctgtttgtcaccaacagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccaggtacaattttggagtccctgtttcagtgggagggaggaagttagcagggccctcccccttcttgttggggttggctccagcaacctgactgccctttggctagggtgactggggaggcgagagctggcttcttcagggctgtcttcaggagcttggggtgagcctctaaagaagggaggcaaaaattagccaggcgtggtggagcatgcctataattctggctatgctggaggctgaggcaggagaattgcctgattccaggaggcggaggttgcagtgagccgagatcgagatcgtgccactgcactccagcctgggtgacagagcgagattcaatctaaaaaaaaaaaaaaaaaaaaaaaaaaaaaaaaagagggaaaaaaggaaagaaagaagggaggtcacctcaggcacagtgtatttccccaggggcacacagagcagtcctgtgccttgcccacccaggaaacgcactgcagcgtctatgttggggttttattctttaatctaaacctcctccttggccactcccacccacagctcccaagggcagggggcaatagttttttttggttgttgttgttgttgttttgagacagggtctcactctgtcgcccaggttgaagtgcagtggtgggatctcggctcactgcaacctccgcctcccagactcaagcgattctcctgcctcagcctcccaagtagctgggattacaggtgcctgccatcacgcctggctaatttttgtattttttagtagatatggagttttaccatgatggccaggctgatattgaactcctgacctcagtgatgcacccacctcagctggcctcccaaagtgctgggattacaggtgtgagccaccatgcctggcctaatagttcttgctgtacttaaaataccaggggagggaggcagtctgatgccaccctctccctttttttttttgtcaggatgtacaattttctatgatgcttacctgaaatttggagaagactttaaacagggggagatgcatttgagttttcctcctttgggacccagctctctggccttgagcccttttctctgggacatatgaacctgaatttggggtctgaggcttttcggacaggagagaacaaagtggtgctgggagactgatgggggggcagggaggggtgctggcaggagataggatgtaggcaaggatagaaggagggtagaagggagggtgttgcctagaactctagaaaaaagggggcagtgtctcctggagggaaaaaagtagtattcttaaaatgcctctcagcacccagtgacctggtggcctccaagtggtatcatcaccagtgctaataaacatgtctctgctctaggcaagacaggaggtgaataggtgacgattcagatttagacctg

SEQ ID NO: 7446 - DNA, 1348 bp, artificial
  synthetic oligonucleotide
taatggtgaccctttatcaagatgcttactttcaaccatcaggaaactgtcataataaactgattttattagaaaaaggcactttaatgccaactgctggaaacacgcatagtaaatacatttgcacaaccaaacacagtgccctccagggggcagggagaagaagagtaggagagggtgatagttgttggcttaacaaagaagagaagagcgagagcgcggccaggggaggtagttaggtcaagtggatggttctgtaccaaggacacagcaaaggtcctcaggcactgattcacattacccaaagtcaccagataatagagttgtttccgtggctgacatttcttagccttgccctcaaacttggcaggagggaggcaagctcgtttaaagaagggagaggggaggagatccaggcaattggcctaggggttggctttgagagagaataggttgacccttcctcggaaagagggaagggggaagcagggagccacgaagagagagaggtgccacgggaactcctggctgccgactcccgtcttcttggtgaaggagtcagggttaggtgtgaaagtgggagatgaggggcattggtacacccaaggaggtctgctgcagtcatcacagaggcaggctggtccgccttcgaggtgagttgcaggcaggctgagcagcagaaaccatgtggtaggtgcccatgcttgagcaggaatgggggtggaccccatctaggtcgctgccggactagccgcagtgatgcctgacagctggaaaatgtcaaaaagtaatcaagagggagcccaggatcggggaagtaggctggggtgtcagcaaaggctattgtctggcggggggccggtatcacacaaacagcccaagccctaggcacaaatactcaatgaattcagctctgggggctttgtggctagctctgaggctggagggcacttcatccccgtctaaatccttcagcaaagcactttggggtggcccaagattccagcctgactgcaaggtgactgtggttgctaacacggcaaactccaggaagagtaccttggtccagccagtgagggctgctcccagagctgacttcccttccctcccttcgtggttttaccccactcggcctttgtgtccctgaggagcgcatcttccccaatgtgcatgcgcatcaaagcgttcctactctgcactcgttccagctctacaacatctccagattcggaggatcaaacttgtaccccatagtctcagagcaactgaatctcggcatgaacaaagggaattagagaatgctttcccttaaaaacaaaatccctatccctgtggctgatccacggag

SEQ ID NO: 7447 - DNA, 11786 bp, artificial
  synthetic oligonucleotide
gtcatctaatgagacaggtgttttctgtgcatagattctcatagaattagcagagctgaactagcctctgttatcctcagggggcattataggaaaaagattagctcctcattctatgtctaaatacctccttgttatcgggtcatcaggaatttcgggaggttaagaataattgccaccctcccatcccccaaagcctagcagttctaactgaggggtggggaccaagggactgagtggagtgctttactcaggggtggtccagtttatcctaggctgcctgtccctgcgggtggtcacaggctcctcaagcaaacacaatccagtcaatagcaaatggaacctccaagttactctctgggaggcctctggaagggcactggcccccagtcccctgggagctcttctgggcaaaggcagtgccccagcctcaactcaaggcctctgggcattggcccagaatggacccatcatctattctagtgaagggtgagagtgagtggtagtcagccagttggctcccagaattttacactcagtaggataataacaacaatctgatgattgctaaatagttcccaggagtacaacgttaggcctctcaaagaaactaacttactcttatttctgcagtgaatgatgctcaagatgaaaatggtgaaggactaaagaaggcaatgttagtacaaatattaacgatttgagttttgctcttcactacagcactgcctgccattcagtatattacacacacacacacacacacacacacacacacacacacacaccttctattacatcctttccctatcctgtgcaatggccgagttaacaaaaagcagaaaaacctggaaaatctcccgcttagtttcagaaatgggtgtggcatgccctgcccgcattgccgaagaagtagttggtccctagagcctggcaaagtcaagggtgtgtgaaggggaaatggtgacaacaataataataactgtcacaggaataataataacagcagtgaacacttactgggtgggtactatatgccaggcactctgctgagtgctttatatgcatcgtctcatttaagcttcactccaaccctgtgagatgggcgctgactcccagagtggttaagtaactagctcaacagcaaatagtcacacagccagtaagtttggcatataaatgtagagagcctgtgctcttcctcctctagacaataacatgtattgggaaggatattgggtcacactggaagaggaaaggaagcttcaggagagtcaggtgttctgagaggcaggaagtgcccacactgggccaagaaaatgacccatcaagaaggtggcaactcggctgggtgcggtggctcatgcctgtaatcccagcactttgggaggccaagacaggtggatcacctgaggtcaggggttcgagaccaggctggccaacatggtgaaaccccgtctttactaaaaaatacaaaaaaaaaagaaaattagctgggcatggtggtaggtgcttgtaatcccagctacttaggaggctgaggcaggagaattgcttgaacccgggagatggaggttgcagtgagccaagatcacaccactgcactccagcctgggcgacagagcaagactctgcctcaaattaaaaaaagaaaagaaggtggcaactcaagggaaagcttgctcagcctctacaagctgctcagcttgcttcttgttagcctctctgagaaatgttctggcactttcccttgcagaccttcctgcatgaaacacccttccctgctccctgaccctcctcctcaccctggaagcaggctggggtctctttgccgagaaactcaccttagggcatgatttcccaaccaagaagtcagggccctctggtatgtccctttggtgttgaaatgtgctggggaggaggcagggcagtgagagagggaaaatgatgagtgtgtgtatgtggcagggggatgtccgggagttttttatccaattaaacccaaccagggccaagcttcctccatgtccagccttgggagacacagaatcagtggaagcaatatatggctagtccttagcggtctgggcagaaacacatgaaactctacattcttcatttcccagatggtggagtggggaacaattatgaaaatctctttcctccacctgaagctctgggcttccagagaaatcccagaaccctggggaaaaggtgggatccagccagcctgagactgccatgagcacaagtggcatgtcagttttcctgtcatttaagtgccctacgtctcccctgccatctctcccactccccaggggcctgtgtgtgtgtgtgtgtgtgtgtgtgtgtgtgtgtgtgtgtgtgtgtctggtaagggaggggtttcaaacgaaatcccctcagcttgggtggcaggctggccagccagtttatatctcccggagtggagacaggggtttgcactgagccacccacactagctgacctggtcttttatgtgacacacatttgccaaacaatcatccaggcttcgaaggtcagttcgtggccagggaatagagagaaaggcgtcttttcttccttttctgctgagccaaatctcccccttgcttccccctctccccccttcaaggtctagcctaggcccgcatccctcacaaagccttccctccctcctccagctgctgctgacctccagtcccagccgtgctggcctctgctccaacaagcacaattagcacctgaccagccactggcccggctgcttgtcctcgcctctgattgtttcagtgtcttagtcatctcttccccagcgcctccttctctcatctcccccacggcgcctagcatcggttgggcacacagtaggtattaataaatgtctgttgaattgaaactcagcagcccctatgaggtcagaaccctcataagcaccccgaccagcagtttcttggcaaccagcactggggcccgagctacagggcattagcagtgtggctgctattacaggacacacgaggctcagcggccagagatttgcaggcaggttggtgttgatgagaaaagcccctgacccctaggaaagcgcctatgggattctgggtgccttgcaggagtttcctttctcccctgcagaagtagttttcagtctgagaaccacaaaaagaataaattggaagagaagccagaaacctctttgcagcttagaaatccaggagagatgccaagcccgggttggggtcaggccctaccctgaggacagaaggctgcccagggcctttcccagctcggtgggagatcctggggagacagggggcatggcagacatgaccccttccactgcagggggctatagggatgtttggggggtgtccctaagaaatgccatcctgccctggaacccaacaaatgacatcctgcaagattgccacctgtagctcatgcagaaaccagtgtcccagccaggagcaatggctcacgcctgtaatcacagcactttgggaggccaagacgggcggatcacctgaggtcaatagttcaagaccagcctggccaacatggtgaaaccccgtctctactaaaatatacaaaaattagctggggaaggttgtgggcacctgtaatcctagctattcagaaggctaaggcagggagaaatgcttgggcctgggaggcagagcttgcagtgaaccgagattgggccactgcactccagcctgggcgacagagcaagactccatctcaaaaagaaaagaaaagaaaagaaaagaaaaccagtgttcctttccctctcattcacccaaatcctagggcaagactctgtgtgtggggagggtgggaggtgcatctagaccagaatctggccagggtcttcaggcaaagagaagcccccaagtctagggtgcttgatcccccacactggctcaggaatttgatcctggcttccaattacaattatttatatagatgacatatcccctctccctgaccccttcctgtacacctgctctgactccagcccacacgaaaaggtacacacaatcccggaaggcaggtggtgtcttcctcacatccatgttttcctcactgccacttcattggggtctggtactaggaccggctctgagcaagtgtttgctgaattgaatctgagttttaggcgctgcattaggcaatatcgtaagggcagctagcacttactgtgtgccatgtgctgttctaataagcatcttatatgtattcattcatgtatttgatcctcaccaaagtgttataaagtggtctcatgtgacagataaggaaactggggcatacaattgactgggatcacatagctagtaaataacaatgctgggatttcaacctagacagccaggctttaagaactggaggtagctgggcacagtggctcacgcctataatccagcactttgggaggcggaggcgggtggatcacctgaggtcaggagttcgaggccagcctgaccaacacggagaaaccccgtctctaccaaaaatacaaaattagccgggcgtggtggtacatgcctgtaatcccagctactcgggaggctgaggcaggagaatcacttgaacctgggaggcggaggttgcggcgagccaagatcgtgccattgcactccagcctgggcaacaagagtgaaactccatctcaaaaaaaaaaaaagaactggaggtaaggagttcaagattacagtgagctgtgactgtgccactgcactccagcctgggtgacaaagtgagaccctgaattaaaaaacaaaaaccaaaaaaaaaacaacactctaaacgcaaaaacaaaaactggatgtaaaattacattgcgggggtaggggatgtggaaaggaagaaggccaagcttaagagcagaagagcagaggtttccccaggaaagcaaactcctcagcctgtgtctagctgggtctgtgcggcacagggcctgatttttgcaagatgaggggcattttggacatgctatcactcaggcccctagagacagaccacagcaccctctattttagatcccaatatatgccagagaagacagaagccactgtgtcaccacttagcactaggtgagggagagtgaattttgggcccctaggttgtccaggggtgggcgccagttcctgagcaaccaccgagcaaacagtgcagcacagggaggaatgccagacatagttgcaaacaagccactccttcggctcacagcaagaggctgggtgagggtggtagcatggagcctgcttcatggtcccccccacccctgcccccaacaagagatcccaggctctgaatccagccccaaaaacaaccagatgcaaggtagcctcttcctcacaccagctggctgggataggaagtcctccctgataatcttcactgaactccagagagctccccctacgctgctcctgtactggatgcactgaatctgaattaatggttgagaaagcactttataaccaggaaaacccagtgtaactaactgcaaggaaggactggcattcttgctgggcatatgtgttccccgggcattttcagtgccaaagtctccccaaagggaagagctagaactgttcccttcacccacctccaacctggcactcgggccaggggtcagctggcagggggtgagtccccaatgggcgtgcccaccagctgttggggctgagcagtggtggttcaggccctggggtggtgacctcacttccgctcctacctccccacctccccagcactcctcccatttgaggccccaccaggccaaaatcgagaagtccaaggttaactgttctttcccactttaagagctaattaaaataattagccacaatgaactgtcaaacattaaccagaagaggctgcaggaccagacaggcctctatcacaggccgagggatgaggggcaggaatcaaatggccatcaaatccctcagctggggtatggtgcggggcgggggcggcccaggaggacctcgctgagccgaggtgccaaggggtcaggaggtgactctggtcaggaaggtgatgtgcaggcatacggtggtgagaaaagggagtcagggttagggtgcggtggaggagccaggaattcataaagcggtcaccgcctcagcagtccctcaagcctccaaagcaaggcgctggcgtgaggggaccccgcacggtgcggctgctgaatcccctaggcggcggcccaggagggaacccggaggcgggagagtcggggagagcgggaacgcgggagcgggaaggctggcggctggctcacacggaaactccggcccctgccaagaggtctctattttggcgatccagttctccacatcataggtctgcgtgcgcgtgtgtgcgtgtgaccctaaagccctggccccagaagccccgggggcagtcggatccatctagcagctccgccgcggtccgccccacctcctctgccctcgggcgcccagcttctgggggcccgctgtcatgatcggccccgtcacggaacccaggctgccgggggcgagggaaaacaggggcccctaccccgactccccgactcggggaatccattccacttccatcccgggatcgggagcccgggttctccatcacacgcgcggcggggcgactccagggcggctcgcgacactccgcgactctcccgcccttccctgggcccccagccccacgccggggccccggcgctctcgattccgccctcaagcaaacttttccacgtcccccaaggctcgaagaaccggcgccatcgacgtacctgaggccgagtggctcacgggcccagctcggtcgccgggccggggtctgtctccgtggtccccgctccgggggccgagacgcgggtccccagccccgccagcccgtcctctcccctcggaagccgggccgggcgagcggcgccaggaactcggcgccggcgaaaggagaagtggaagttgagcgcggcgcccggtcggtccccgcggccgccggggccgccgtcccccgccctcctccccgcccgcccttcttccccgcccgcctgcccccgccaccccgcgcccgtgactcacctcggcgccggggcaggctggtccgggcgggcgaggcgcagggctctcccacacttcgcgccgccaatggcaagttggagggagagatgcaaataccaggtgagacggcggcgcccctgataaaacggggcggggggcggggtggagcgcgcggggagcggggcggacgccggggagggccgggccaagacacggggcggcaggggcgcccggggagggggcgcgaaccggcgcagacatgcaccgaaacgagcgagcgaaaggggaaatgcagtagagacacacacgtccccgcaggcggcggatggggcgggcgcgaaggaggcagggcgggagggagggaagagccggagggagggaccgacgggagggactgcgggcgggcggggtgggggagggaacgagggagggacgaggcatctcggtggaaacagcgcccgtccgccccggcccgcccgccgcggtcgccagcacggcatggggagccgtgccaggggcccgcgcggcctctcattcccctcgcggctcgctcgcgcccgggggaccacgaggcagggcgcccgcagagcccgcgtcgtgcgccgcggcccgggcgggcgctccccactctgcttctagccagcgagactccgagctctctgctcgttccgcgcccttcccggtgcgaagcccccatacaacgccccgcagagaaatcccttccccgcggactcgggaaggtttcgtccagccccctcggcccgtgcaagtggagacttgcttgacgcctttgggccaagccctgcgctccacattattgagctcctggggtgtgcaggccccagcgggagggcgggccgtgcggcgggtgaggccgcgagatgcccagaggatacaattttggaaccatatgcccgactccgcagaatcctgggcgtaacacctggggtgactggagagtttcggcgacttcttagggaagtcgagtctaggactcctgcgggaagttggggtgggggacgctggcaagatatgagtcaggggaagggctagggggagaggggctggcccagcaagtgcaaagagagccagagttcgggtgctggaagaaagcccatgcctacctttcttcccctgtccaaagccaggctgctctgctccacgcgcccacttgaaagccactcaggcacgctccccttctatctcccctttgccctctctgacctgcctcaacatcaataccgccgcctacgtgggtctgctgataggaggctctggagagagtgcgctgggaattgttactctgtatagttccacgtggcctttttgggggtgggggcagcaaggcctaagccttggcagaaagcatcaagactgaaggagccccaggggatggggccttctaaagggcttgaggttgaaggacctactcagcctccagcatcggcctgcttctcctgccttgggaaaggatcatctcaggcgcaggactgggggacaggagtggtggtggatgatggccacaaaggcagctgcagattacaagttcccaaggaaagatcctgtggctggactggggcgccggcccctgagacctcctggatactcagaatcaagtccccaaaacaagcactttgtcttttccaagcgggcatgcttttcccaggggattccagatcctggagacacacagttctctgctggcctctcatccacgaggtcccctctcaaatttggggtaggttccggatgtccctaagccctctttaccttgactttgaaattcacgaatggacagacacgtctgcacacgcgtgcacacacacacactttcccattttgctaagagctcagtggtctgtaacctcagacagacctgggttcctattccagctcactatttaccagctgtgtgacttcaggcaagtcacttaaactctctgagcctcacttttcttctttaaaacagaacaaaaacaaaaactaggctgggtgtggtgactcatgcctgtaatcccagcactttgggatgccgagcggggtggatcacttgaggtcaggagttcaagaccagcctggccaacatggtgaaaccccatctctactaaaaatacaaaaattagccggtgtggtggtgcatgcctgtagttccagctactcgggaggctgaggcaggagagtcacttgaacctgggaggcagaggttgcagtgagccgagatcgtgccactgcactccagcctggatgacacagtgagactccatctcaaaaaaataaataaattaaataaattaatttttttatttttgttttttatttttatgggtacattgtaggtgtgtgtatttatgggttacatgagatgttttgatacaggcatgcaatgtgtaataatcacatcagggtaaatggggtatctgtcacctcaagcatttctcctttctttgtgtgttttctttttcttttttttttttccttctttttttttttttttttttttgagatggagtctcgctctttctcccagactggagtgcagtggcgcgatctcggctcactgcaagctccacctcccgggttcatgccattctcctgcctcagcctcctgagtagctgggactacaggaacccgccaccatgcccggctaattttttgtattttttagtagaggcaggggttcactgtgttagtcaggatggtctcgatctcctgacctcgtcatccacccgcctcggcctcctaaagtgctgggattacaggcgtgagccactgcgcccggcctctttctttgtgttatatacaatccagttatactcttttagtttagatttttttttttttgagacggaatttcactcttcttgcccaggctggagtgcaatggtgtgatctcggctcaccgcaacctctgcctcctgggttcaagcgattctcctgcctcagcctcccgagtaactgggattataggcatacgccaccacacctggctaatttttgtatttttagtagagatggggtttctccatgttggtcaggctggtctcaaactcctgacctcaggtgatgcgcctgccttggcttcccaaagtgctgggattacaggtgtgagccaccgcgcctggccctagttatttttaaatgtgcaataaattattgttgactgcaggcaccctgtagtgttatcaggtactagatcttactcattctaactatatttttgtacccattaaccatctgcacttccctgcccccagcctcacttttcttatttttaaattggagacaatatgaacctacctcccaaggctgtggcaaggactgaatgagataacaaatgtctatggcagtgtctggtgcccagtaagtcttcaataaatgttagctctcttaggtgtcatgttcatcttcatttccctttctcaacccagctctcaggagaaagtatgacagggccagggctgaagttgctcaggactaatggtggatccctcccgtaagtgaatgtagtttgaaccaaggctgaagcctcaaggcagcatgcaaggagaggttttccttttgggaagggcaggaagagaggtcagcactgccaaccagctcatggtgactggccctaatgcctgccagcgccctgcagcccacggcttgtgggaatcccataagttcccaccttccccagcctctcagaactaaccacagccccatgatctgcgcgttgcagccaaagctagccccaccccccttgatgaaaaaggctgacctcaccttggggagccatgggccacctgaatgaccttccttgctgcccttctccttccccacacggctcgccgctcttccacctacctgctgggtgagcccaagccaggtggggccagccaggctgagatcaccactctcctgacgacagccacactgtttctaccaatggctcattccctgacttggcaggaattccccttctcgagttgcccatgggtgcccagcctgcaccatgagcggagcactccgagcctttctccttccagccctgcttcccccagtctccaaccctgactgggtggtctcgggtctcaaaacttgagtcctgcaaggagcgggaggggcctctgtgttgcccacagcccatgtagttccacctccctacttgcacactcaacttgcccttccactttaacagctttcagagcccctctttgtctcctttttctttttttccagaggcaaggtcttgctgtattgcccaggctggagtgcagtggtacaatcatagcttgctgcagcctccaactcctgggctcaagcgatcctccctctctttggcctccggggtagctgggactacagatgcacaccaccatgcctggctaatttttgtgttttttgtagagacagggttttgccgtgttttccaggctggtcttgaactcctgggctcaagcgattctctcacctcggcctcccaaagtgtcgggattacaaacatgagccgccatgcctggcctttatctctttttttcaagcaatgcctgatagcccatgttttcctgcaaatcatcaggttctttggagatgaggtggctgatttctccctccctctgctcacttaactccttgtcctcagcaaattctattcaaacttgtgggcagagcaatataccacaacgccacagtttctgtgccagagcccgaacataccaccatggacacatactaga

SEQ ID NO: 7448 - DNA, 2557 bp, artificial
  synthetic oligonucleotide
cagttatacatgtctcctcccagcaccatgaaagcccctacaaaacttcagaagatcaccggctttcaattgtcttcgagctggacagcagctcaggagggctggctgcctggaggggatgatgccgacacaggaggcgctgctggctgtgagtaggtgctcaccctgagcgtggtggctgctgggaggcactaccccccaacccccgacagctggggagtgggcctgttgtttgggaaacagattccgtgttcttcaggagggccctctgggatggtgggaaatttggagggtgtgggagatggaaagacacaaacctgtggttcatttgaaaagaaaaaaaaaaatgaggacgaactggctttaggcagagtcagcaaatgagatgagggcaagccccctggagtctctaactccactgatccccaactcctaccttggagccaaagctcagcctgcaaaagtccctgggaccagggcaaagaggcaggcacctgccctgggctcctatcagaggcattgcagcattcaggggtttggggcttctgtccagtggtgccagagttaacccctcagccatgaataactgctggcccaacacctgtcctgtgtcatctctttgacctctgatgtgtcctcagagtgaagctggggaggccctggccttagctgatctccccacagcccggtgcaggcggaccaagattgtcaacacagggaggttttgccggagtgagcacaaagtgaatttctgcaggcccttgagtgtgctgggggatggggacacaagtagccatcaagctgacatctcttcctcagatggagaagagacccaggggaagggaggggcctccagtcacactgcacggggctctacgtattatataaagtgaatgccactgcccggaagtgtgcaagcaggtggcagtaaagccagattcaggagagttggggagggcacttggagaggagagatcaggaggggctcagactgggacaccacaggggaccatggggcctggccccagatatccaggactagggatgaggtaggatgggggattgtctatgaggggaactcatcagcccccaatttcatccactctgcatcctcccaaggggcaggcctgggctgaggtttgtaccaggaggtagacaattctgctctttgggattgccacaatccactgagaagtgaggacaggcctgaaacatttgctagacagaggcatagcagaggcccagtggaaatgcagccactcttcagtttccccaccctgcccccacatcggggttgagggttgttgttgttgaatgcagaaaaatataacaatgtgtataaaggtgcagtatgagtcacttcacggaatgtctaggcccctttgctggcagcaaacaagctttccagccctcttttgaggaagccatccaactcggcggctgctgctggtttgtgtgtgtgagggtgtatgagtgtgcatgtgggtctgtgtgcaacatggctctctgggccttgcctgcctatgtgcgtgtctgtgtgggtctcacagatgtgagtgagggcataactgtgttcggggtgtgcatgtgtgtgcatatgcctgtgtgtgtgtgggctcaagtcttggatgtcgggtcccctcgtgcatgcatgtgtgttcgtggagggcatgtgcacatgtctgtctgcaaagcagtatggtatgtgagcctgtgcgtctcaggatgtctacgtgtacattttttcctcgtcgctgccaaattatcttcccatctctcccctcacgaagagaagggctgaccgaggggagctagcagtccaagacggaggtggccagggacgggagaggggctggagggaaaccaaagcaattccactcttcggaggaatgtgtcagccaaggatgaaactgaaaccgagacagcagctcaaaggcaccagaccctgggatcgtccaggggcttcggttcctcccactcccccaccccctccagccagctgtggagattagtcagcccaaaattcccatctctgcagccttaacttggggttgagtttgtgatgctgagttagaacttggacccgtggttagcacgtgaccccattagctcccattatcacattaacacaaattagtttatcagatcctctcctggtcacctaggggggcttggggaagagctcaccgctcaggtcctgctctgggagaagaagccagcgccgtggcatcaggagagggcagaggctgagactgcaggtcagattggggacagaaagagggggcagggggacgtcaagctttgctgatctgatctttctcctcgatggtgctctgggaggagacaccttggggaggggtctggtagaaaggagggggcttccaggaatagctgggcaccgccctgtaggaaaaaggcccgggctctgaggtctgggcgggagacaggcggtatttctcctggcacacagtgagacctgggaacgtttaggatcctttggattccccccgccccttccctttctttatgggaagtctttagatgactttctcagatg

SEQ ID NO: 7449 - DNA, 1591 bp, artificial
  synthetic oligonucleotide
gtgcgcccgggcgcctctgcagcgccacctgcacgcggaacgcggcggcggcggcgggaactgtcgtccaaggaggagcagcaggaggaggagatatcggctcctctgcccccagctttcctcgctggcacgcggcctcccttcgccgcctcagccccaagcggcctgaccagcccagccccaagccttgtcccgcgccctgcccggcgcaggcagccagcgccccgagcttccactcctgctgctgcgctctgagcggcctcctgccctgggcgcctcttctggggaagcagtgaagtcacactgggccggatccgctgactcatgagaatgagactcttccccggtccccggcacaccctttgaaacttcccctcaatcctttcttttttttcttttcttttctttttttttttttttttggcggagtctcgctctttcgctcaggctgcagtggcgcgatcttggctcactgtaacctccgcaccccacccccgggttcaagcgattctcctgcctcagcctccggagtagctcgaattacaggcgcccaccaccacgcccagctaacttttgcatttttagtagagacagggtttcaccacgttggccaggctggtcgcgaactcctgacctcaggtgatccgcccgcctcagcctcccaaagtgctggaatcctttctttctgctcccgcctcccctcttcctcccgtcccgacaggcgaactggagcggctctgggctccccgggaaggattcggtggggcagctgggagggcggtggcgcgtgggagtccccgtggagatctccgcgcccctgttccaacctggccacctgtgctgttctaggggtgcacagggaatgcccaggagggaattgcatgtttgcaagattgggcaaagctctcactaaggtatccttttgtaattagccactgcattcagggagtgcctgcccaagggaaggggtctggggatccccttccctcttcagaaccttgggactgcctgaggagttcacctggaagctggtggctcttctttagaaccacctgttccaatgaacaagtgagaacatgggcttgcttcaggcgggatttggaacagcttctgccactgaagggacaagtgtggagtgttctgagccttgagctgttctggaccccagcagcaagtcgagccgatcatctgagaggtcactggccctttctcctggaacttgatagtggaccagttcaggatagggtgggggtgacttggaggcccaggagtccgggttttcataccacccccttgtgacactaatttgaggacagtggaagggatgagaggattggattgtctcatcacctctccactggggtgggaaaccagaatcacaccctggttgcttagaatattagtttcaacaaggtgcctaagggcctcaggcccaggccagggaaggcttcaagctagaggagccctgctggcctctgaaacacctaaagctcccctttccttccagaggggcatagtccgtaagcatcctttcccacctagcaaatcatggtactggattggcattgtttgcctgtatgcactttccttt

SEQ ID NO: 7450 - DNA, 2067 bp, artificial
  synthetic oligonucleotide
cgggtgggcattggacagagaagccggcctgctagagccggggaaggggaacggcgaccggaggcctactgcgcaggcgtagcactcgctgccgcattgcgattggtccgcacggcgagaggatttgcgcatgcactagctggccgcaagctcgcaaagacgctggctctaggtagccggttttcgcgagtttgtggcacagtgttggactgaacgagttaaggaacctgttcaaggagggactcgtggggccgctttgattggcggttgtgcctggtgctgccgctgtgttggtgacgagaactgataacagcatctcacaacagcgtagccccggcatcgcactttgttttttggttttaggacaccagttacttgataccgaagccttcctgattcttttgcagtgatccagatccagtttttccatgagtccgaggcgcggaacctggcttcccagatccggcgtgtacttccatcttttaccagttgccggctctttcccacccaacccgtttcctggacaagtaattctgcgctcttcttcccgcctgtcacctttatttattagttcagttgtgtgtcctagatgctgtataccaggtgctacagatacacacagtctcctgctgtggtttctgtgcttgggagcaggatgttagcaaaaagcgttcgtgcttctcggactttctgggaagagaagtctgctaagcagaactttcagttatgggagtagggtgaggggctgagtgtaaataagtgttttgactctgccagatataagctaaattggaaataatgttttggctgcatgcagaacatacaatgtgcctgtttcaaagattcagcttacatattcatttaacaagtatttattgagcacttacctcttggattgtactataaaaggggctctgttgggtatgaaaagtacggatggtccccgacttacccctcacaatggttcgacttacaatttttcgactttatgatgggtttaatgagacctaaccccatgtcagtcgaggagcatctggacttaagcatggttcaacttacggttttttgactttatgatgggtttatcagggtattaaatgcagtttcgacttaacgatattttcagtttacaatgggtttatttggacatagcatctatataggaagtggccactgtctagttggggagatgacatataccggtcattgaaataatatctggtgtagtgccggacagagcaagagagaagactatgggatggaatcactatggtagaacttcgtgtaagaagttatttgagttgtgtcttgaaggatgagtagtaaaattcaaacagtagaggaaaaggattgatatttcagatggtgaatactttcggaccaaagataacatttttcattgttaaacatgttgaccttggatccagaccaacccacattgaatcctggctctgccacctgggcaagtcacttaattgtgcctcattttcctcatctacaaatctcaggagggtgttcggaagactaaatgagctaatatttgtaaagtgtcttagaggaagcaccatgctgtttgttaaatgaaaaggcttggaactgttttaaaaaaccaaaacccagcacattttcgggggacaatgatagagagtacatactaagaagtattgatgtggtcaggctccgtggctcatgcctgtaatcccagcactttgggaggcctaggcgggtgaatcactttaggtcaggagtttaagaccagtctggccaacatggtgaaaccccgtctctacaaaaaatccaaaaattagccgggcgccatggcatgcgcctgtaatcccagctactagggagactgaggcaggagactcgcttgaacctgccaggtggaggctgcagtgagccaagattgtgccactgcactccagcctggatgatggagcaagactctgtctccaaaaagaaaaaaataaagaagtagtgataaagacaggcaagtatggtggggggccagatttgaactggcaagagttgggccctaactttggaggtaatgaagttacttttttt

SEQ ID NO: 7451 - DNA, 2369 bp, artificial
  synthetic oligonucleotide
atgccattgtcccaagatcctccacctgggccagtaatggctagccccgtaaacaaagtccccttttgctggaactgccaccactagcttcccccccttctcctagcctctgtgtggccctctcccgcggcgggccttccccattggccagccaaacacaaccgactgcggcagccaataggagccgctctcctgaacattcagaggatgggtgcgcgtggtgtgataaggggatgttggcgcctggtacgcgcccccctacatctggcaagtctgtaacagaaacagttacaccccctacacacgcacacgcgtgcccgctggctccctcctctcagctgtacaggccccggacaacccactgcgtgtcttggcagcggcctcccaggctgcctggggcccgcgagtgcacctgctcactcattaagacagagcatccctttatcccaaggcgcgggtcgggtagagggtgggggtagaggggacggggtagcggggaccgggaaggcgcggctcagctgcccgctgctcccgaggtgaaagaggtgcctccgcccccaccccatccccgcagagttgcgttgctccagggaggccgaagtgatccagtgatgtcttaaggtgcagctctttgtcctccccagctgtgctccctgcccgctgaccccgtgcgctcgagccagtgggggtggggagcccgaaacctataacataaacgggggcaaggagaaagaagtctatcccggggtggcgtgtgccgctgtccccaccccgtctctttcctcctgaggcttcttccctcgggtccgtcccgggaatgcaggcaggggagggtgtgggccgaggcgcggcggcggctggagcagcgcggtagggtccttcgccagagcatccggtccgagggcgcacacaggcagaaggctcgcggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggtgatccagggggtcaggtccaggaagggtgggacccgggaggggacctcgcccgaggcatagctctagcggttgtcgtcgtccagcgtccagcgcgtggcggtttcgcctcttgctgagccgaggaccctcggctcctcctcaccccttttcacctctctcagcggggccccgtccccacttcactcagttttttagggcggttgagaatggggttgcattcttacccttagcccctgcctgacaggtcctgccaggaaaagcatgttggattcccatccatgacccctaccccgagcagcggcacctgtgggcagagggaggcaggaggcatctgtgggtcctagtctctgggatggatcccaaagcactttacacatcctgatgtctcttctactgcttgggtgccgataggctgcaaaaccccactttggctaagcctcaaggcgttagagggaaggaaatgatggaaatccatggagaatgaaaaagctgctttattttaaattgcagtttatagttaaaaaattagggctgagttgagatggcggtggagtggggtggttctggcagaaagccatgagcccttttaaagaaattgaggcagggtccagcccttcgtaatagacaaaacttgtttttttgtaacagcccccctggaatgatatcttctttacttgtctggggcatctaatacatgaactgctccttattcattctgttggtattgtcttcaggtctttgtaaaaatgcagtgacttaaccgagggccaggggaatgttcaatcctccccctccatgagtttatgtaataggctaagtgcaaatattcttgtctgaccatttgtgctcacctttaattcagaaaaggtagaaacctgatatgacaggaatat

SEQ ID NO: 7452 - DNA, 1568 bp, artificial
  synthetic oligonucleotide
aggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagattatcacatggctttttgtcttgctttcctccaagacattcctgattgtgatgagcagaacaggcagtttgccctactagagtgatattctccatgccagtggcacactccctaccagctttctaggctctctgaaattctcatcgtttgagtcacttcttcaggactaattcattctctcactcagtgtaatcagtgggcagaaacacccggtggggttgggacacaggccagatatgtttttctagagagcaagtgcaggtggagtgatagagaagtcttgaaaggagatgtggactcatcagtatttcctaggttccctagatatgtgccttgaatgtccagatagactactctctccctattttccagtttaaaagtaaaaagtatggccggacgcagtggctcacgcctgtaataccaagactttgggaagctgaggcaggcaggtcacttgaggtcaggagttagagaccagcctggccaacatggcgaaaacctgtctctactaataatacaaaaattagccaggcatggtggcacatgcctgtaatcccagctactcgagggctgaggcaggagaatcacttgaacctgggaggcggaggttgcagtgagccaagattgtgccactgtgctccagcctgggtgacagagtgaaactgtgtcaaaaaaaaaaaaaaaaaaggagagttggtccagtgggcccaattacttccagaatagttagattctgcttcccatttttcaccaatcagtcttgaaccctaaggctgttccgactgtgacccccacccccattctttcttggatgggcagggctcaagcaacaaatatctatcatgtccccagacctttgctaggtgctagggaagaaatgttacaagaggacacattctctatgttcagagaccctatgatctatttgcaggaacgatgtacacactgaaagtacgtgcaaacaaaaactagacaacaacatcaccaagtgtgaggttgtgccatgggaa

SEQ ID NO: 7453 - DNA, 1799 bp, artificial
  synthetic oligonucleotide
tctagttttcagtctcgatgcttccaaccgaaataatgacaattattaatagcagctaacatttatcgagtgctgtgtactactaagtacaatgttatatgcttaatgtggaccgtcatgcttaatcctcacatcacaattaccctctgaggtacagaatgatcaaagcttcctgccgaaggccacatgactgcaagtgttggagcagactagaactgaatggtctgaaccacaatgttaatttcccttatctttctctatttctctcaaccctgagaggaggatgtgctcctgggcctgaagttaatggtcccatctctgcttcatttaggattaactagtagattagatgggagttgatgttagatgccagatattattttattgaaattcaagaaaatcctgtaaaaatgattttcaattccattttgcagaggtggaaactgaggtaatttgtcattcagaaaataaatggttatcaggaagtactgacctgttcacattatagagcaccattttccttgccctggttttaatcaaatcagagcattttctttaatggaaggtctgtactattcaaagctgacttttgatctgtcgacaagtaaacaatccttatccggagatcgacaacttcattcccttcattcttagctgaattcattcttaggtcaggcttgggcccagaacgtgggggtaagggttgagcaggctcctgaggaacaaatcatcctcccaggaggggagggcaaggcagggggatggaaagtctaggaacggatgggccagcttgaacaactgaaacttttaaaaaagaggtattttagaggagcttcctgcaccatttgaaggatgggaagaaatgacctccaaggtccttttcagttctccattcctctgaacaacaaaaatagtgattgtgcactggtttctatggccatatgcatgttaagacagctatgaagagaacgaagttttaggtctctagataaggattgtttacttgtcaacagatcagaagtcagcttcgaatagtatagacctttcagtaaagaaagaagggaagagggattaaaaccagagcaggaaaaatggtgctctatagtatgaacaagccagtacttcctgataaccatttattttcagaatgatgttacctcagtttctgcatttgcataatggaatcgaaaatcacctttatggtatttccttgaatttagataaaatataaaatgtattttatgcataaacatttgtgtattattccttatccaattcccctgacataaaggacacttgtaaagaatgaaaatggaagatcattcatgtagcgcccaatcattcagttttaaaaatgaagctgtgctgaatatgtccttcttttaaattattcaaaactgaggtaacttgaccgcaaagccacttggaagttaccaagagaactaaatcaactgtttgaaattacttcaaattgtggcctttaaggatttgactcaatcaataagacaacttgttaagtagctgagttttccaagcttggggtatctactaatttatcaaggattcttatgttctgaggcactgaagatttgctagatagaaataccctcttctgttattttatcaagaaaaacacttacacaacttaacactttccttcgattctatgttatgataatctagttaggagaacatactggagaagatagacgagggggaaaaatggagataaggggaaaacagaaaaggacgatttcaagattgagtgaaaatatccctactctctgagaaagtaaggt

SEQ ID NO: 7454 - DNA, 28029 bp, artificial
  synthetic oligonucleotide
ttgtaaatacatttacaagaaaaacacttgccaaaatactgcttacagaaacattttctagacattgtgctttgaactgtaaaagtttcttctcccaaatttctccacaaggtttatagcagtactggttcatctctctttttcttttttgagacggagtttcgctcttgttgcccaggcaggagtccaatggcgtgatcttggctcaccgcaacctccgcttcccgggttcaagtgactctcctgcctcagcctcccgagtagctgggattacaggcatgcgccaccacacccgactaattttgtatttttagtagagacggggtttctccatgttggtcaggctggtctcgaactccccacctcaggtgatctgcctgcctcggcctcccaaagtgctgggattacaagcgtgagccaccacgcctggcccaattcatctcttaagagttgcccagactgaaaatatcgtgtggcttacataacacacacgtaaatcctgtcactgaatcctaccattttttttatttgagctagttttttctttcttatttatacagctatttgcttctgaccctgaaaataagctttacaggaaaagacagagaataatcaaaataaaacagtgaaaagtcccaaaatcttggagcatgcatagttggtccctgcttccggtcagggtgataagaaagtccgggcaccttttcctttgatgccagcaggaaatttaaaactagcaaatctacagccgcatgactctgcttttggctgtagtgggaaatttaaaacttgtgattctccagcctgcctccttctttggcattggtgggaaatttaaaactggcaacaaaaattggtgcagttgagaaatttaaaacttgcaaatctacagcctgtgcggcattttcaccagccccacttcctagatgctataaaggcccatccaacttcctctgcctctgaaaccagcccagacctgtttgcagcacccagccctccctcacttacccccactagtccccagggtaataaaatttctctcaaattctcttgtcatatctagtgtcacgagtgtccacatccaacctaaaattacgaggaggaatggtcaaactgcctcagcaggatgaccagaaaacacttatacacccaaatttcaatctaacttattctttttttcgtgaaaaatacagccaagaagaccagcgggctctggtcagttgactgtttgcagactctggtcagcaaattttctatcaagatgaaaatttgagaaactaaataataacaataattaaaaggatgtctggtgagaatggaattaacacatgggaaattgtttgggtgatttttaactgttcttaaaactcttccccaggcttctagaaaaccactctatattggttctcttgactggctggccgtacgttcttttttatttttcagcacttccagtaaatgagggcttactcctgtataggtttttctgacaattttaaaaattgagacaaatttacatgaaaaaaatctaccattttgaagtgtacaatagagtgatttcttatatatatttacagtattgtgcaaccatcactgctatctaattccagaacattttcattacctcccaccaaaaaacctgcaaacctattagtagccactcctaatttcctcctatttgtatcctctcaccaatcattaattaacgttttttatctatggatttgcctattctggatatcacatataaatgtaatcatacagtatgtagtttttcatgtctagcttctttcattcactataatgtttctgaagtaggttcatccatgttgtagcacatatcaattcgttcttttctctctttctccctccctccctccctccctccctccctccctccctcccttccttccttccttccttccttccttcctttccagatggcctctggctctggctcttaggctggagtgcagtggggcgatttccagtcacggcaacctccacctcccaggttcaagcaattctcctgcctcagcctcctgagttgctgagattacagggtcctgcaaccatgccaagctaatttttgtatttttagtagagttggggcttcatcatgttggccaggctggtcttgaactcctgacctcaagtgatccacccgcctcaaccttccaaaatgttgggattacaggcttgagccactgcacccgggccacttcatttctttctattattgcatgatatttcattgtacaaacatatcactttctgtttatccattcttcagttgatggacgtttgggttgtttctgcttttgggctgttataaataatgtagccatgaatatcagtgtattagtctgttctcacactgctcttaagatattacctgagattgggtgatttatacacaaaggagatttaattgactcacagttccgcatggctgggaaagcctcatgaaacttataccatgaaggaagagaaagcaggcaccctctttacaaggtggcaggagagagaaagagtgtgtgtaggaggaaatgtcaaacacttataaaaccatcagatcttgtgagaactcactcattatcatgagaacagcatgggagaaactgcccctatgatctaatcacctcccaccaggtctctccctcaaaacctggggattacaattcaagatgagatttgggtggggacacgaagtctaaccatatcaactggtgtacaagaatttttttttttttttgagatggagtttcactcttcttgcccaggctggagtgcagtggcatgatcttggctgactgcaacctctgcctcctgagttcaagcgattctcctgcctcagcctcctgagtagctgggattacaggcacccaccaccatgctcggctaattttttgtatttttagtagagacggggtttcaacatgttggccaggctggtctcgaactcctgacatcaggtgatccacctgcctaggcctcccaaagtgcagggattacagacatgagccaccatgcccagccggtgtacaagatttttaaaaaagctttatgaagataaagttcacataaggtacaatttatgcacttaagtgtgcaattcagtggtttttagtatattcacaggtacatgcaaccatcaccacagtcaattttagaacactttcatcaccctaaaaagaaattctggccaggcgcggtggctcacacctgtaatcccagcactttgggaggccaaggcgggcggatcacgaggtcaggagatcgagaccatcctggctaacacagtgaaaccctgtctctactaaaaatacaaaaaattagccgggtttggtggcgggtgcctgtagtcccagctactcgggaggctgaggcaggagaatggtgtgaacctgggaggtggagcttgcagtgagccgagatcatgccactgcactccagcctgggcgacagaccaagactccatctcaaaacaaagaaaaaaaaaagaaattctatgcacattcgtcacaacatccttactcaccctacccctcttttcagctaccctcctgccctacacaactactagtctaccttttgtctgtgcagatttccctgttctttatatttcatataaatggaagtatataatatgctgtcttttgtgactggcttctttcccttagcataatgttttcaaggttcactcacgttgtagcatgtgcttatttcctttttatggctgaataatattccattgcatggctatagtatattttgtttattcatttgtcagttgatgaacatttgtgttgtttccacttttgggctattatgaatattcctgtgcaaatatttgggtgaaaatatattttcaattctctttgttatataactaggagtgtaattgctaagcaatatgataactataattaactttttgatggactgttaaactttttcaccatggctgcacagtttttcattcccactaggatttattatgattccaatttctccacaaactcaccaacacttgctattttccatttttgtttttcttattttggttatagccatcctaatgagtgtaaagtagtaccatggtttctgctggcttctgatctcagaatttctgccacttcctacagtcagtccactggtcccgggttttaccctttgatctgctgtggtgggcccacttgttctccattcaacatccgtgttacacaggaactgggaacaagtcagggaaactaaacctcagatctgccatctgcctgagcctgaggcattttcatttttattttgatatcactgtgctttaggatggtacacagaagcccaataaacagcctctttctagagcaagatggcatgggtgaggagttggaggaggtaaaggaagagaggggttggagaggacggaggagaggacgggggatgaggatgagaagggatagaaggaaggagaagagataagaaaggatggagaggaagggagaattatccatgacctgaaaaagttgaaccccttcctctagttacatttccagtttctttcctggcctgaatttgggtggagcctgatgcccaaggcaggtgttttgtgtacatctagcagctataatgttaccaagcacagagaagtttgaagcaagtcacataggaatatttattgggcttcccaggcagcatcatgaagtgggctgacagattgtgttttcaatttactctacgtattattattaaaaagtccttaagattgttgttttgttttcctttttctcagtatgagtatggatcctcagtggcttttggtcaactcattctccttctgaatatggagacagtttggaagcaaatacacgaagtgctgaacccctagtcatatgccctcaaaagtgacattggcaaaatgttaaaactaactcttgttatctttcttttaaatatcttggtcaggcgtggtggctcatgcctgtaatcccagcagtttgggagggcaaggtgggaggaccctgaagtcaggagttttgagaccagcctggccaacatggtgaaaccctgtctctattaaaaatacaaaaattagctgggcatgatggtgggtgcctgtaatctcagctacttgggaggctgaggcaggagaatcactcgaactgggaggtggaggttgcagtgagctgaaatggcaccactgcattccagcctgggtgacagagtgagactccatctcaaataaataaataaataaatatcccttcccatctggcatccaagagcacatatcacttccccacattctgcctatccacgtaaactccaagtcccctaaactctcgttggctggaatctaaaagtctaaaagtgctagagtttccccctactcacgttagaagagctgactatagatatctcttcttgacttgttcagttatgtcacgttggtaggttgaaacttgccatgatgaaagtattaacaccacaggaaatcaacaaacactactaatgagagctggattaccagcataaacccctggttgaattctatggcttcagtctctatggcctaatgcttaagtaaaggtgcctcagaaagctcctcatattcttttaaaccaaagcagcaattccatgtttacattttgagcttctacctaatatttttttgaagaaaagtttccactgatatgaaataaatgataaacatttgaaagctattgttctaggccaagccaccagttttgaagatgtgttcatggaaacctagaaaggttaaaatagttattcaacatcacacaagggacaagagaaaaaagtcagggcaagtactgggacctaggtttccttaatcccagtccagtgctcttcccatctgtacttaataatactgcattaaaatgtttcctgttctgtttctcatcccatcaaaaatgggtttgtcaaatagtctgtctaataaaataatcaacgttcccaggaacgtatgtttattatgagtggggccttctagagaaaatgccccctcagaacactttagtgaatggaagatattcactttagtgaatgaaaggaaagaaaataggcaggagtagagataccagatatacacaaatgacaaaaattgtggataaaaattatacagcacttattgtgtgcaaagcactgttctcagtactttataaatatgaattatttcatacaacaactctatcagtaaagtactcttattaccatcccactttacagatggcacagagatatcaaataaattgttgtcacaaaactggaaagtggtaaaactaggattttaacccaggcattctggttctagcatctggcatcttagccattatgctatcctgtctctttaggtgatcaataaatatatgtctctttaggtgatcaaataaatataaatatatagctgatcaaaaaatatatatatataattatactatcctgtctctttaggtgatcaataaataaagatagtgaatgaatgaataagcatataaatagcatgagacaccaagatcggaggttttggggtgtgttttaaataacagagggaatatcacaccatgctgtcttcatgtagaaccaaatataagtgaaatagagtaagtagccagtagaatgtatctcccaggaagaaaaagtcactcctatcaaaggtttggtggaagagatatgcttaatcacctgggtctctaagatttcaattaatgcctttctatgcctctcacatttctgattaagccacttagtggtagaggactcttgagctagtcccaaggatgatcaggccacttatataatttctaggaaaagagagttttcacactcctctggtaactgtatacatagattgacttagcctttcaaagcgaaaggtttaaatgtatgtaatcaggactttgcattatgctatatgtcagaggaaaggcacaagtaagtatgcaacatagatgcttctcttatggcattaacatctgttggcaggttaggcccaaaaccccagaaatgatgagtgagcaatgcaagaacatgtataatcaactattaactttgtgtggttcagactgtcaagtacagaaaaaattcacagaaatggaaaattacagcagatggaagtagacatggaaggcttgctcttaagcttgagtttagaccaagcaggatcttgaaggttgaatacaatttaataaggcaaagaagaggcatttcaggtaagaacagtgacaggagaaaaggtaaggagacagaattgaaaagaatgcttctgtgagacaataatgggaccagtctgattagaggaaatgttgtgtatgagcaaggcaggagaatggggtctggaggcagggaacctaaggccgtttcctgctgacttcctagaaataaattgaaaggaaaaccctaactttccacgcctaagtaacaagaggactagaggatactccctttgcaaaccttttctgtgcagcagatggaacattgaaagcacctctgattggttgctttttctcaggcctctgagcccaagcctgcatgtatacatccagatggcctgaagtaactaaagaatcacaaaagaagtgaaaatggccagttcctgccttaactgatgatattaccttgtgaaattccttctggctcagaagctcccccactgagcaccttgtgacccccgcccctgcctgctagagaacaacctcctttgactgtaattttccgctacctgtccaaatcctgtaaaactgccccacccctaactcccttttactgactctcttttcggactcagcctgcctgcacccaggtgattaaaaagctttattgctcacacaaagccttttggtggtctcttcacatggacgcgcatgacatttggtgccatgacttggattgggggacctcccttgggagatcaatcccctgtcctcctgctctttgctccgtgacaaagatctgcctacgatcttgggtcctcagaccaaccagcccaaagaacatctcaccaattttaaattgggtaagtggcctctttttactctcttctccaacctctctcactatccctctacctctttcttctttcaatcttggcaccacccttcagtctctcccttctcttaatttcagttcctttccttttctggtagagacagaggagatgctttttatccatgaacccaaaactccggcgccagccacagactcgggaagacaggcttcccttggtgtttaatcactgtggggatgcctgcctgattattcacccatgtttcagaggtgtctgatcaccgtggggacacctgccttgatccttcaccttagtggcaagtaccactttcctagggggcaagtacccccccaccccttctctccatgtctctaccctctcttttctctgggcttgtctccttcactataggcaactttccaccctccattcctccttcttctcccttagcctgtgttctcaagaacttaaaacttcttcaactcacacctgacctaaaacctaaatgccttattttcttctgcaatgccactcgaccccaatacaaactcgacaatggttccaaatagccagaaaacagcacttttgatttctccatcctacaagatctagataattcttgttgtaaaatgggcaaatggtctaaggtgcctgacgtccaggcattcttttacacattagcccctccctagtctctgtttccaaagcaattcatcccaaatctttcttctttccctcccgcctgttccctcagtaccaaccccaagcatcgctgagtcttttcaatcttccttttctactgacccatctgacctctcccctcctccccaggctgctcctcaccaggccgagccaggtctcaattcttcctcagcctccactcctccaccctataatcctctatcacctcccctcctcacacctggtctggcttatagtttcattctgcaactagccctccccgacctgcccaacaatttcctcttaaagaggtggctggagctaaaggcatagtcaaggttaatgctcctttttctttatctaacctctcccaaatcagttagcatttaggctttttcatcaaatataaaaacccagcccagttcatggctagtttggcagcaaccctgagacgctttatagccctagaccctgaaaggtcagaaggctgtcttattctcaatatgcgttttattacccaatccgctcttgacattagaaaaagccccaaaaattagattccagccctcaaaccccacaaacaagacttaattaacctcgccttcaaggtgtaccataatagaaaagagttacaattacttgcctctgctgtgagacaaaacccagccacatctccagcacacaagaacttcagaacgcctaagcaacagtgaccaggcattcctccaggacctcctccatcaggatcttgcttcaagtgccagaaatctggccactgggccaaggaatgcctgcagcccaggattcctcctaagccatgtcccatctgtgtgggaccccactggaaatcggactgtccaactcaccaatcaagcaagtaattacactgaacccccttgggcgctctctaattggatgtcctgggtcctcccaattcctagtcctttaatacctgtctttctccttctcttattcggaccttgtgtcttctgtttagtttctcaattcatacaaaactgtatccaggccaccaccaatcattctatatgacaaatgtttcttctaacaacctcacaatatcaccccttaccacaaaatcttccttcagcttaatgtctcccactctaggtacccacactgcccctaatcttgcttgaagaagccctgagaaacatcgcccattatctctccataccacccccacaaatttttgccaccccaacactttaccactatttctttttatttttcttattaatataagaagacaggaatgtcaggcctctgagcccaagcctgcacatatacatccagatggcctgaagtaactgaagaatcacaaaagaagtgaaaatggccagtcctgcattaactgatgatattaccttgtgaaattccttctcctggctcagaagcacccccactgagcaccttatgacccccgcccctgcccgccagagaacaaccccctttgactgtaattttccactacctacccaaatcctataaaactgccccacccctaactccctttgctgactctctttttggactcagcctgcctgcacccaggtgattaaaaagttttattgcccacacaaagcctattggtggtcttttcacacggacacgcatgacactttctgtaaccaatcagacgtttgcacaggagtgtgatctttgtaatttcacttcagcctctgattgtgggccaccactcatttatgaggtaccaagtggccaatgggaaacctctagcgggtatttggacctgagaagattctgtatctggggcccttgagccactgctcaggcccgctcccacactgtggagtgtactttcattttcaataaatctctgcttttgttctgtagttgcttcattctttccttcctttgctgtgcattttgtctaattctttgttcaaaacgccaagaaccctggacaacctgcagtcaagaccctctaccagtaacatattttggcaagctggccaggagaaagcaggtccaaagtttgggatttatttttctcctttccccttttacatacagggaaatctttctgtctctctcttttcctttctaactcaggaccctcagtaggcagcacctaagaatgcagacaactgcaactttctggccaggtccactctctggtgaaactgaaagtcttccatgtggaagtgcctgaccaccaccgcctggtttgggtaagggacctgagtccttttccttgttttcgtttttctgagtcctattcctttcttcctttttctgagttttcttttttcatttttcagtctttcagcggccttttcctagtagctccttggtaattgaggggaactggttgggtccactctccgttgttgtctgaaggccaaggagaaagcagggatggctgcccttctcagaagggggaaagactcttttctatccttttcagtgatagtccctgatccctatgtgtgaagcaattggcagtggcagttcatccagggtgaactcacacatgtttcaggcgacttaaacctccttttcttatgctaaattcttcccttcccccactcgactggctaaggacagaaaacccacctagctatgccaaaaaaaaaaaaaaaagggttatactagtcagagggtctgggattgtcccaggtagtctgtggggggtggggaggttaattcatgaaagggaatttattattgcctcaattgagagttaaagggttgctttcagtgggatagaaaatccttaaggaaagaaagttcacaataggtcctcagtggtagagggaaccattccaaagtggtgctgccatacatctaaggtcagatatctgacaggctaagtcagggcctttaaggagggacgccctcagggaacccagcctgggcccagaatttttccaaggggacacccgggcaaaatttgggtcacctagtgagccctccacttttcaaagtcctcttttccagaccactaagggcaactgtcagtctattccacctgattccactgtgggcaactctccacatattccacctgattccctgcttggttacatcatctaccatcggaatctatttgacaatctaaagagaaaatgtatacttttttctgcaatactgtctagccccattataagctgcccagcccagaacaatgggcagtcaatggtagcttaattatgacattatcctgcaattagacctattttgcaaggggtagggcaaatggtcagaaatcccatatgtaaaggctttcatgaccctattccacacctaaccatctgtgaaactcccagaacccactcccataaaggaaagttctaaggcagaactagatactatagatgacccccttttacaagggccacttgtctgtcagggtgaacagtgaccacccccatatggccccttgccaagtgctcctgaggctaaaacccaggagcaaacaccggagaccctactaagtccccctcacactcagagaggaacaccgtatttaactctcaaccctgctaccttttagggaattagcaggagctaaggggtcagtcctagtgcaggtccccttctctataattgatatacaataatataaggaaaagctgggaagctattccgagaatcctaggaaatttgcagatgggttccaaactttgaccttagcctttgatctctcatggagagatgttcaattcattctagcaacctgttgcactccttcagaaaaggaaggagtcattgaggccacccaccaggaagcagacgaattatttgcccaaaaccctcagggcaattgctcaggcccagacacagtttccattactgatcctaactgggaatataacacccctgtgggaatgaacaaccgggttaaatttcttgaggctttcctttgaggaatgagaaagggaataactaagacagtaaattatgataaagtaagggagattatgcaaggcagggaggaaaacccagccatgttttgtggcaggctggaggaagcctttaaaaagtacactaatctggacccttccttttccaaaggcaaaatattaatggcacagcatttcattagccaatctgccccagacattagacataagctccgaaagctacaaatggggccacaaactaatcaaaatcagcttcctgataccacctttatggtgtataacaattgtgacctggaggaaggaaaaaagggaacagaatgaagaaaaatggcaagccagaattacggcagccatcattggcgatgccttgaatgctcaaagagcatctaagggaaatccaaagggcaataaggataatgccagcaaaggctcttgcttcaaatgcaagaaaaatgggcactgggcaaaggaatgtagtaagcccctgccaggcccctactgtcaatgcgaaggcaccagttgtggcccctggcactagagaattgactgtcccttctcccaccaagggtctcagtcaggcaaaactctagttttgcgaaaggaggaattagatgaagactgaaggggcctggattcttcctcactgcccctgcccaggaacattttaattactactgaggagcctcaggtaactctggacatcacaggcacccaaattcagtttcttttcgatacaggggcaaattactctgttcttactgcttatgcaggaaaactttcctcccagtccatgagtgttatgggaatgaaagggaagccacagacaagattttttattcctcctttgatttttcaatttgagagacaaatcttccagcaggaattcctagtagtaccaagctgcccaatccccctcttgggaagagatattgtggttagaacaagggcactacaataatttaagcatcacccagtgaaattgctaatagtcaaaattacagacaatgtcacagaccacattaataaacaggctaacccactggcatggtatactggaaaaccggggaaggctaaaatggcagtgccagtcaaaatacaacctaaaaatcccagctaattttccaattgaaaacaatacccaattaagcaggaaacaagaaaaagccttacaccaatagttaaagtattacttacccatgggctcttaagaccctgtaattcattgggcatggtggctcacacctgtaatcccagcactttgggaggccgaggtgggcatatcacttgaggtcagtagtttgagaccagcctgaccaacatggagaaaccccgtctctactaaaagtacaaaattagctggacatggtggcacatgcctgtaatcccagctactcgggaggccgaggcaggagaattgcttgaacctgggaggcagaggttgtggtgagccgagatcacgccattgcactccagcctgggcaacaagagtgaaactctgtctaaaaaaaaaaaaccctgtaatcctccctgcaatacccccaccttacccattctaaaaccttcaggggaataccgattagtacaggacctcagaataattaatgaagctgttatttccatatactctcctggcttaggtgccaggggatgcaaaatggttctcagtcctagacctaaaagatgctttcttctccattcccctggccccaaagtcccaatacctttttgccttctaatgggaaaatcctaataccagggaaaaacaacaatacacttggacagtgctccctcagagcttttggaatagcccccatttctttgcctgggctttagagaggggtctgaggtatctgcaattagagaatgggagtatacttcagcgtgtgaatgaacttcttgtgtgtagcccaactcaggagtttctgaccaaaatactataaaaactttgattttcctggcagacaggagatataaagtgtccaaaaagaaggcacagattaccctttaataggtccaatatttagggtatgtcttaacacttggagcctgacaaatagtcccagaatgagtgcaagccatatgtggtttgggggccccccacaccaggcaacagcttcgttctttttggggaatggccaggttttgcagaacatgggtaccaaatttaggactcagagcaaagcccctgtatgaagcaacaagggggcctgaaaatcagctaatggaatggaccccggaaatgagaggagcctttgccaagttaaaacaggctctcgcccaggctcccgctcttggcatcccggacctaactaagcccttctttttgtatgtagcagagaagagggacatagctgtgggagtgctagcgcagaaatttggatcagaacacagaccaaccacctacttttcgaagaagttaaacggagtggccttgaggtggccaagttgcctgcaggcagtaacagccactgctatgttagtggatgaagccactaaaattcccctgggccaaccactggaagttctagcccctcatcaggtaaagttagttttagagctaaagggacacctctggatgacaggggaaaggataaccaaataccaggctatgctcctagacaatccagatgtaatccttaaaacctttaacactgaatctggcttcattgctgcccataggcccaataactgatcattcctatgagcaggtcattgcacgtatgttagctgtcctgctttgaaagatcagcctctcccagattctgaggatgaccgattcacagatggcagtagttttgtgtcaaatggggagtgctgagctggatatgcagtagtgaatcataacataattactgaagcccagccactgcccccaggcacatcagcacaaaagactgaaatcattgctcttactcgagcattaatgttgggacaagggaaaaagcttaacatctatacagattttaaatatgcattctttgtggttcatgctcatgctacaatctggaaagaaaggggattactaactagcaaacactcccccataaagcatgggcctgaaattcttcagctactggaagcaatacacctgtcaaaggccatagctataatccattacaggggacatcaaagggactcaacccctatagcacaagggaacagaaagcctgatagagaagccaaagctacagccctcagggtgcaatcccaacagatcctagcactacttcctttctatgattccccaatataaccggagtacacactacaggaagaacagttaataaaggaagaagggagacaaaaacaaggatcctggtggtattggggtcaaaaatatatctccctcagacagctcagtggaaagttataaaagccctgcgtgtctctttccatgtggggagagatgcaactctgcccatggtaaataagctctttactggatctaacttggcttcagtggctaagcaggtctgccaagcctgctcactgtgtgaacttaacaacccaggaaacaaaatgcctcctccaatagaaccagtccagaagagaggaacttatccaggggaagactggcaattagacttcacccatatgccagcttgaagaagatacaagtttttgttagtgctaatggatacctttactggttgggtcgaagcttatcctaccataacagagaaggctaatgaggccataaagtttctcttaaaagaaataatcccctggtctgggttacctcagagcctccaaagtgataatggctcatcccttatctcccaaacaactcaaggggttgctaaggctcttggaatcaaatactatttacattcagcatggaggcctcaatcctccaggaaagtagaaagggctaaccaaactctaaaatgagtgtaagctaagctatgtcaggaaacatcagaaacttgggtcagcttactgcccatagccctcttaaggatccataatacccctagagcaaaaattaacataagcccatacgaaatgttatacagaaggccattcttaactaatgatttaattattgatccagaaacagccagtttagtaaaatacctagtcaacctaggacaatttcagcaggctttacaaaagcttggaattcaaaggctttccacactgggaactaatcagtaaccccaaatcaggccaggagataaggtacttgttaaaacatggaaggaaggatcacctgctcaacaattacaacccaaatggaagggaccattttcagtaacactggccatgccttctgtggtcaaagtactaggattagatagttatatatatctttcaaggaccaaaccagcaaaaccagaggccccggaccaggaacctgaagttcccatcagccactacacctgtgaacctgtggaagatctgaagtacctgtttagaagacagccgaaatgcctaccaactttccttggtgtctttgttgcatagttactgtagactggataatagtagccatttatttttaactattgcagtttaattgccttcttccaaatggatggaatcactacctttgtagtaattaagcagaatgtttttaatacaattctgcaacaaacattcctgacagcataggtatccacccccaaagttcccattaaatcttttaaccaaattcatttcctctcacatagaggccatcaaagttcagatgcttgtgtgacaaggtttccagacagttccaggtgaagacaccacccccagccatcaagaagccacccggtctccactagacagagtagggcaaaagttccgtgatctccaacagatagggactatgccccaagtcagcaggaagcagttacagaagaaagaccgtcaggccctctgcctcctctagagatttatggggatcacatctttcggggggagatgaggcagaataggttctggaggcagggaacctgaggccatttcccactgacttcctagtaataaattgaaaggaaaactctaactttccatgcctaagtaacgaaaggaccagaggctactccctttgcaaacccctaccttttctgctcagcagacggaaaattgaaagcactttctgcaaccaatcagacgtttgcacaggagtgtgacctttgtaacttcacttcagcctctgatcgcaggccaccacttcatttacgaggtgagcaccaagtggccaatgggaaacctctagagggtatttggacctgagaagattgtgtatctggggcccttgagccgatgctcggcccactcccacactgtggagtatactttcattttcaataaatctctgctttcattctttcattgcttcattctttccttcctttgctgtgctttttgtccaattctttgttcaaaacgacaagaacctggacaacttgcagtcaagaccctccactggtaacacaagtgttatgggaaatgagtttaaatacttattcatttattcatgtacataatcatccatgaagcaaatgtttattgagcaccatgtcacatgttgggaatactgagataaatgggacacagtctctgccttcaaattggttacattcaagtggtgaaaacaggttcacaaacataaaagtactatgataaaagtaagctacaggtggcctcctgcctcagcctggactgagtcatatttcatttaaatgctgtgatttcacttctgctacatctaccttcttggactcatatttcaggacctgcattatgaattggtttctttcaggataaattagacaccaaaggtccatgataccatctgaagaagaaccttaattggtagaacatacaaaagcagttttttgttttgtttcttttttttttttttttgagatggagtcatgctctgtcacccaggctggagtgcaattgcgcgatcttggctcactgcaacctctgcctcccgggttcaaatgattctcctgcctcagcctcccaaatagctgggactacaggtgtgtgccaccacacccggctaatttttgtattttagtagagatggggtttcaccatgttggccaggctggtctccaactcctgacctcaggtgatctgcctgcctcagccccccaaagagctgggattacaggcgtgagccaccacgcctggccacaaaagcagttttgtatttccatatagtgtagcacttttttttgagagtccttcctctttttttttctaagagcaaaaatgggaatattaaacgggtgaattttgaaatgtaaaaaagaaattataaatctattttactatatatcctcaagcaagtatagccaaaggaggaggggtaggtaacagtaaatattttatctcctaacaatgtatctataaaccattctgctgaagaatctgacagattactaactgtgagaaaagaaaggttaacaactctgataatacataaactcagatcagatataggcccaatttttgttgtaatcatccatccataacctgttcagatgacaagccctgttgttaataaagcatactgtactacgagtacattgctctgtgctctgcttatatttgtagaaactgtaattgtctaaaacaatggcctcagtgaaaaaatgtgatatgttattagttgtgtaaagattaaaataatttaaacttataatagtagttgttttggaaggattaagacatgagtgatgctgtatagagttaataactcagcattgggtttttttgtttgtttattttgacaaggagtctcactctgttgcccaggctggagtgcagtggtgccattttggctcactgcagtctctgcctcctgggttcaagtgattctcctgcttcagcctcctgagtagctgggattacaggtgtccgccaccatgcccagctattttttgtatttgtagtagagttggggttttgccatgttggccaggctcgtctctaactcctgacctcaggtgatccacccaccttggcctcccaaagtgttgggattacaggcatgaaccaccgtgcctcgccagcattgttgttaagtttgtttccattctggtccttgtgagagagccataaatttcaagccacatcttgtgggagagacaaagttaccccaacagaatgcaagttccatgaaggcatggaaccatggctcatttaccaatatctaccaaagacatagtgattggaatagagtttaatatttgttgaatgaataaataaatgaatgggagtattcaaaagaaatggaacaagtttcagattcaagccaagtcatttttagagttcctccaggatggggcacagaaaattagagtggaatccaatctccataggattgggactgtcagggagcaggggagaggggatggaagcagaccccagacaagtggctgaggataccacatggtattttgcatcctagagtgggacagagaatccttgtgtacagaatcctggaagtaaacaataaagcatgcttctggtccttgccttcccacccctactactgcctcacctaataggattcgaaagtgttcttgcatctttaaatctggattctcctggaaaaaaggaaagagcatcagatctcttctgattatcactaatggagtgacaagtagaacaggatgcaggtgtggttcagggacctgtgtgaggggctaggacaagaacagggtcaaggatctatgaggtagagagatagagccctaggtcttaaaatgaaagggggattaccactcctcttgagatactaaagaatctgggtgaagatagaccaatttaaaggtgataaagaggggtaggtacagaaacattttgcagttgggggagtatgtacaattatggtttaagaggaggagaaagagggtgaaaagatttgttaggttctaagccacagccatttttccttatttatttctggcaaaatttggtgttgtttggagcctaccctaccacatgctctgggaaagtgatgaggcgtggatttgattagtttcattctccttaggaattagtttaggatagatgtgtgacacaattttgcctaatgggacccaaggaaaattctgctagaggtctctggaaaggacttttcttcctttgttgagagatagagatagagacagaaatagagatagataagagagacagagagagagagagagagagagaatgaatcgtaggtatagaagatagtatcccttttctttgctaggtgctcccatttgtatctgacaccaagcaatgctgaagccatgttacagcgctgacaggaggtaagaggaatattacccacacactgtaggtggcagagcggaaagaaaattcacttgggtccttgatgacatccttggtttactcgattgacctaccatggaaccatctttccccaaacttattttataagataataaataattatttttaaaataaatacttatttaaaaaataagtcatctctggttaggtcttctgttacatcttgcacttgtgttgatgcctccatcttttctagtaaggtaggaagaaagagcatgtgttataaatatgaagtgtgggatttgaaaagttggaaacagatatttcagttttcatcagttttcagctatagccccatcttcctctttcttccccaaccccatccccaccccatctcccgtaagactcagacgagggccaggagacacaggactggactcagagaatctctctcttctgatgacctaatctttgtttttggttcaagctcattgtgtttagctccttcttccttgaagacattctttcccaggaggctctccaatcactggagtaaacagacttctgggatattgcctctcagacatgtctaaactctaagctgtagcttaggatcaagtgggaaaccccaactacagtgctattttgtgcctgtatctagcaatactctgctgcctttgagcatgaatacagaaataataaaaatggctcagactcagcattggaaactgcttcaggcattattgggacctgatttcaatgggcaccagatatcagggaaaccagcccccagtatttcaatgtaggttcttttctattttccctaagtgtcagctggtctgagaaataaagataaagagtacaaagagagaaattttatagctgggcctccaggggtgccatcacatattggtaggacaatgacagcgaccccaagccacaaaaccagcaagtttttattagggatttcaaaaggggaggggtgtacgaatagggagtgggtcacagagatcacatgcttcaaagagcaataaaagatcacaaggcaagggcgaaattagaattactgatgagggtccatgtcccgctgggcatgcattgtcttgataaacatcttaacaggaaacagggttcgagagcagacaaccagtctgactaaaattcaccaggccggagtttcccaatcctggtaagcctgagggcactgcaggagaccagggcgtatttcatcccttatgtcaatcgcataagacagacactcccagagcggccattcatagacctacccatgggaatgcatttcttccccagggttatcaattattaatattccttggtgggaaaagaattcagtgatatttctcctactcacacatccgtttataggctccctgcaagaagaaaaatatggctctattctgcccaaccctgcaggcagtcagaccttatggttatctttccttgttccctaaaaatcgctgttactctgttctttttcagggtgccctgatttcatgttgttcaaacacccatgttttacaatcagatttcatattgttcgaacacacatgttttacaaacaatttgtacagttaatgcaatcatcacagggtcctgaggtgacgtacatcctcagcttacaaagatgacgggattaagagattaaagacaggcataggaagttataagagtattgactggggaagtgataaatgtccatgaaatcttcacaatttatgttcagagactgcactaaagacaggtgtaagaaattataaaagtattaattttgggaactaataactgtccatgaaatcttcacaatttatgttcttctgccacggcttcagccagtccctctgttgggggtccctgatttcccgcaacaagacataggagaaggtcagattatgctgcagtgtgcgtgactccagtagactacaactcccataaaagccacgtagcatacagcacagaatgcagcatatacagagttagttctcaacaaatgtgtactgagtttagttgaaatgattggtttctggaatgaaggtcaaatggcttccttttactgaatcttccattcagagagtgcatttcatcttctatccctttaactcccaaaacaaaacctttagtattttcacctcagttgtttaagtttctttttacaacatacttgtgacgtagggagtggtgagaatagttttatttaatttactaggaagaaagaaagacaaagagatgatctgatttagcataagtaccagagggtgtctgtggcagagctgggatggcccattaaatctctcgagccattgttctgatgtccgtgtgtagtggttttgatagcactttcttctttctgtcttactaggctgctaattatgcatgccaattatattcaggaacaccatgggcctaagggtcagccacgatctcaggaggatgtaattcaagtgagaaaataaggcacaatacagtatttccctccttctgatgtgcatattaattgtggccttataagtttgaaaacttgtgcaggagagtggtgctggttttattcccctccagatataaaaagaaaaatatataagtgctctgaatggaccacagctgaaaatcaagtgagaaacccaccagcttgatatcctcttaatagagaacactcaagaatgtggaaagagttctccaccagtctctaaaaaaaatcaagatggatactcattttcttcctccttattgaggcacttctagggcatcactctacatgcagtcttttaagaaagcctgaagatggtggaagatttagtataaacgttgacaaaaatgctaagatttagtataaactttgacaaaaatgctaattgctatttgcaaaaaatgctaattagctaaagaattagctaattgctaattctaaccaacactggcatttttcctaatttattttcactttagaaagcaatagcaaggtgttcagaagacaagatccaaacctggagaaggtccaaaggagaacgcggggcaagagagaatgcaggatgaaaagggaacatgtgtgggagttgaggctatttgggtgaggcgattgttaactagccctaggctaaagtcctgccactcatcctcgcagacaaaggctctgatgccctggacttcatgctgtgctggaccactgtcccttctctggggctgtgggtgccacctagaccctgggggcagagagatgcaggtggacttgaccctagctcttctcttggggccagacaggagtatttcactcacctaggaaaatagtattctaccattatgtatgatactcttttatcatgaagcacaatgttagttgtaggttttggtagatattctttatcaagttggggaagttcccctctattcctagtttactgagtgcttttatataatcatagaatttttcttttttagtctgttgatatggttggaaatgttgaatgatctttaaatgttgacccagcctttcatatgtgacataaatcccacttagtcatactatgtaattctttttatacattgttagattcagtttgttagtattttgttgagaattttgcatctaagttcctattagatcctagtccataatctgtagttttctttcttttttttttttttttttttgtactgactggttttggcatcagggtaataatgacctcataaaataagttgagaagtattatctcctattctgtgttctggaggagattgtgagaattggtgttatttctgtttaggtgtttggtagaaacaaacaaaaccatctgagcctgcagatttcttttgaggttttaaattatgaattcacattctttaatagttataggagtattcagatgatctattttgtctttggtgcattttgttagtttgtgattttctttttcttttcttttttttctttttctttttttttttgagatggagtctcgctctgttacccaggctggagtgcagtggtgcgatctcagctgactgtaacctccgcctcccaggttcaaaccattctcctgcctcaacctcccgagtagctgggactacaggcgtgtgccaccacgtccagctaattttttgtatttttagtagagacggagtttcaccgtgttagccaggatggtctttatctcctgaccttgtgatccgcccatcttggcctcccaaagtgctggggttacaggcatgagccaccgcgcccagcctggtttgtgattttcaacaaattggtcaacttcatctaaattctaaaatatatttgtgtagaattgtttgtattattatcttaccaaccttttggtgtcttcagcatctgcagtgatattccctgtttcattttttacattggtaatttgtacctttttttctttgtcacacttgctagaggtttgtcaattttattgatcctttcaaagatctagctctttgtttttattgatttttctttattgtttttctgttttaaatttcattgatttctgctcttagacacaggtcttttgggaactcaccatctaacagcaaaaacttgtgtaacaaataattataattgtataatcttatttacttgaaatggccagaaaaagaaaatctatagacacagaaagtagattagtggttatccggagttggaggtggatatgggcattaactgtaaatagagcctgagggattttattaaagagaagaaaatattttaaaacttgattatggtgatggttgcacattttggtaaatttactaagagtgattgaattgtacacttgaaatgggtgaattttatgatgtgtagtttgtacatcaatgaagctggaaaaacaaataataaggatataatatgaataaatgcaacagtaaaacgatgtagttgtcttagccccctctaactgccaaggaaacagaggactagttattatagggttagcatatgaatctagtcctattgtgccaagattagtcatcagctgaggcaataataagagacatagaggtatatgccaggaaatagatatccttcctacaagtggaggttattcctctttcagaatggtcctcacccagtggcgcagagattaccctgagtggtgattccacacacatactgctagctgtacaagccagttagcctctggcagacgctttggcttgatcagcgttcttagtttcaagcaacaaataccaattctgagtgattgaggtgggaaagaaattggacagctcacagaatcttgtgaaggttgagaacaaaactcaaagctctgtagccaggaatgttgcccaaaaccatgctgtagattcagtccagtgagaagactgctttaactaatgctactgagtgtcctggactctgccccttcctctccaccactactgctctgggagatcaatttgcccacgactgtggctgttgcaagacagagaactcactactatcctagcttttatgtgactagctccttactcaaattcctatgcaggttttttgattggtggggtgtaggccacacaactacatccaggctgtgtgggaggctggtaaagtgagtatttgataccttctatcagcttccatagtgtgaaccaggctgaacttttcctcaagactcatatgttggttaattccctagacgcagagagtgagttccgatattggaccgtaaatacacacacacacacatatacacacacacacccctttccactgcagccttgctcaaactgtagtagtccacagaccagcaggtttggcaccaatgggaagcttgtcagaaatgcagaaactctggtcctgctctagattttcaaaatcagaatatgctttttaacatgcacctcagataatttgcatgtacacaaaagtttagaagtgctgctctactttatacaatatgtagtcctttttaattttcaaagatcagtcaccactactctctactgatccacagggttgctagagttaccaaataaaaatacaagactcccagttaaatttgattttcaaaataaacagcgaatcatttttttggtataagtatgttctgtattttatctggcaaccctacttatccacatacccctccccccatgattaacaaaatgaacaaaaagaaacagaaatagacaaaacagcctacaggaatgcatgcacaccagttttctattttggcataggagattataaacagcatgtcagcagaacatgtacactctatacactttcaagcacactgagttctgcataagcattccatgcctgaggtccctataatttgaagggtgagtcacttcctctattaactcttccataggttaaggtcgtttctgtttttcaaaaatatacctattaattgcaattacttttacttaatgaattttgaccaaaagtacttttatcccacagactttagtttcattccttcaaaacaggaataaactggatcttaaaataaatacagagagtatgtgtaaataaaatatgaaaaaatatgtgctggcttccctctggagaatgcttcagtttttcctaaagaaaagagttgtcatccatgtccaggagtcttagaaaaatagctttcaaatattctagctaggaaagaggcagattgcatgatgtatcaattagaattagaagtatcacgtgcaaaaattaaagaaaactttcagtactccaaaatacctgccaattgcctttattcataaggtggctcaattcaccctaatattttagctaatacaaatattgctaaccaaagcaaccaaataggtagttttgagtggttgggagagaatgactttctgtttacaattcttaagagtaaggaagtaattttctagatagcaacttcttgcacaggtgaacaagaaataagccaccttcaatgaagcctaccaacaaaaatctttcagtaatcatattctcataaagtcttatcctcttgactgatgatgaaatgtccaggaattgtcagagggattatagtttcaagaagcagaatatccttaggggctaatgagtatcagggattaaatatatacatatcctccctcaccacaaagaggttttatttcatgtctgttaccatcttttaattcattgtttgtaagccccattttagaggc

SEQ ID NO: 7455 - DNA, 1196 bp, artificial
  synthetic oligonucleotide
actggaagcgtttaacagggggcagaacagacttcttaaagtttcatatgcaaagaaatcatctggacatagtgttaaaatggagattcttatttaaatagagtctggctgaggcctgagagtctacatttttagcaaggtccaggtgatattgatgttgccagttgagtgcacttgagtagcaggaggctagatgattccttagggggatgctggagaagctatgtgataattcatcagatggagcaatgagatagatctctgcggcctactgcgggagccactcaccacatgtggttattgagcatttgaaatgtggctagtccaaattgagatgtgctgtgaatgtaaaatacacaaaaatgtagtatggaatagactaaaatatttacttagtaatttttatattgattacatgctgaagtgatatttttggatgtattgggctaaacacaatattcagaatatatatacatatatatatatgtatatatatattatttttgagggggagtcttgctctgtcgcctgggctggagttcagtggcatgatcttggctcactgcaacctctgcctcccgggttcaagccattctcctgcctcagcctcccaagtagctgggattacaggcacccaccaccacacctggctaactttttttttaatttttagtagagatggattttcacaatgttggccaggctagtcttgaacaactaactcaagtgatctgcccgccttggccttccaaagttctgggattacaggcatgagccaaagaatattaatattgggatcgcttgagcccagaagtttgagaccagcctgggcaacatagggagacaccgtttctacaaaataaaaaataaaagcctagtcgagtatggtggtgcatggctatggtctcagccactcaggaggctgaggtagagacttactcggacccaggaggttgatgctgcagtgagccatgatagtgccattgctctccagcctgggtgacagagatagaccctgtctcaaaaaaaaaaaaaaaaacaacaatgtttaaagggctattaatggaaggagatcaagcagaatctagagggtgacacagggttagaagattttctttttgtggtaacctgggaagaatatgaagctgataggaaagataaatggagagggaaggtggctctccaggagcagcaag

SEQ ID NO: 7456 - DNA, 1291 bp, artificial
  synthetic oligonucleotide
ctcactttcctacttttgttttgaagcctttgccccaccccctccacgttgccgcctttttcgtactgagcgcgcagggcactacgcccaccactccccttgacccactcctcaagccctgataccggggcgaggccccttccttttctagtccttctacgcgccaggtgggtgggtttcgcggtgacgaggcgacacctctttcccctctggcgagcacgttaactggggaagctaccaaattctcacgccttagctgccctgcctccacctcccgcaagtccggttgcccctctaggcttctgcgcctgcagtggttccgaccctcgcctttagaactctgccgcttccgcctcttatttcgcgcctttgtttttagttttggaaggggcggagttgaaatggctgcgccgcggttgccgaagcaacgctttggttacttccgttggtttcaatgcttccgggttggcgctgcagtggcgtttccgactgtgggagcctcagcttcccagtcgtccgatgagcccgagcaggtgagggggagctcctggacttccaggctggggagcggggctgggccgcgccaggccgcgcggggccgggctggcctggttcccggcctgggaggggcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttgcaacggcggccgtgattgtaagcggagtaagcaaacacctccattgtattagtgtaagggatactgttgaaagatgctccccttcggtttctaccccctgtcactcctgaggtcaaggcattgaaggcatctattaaaatgcagttcagttacttgattggcatgacagctgttatcaacatgaattagtttctcagacaggataacagcagggacatttatggtttcctgtcagtgattccttgttgttgttgtttttccccccagcctagagatgcctagcgttatcatgaactcttccctcgtcttcattccctacatcatcgagttctttgtgtcttcattggggaagtctatctctaacctcagtgccaacaagcatctttgtctgctgtactttgcaccat

SEQ ID NO: 7457 - DNA, 1971 bp, artificial
  synthetic oligonucleotide
aaatgggtcaactgactgtttagtccagggtgtttaaagaagaggaagagaactgacatttttgagcactaacaatgtgctgtagtttactagatatttacatatacattatctgagttaatcttcaatataaccatgtaaagtaggcattattaccccggtttgatgaatgcgagatctagtttgagaatttaaatgactgaattatcatttgaacactggtctgttggatttcaagacctgtgatttttccattgcacatactgactcccaggggtagcagagtttcttagattgaacctaataacacactgatcacctggcctctcctcccctcctgcttttctgtacttaaaaatatatatattttttatttttaattgacaaataattgtatatattacgtggggtacaatgtgatgttgatatatgtttaaaatgtggaatgattaaatcaggctaatttacttttttttttctaaaaggaccttggcttcagaattaactttaattttcattccactttgcttatattatcttggcaagatcagtcctttgtagcaaggccaggatttaagctttgaaccaccagtaaggagggcattggtttgagcctgctttcaattttgtccaaaatccagttattcgtattttacctagttcccagtaactcacaatacaatccaagaatgtgccttattgctggcctggtacttgctggatgctcagcatttcaaggcatattgggttccatcgtccacttgagagtcaaaaagttcttcagttgtaggaacacgatgcttgctatggtgaaagcaagcatgtttctcctctgggccagactggtaagcaaagcgactgcaaaaaatttaccaaaagtgggttgatgtgtatgtagtagaatagatcaatgagaaacagccatttgggctgaagaagatatagggtgaaggtagggagaaggaaattttctcaagagtagggaaactgaaaaggatgatcattatcctctgaatgactgaggaaagtaagctgggagttaatctaagactaaggggaattaagaaaatccgagtgcaaagcatagtggtgtggtgacatcctttgaaaggagggtggctggattccatccaggtctaaacattataatttgtgattagaatgaaaaatttcaagggcctcttggaattagccattacacgttggattcaaatgcatcctcaggtcattaatttagggatattgagggattaaccaacctaaggttggtacctaatttggtacctaattcagtaccaaatcctaggcaagttaatccatactgttttggtttcttcttgccctcttttgttgtcaacttggcagctttctggggcaatattacagtttaaggtcttgagagccaaactctctagcaatccactgtggagaccaggaggttttggagagggttacagggaaactcagaaaggcagagagtggttcctgagtgtcttcgctattctgttcttggttttttgctgccaggttgcccagagggaaactgagcatagttcccatctgccaaccttgtcattttctgtaccccacggaaaggaggatgaggcacctgctcctcagctggtctcctgtgcaacagtttcttaggaaaatgcaaaattgggagtaagtggaaggagccctgaggagcaaagtggctccagtctggagagcttggctgtgcctgccttggtacccacatgttttctctctcttccctcccagtgcctcagaatttgtgatccagcattgtcatcagcaagtagccacaagtgacatatgaggccatcttaagggaaggggcagcagagagttaaaaggtggtggattgggaccggtaacagcagaaataatcacaagatagtgtttctttgggaaataacctattttaaacatcatgaggtgtgcgaaaagacaagctttagaggaatt

SEQ ID NO: 7458 - DNA, 415 bp, artificial
  synthetic oligonucleotide
gatgtccatatcctaatccctggagcctatgaatatatgaccttacttggcaaaagctagtttgcagatgtgattaagttgaggatcttgagatggagagattatcctggatttttcctgtgaacccagtgatatcatccctgtgagcccagtgttataagggcccttaaaacagggagtcaggagatcagagtgggcagttttggagatgtgatgacagatgccagtggttggagtgatgcaaggaagggatcacatgccaaggattcaagaggcctctggaagtcagaaaaggcaaggcaaggaatcctgtcctagagcctccagaaggaatcagccctgccaacactctgactttagcccagtgaaactgatttcagacttctgacctcgagaactggaagataatagattt

SEQ ID NO: 7459 - DNA, 308 bp, artificial; identical to SEQ ID NO: 6322
  synthetic oligonucleotide

SEQ ID NO: 7460 - DNA, 1882 bp, artificial
  synthetic oligonucleotide
tctgtctctatttttctgtgttttttttttggactccacctttcatcatctgtttgccattgcaaaattgtacttggttaatttcttatgggctcccctctctcactctaatattccctttcttttaaaaaaaatctgttttccctactgactcatcggttataaatgtcttccctccttcctaagttcctctcttcccctttctccctttctctctcactttacttcactctttccatctttttgcactaatttttgtattggctcatttcagaacttatttcattctctttctgtcttgcatttattattttttgcagtggcatttcttattgactcttccttgttaaacatctaagtttttctctcttcatcgctttctttccttctctttttcatattctttcttaattgctccccccactgttttttacatatttatctctatagctctcttgaatatcttttattgttggcaccttcttttacatttttcctttttctccttctcttctttgtaaagtcttcttataggtttctcattttaaaactcttctctcttttttgttctgtcaatatctgtctctctttccttttctacttctttatatctttttttcttatattttttggtatactttattcttctggctccttttgtaacaatagagggaggcttagcatgactgactccatttttgcatctgactccctgtggtaatttcctttaggttaaaagcttctgctcagctctgcatgtatgcctgctaattgtaggaggaatttagcttatagttctatgtcacggcatgttagaagatagtacaacaggccaggtgcagtggctcacgcctgtaatcccagcactttgggaggccaaggagggcctgtgccaggcctcactctctctttactttgcttgcctgcatgcctgcctgccttacttccttcctcccttcctccaataggtcttttttttatttgtttttataggcttcttttaaaactgttttctctacttctccatctctttctctctccttccttttttttgtcctgtcttttttactggattttcttttttaatgtcatcttacttgcctactctctctttgtctctttatctctgtctctctctcttcccaaccttctttacttattccatggtttctttctatattttcttgtactgcctttttttttattggctcttccttttaaaagtctgttcatattttctatctatacatctatcatttaacattactgtcttctttttaagtctctctttttccttactgagctattcttattgatttacccctttaatcttccattttctttgtgctttctctccttttctatttcccctctttttatttcactttttcttattcattttttttgttttagttctatatattttcttgtactggctttcttactgcttccttcttattttatttttctccgattttcttcttcctcccatatccttttcttttattcagtctgtcttcatcatactgcctcttcttactgctttctccttttgaaagtgtattctggccggacgcagtggcccatgcctgtaatcccagcactttgggaggccgaggtgggcagatcacctgagctcaggagtttgagaccaccctggccaacatggtgaaaccccttctctactaaaaacacacaacaaattagctgggcgtggttgcatgtgcctgtagtcccagctacttgggaggctgaggcaggagaatcgcttgaacccaggaagtggaggttgcagtgagctgagattgcaccactgcactccagcctgggtaacagagtgagactccatctaaaaaaaaccaaaaaagtgtattctacctac

SEQ ID NO: 7461 - DNA, 2996 bp, artificial
  synthetic oligonucleotide
tatactgggaacagaaagtattttaggccagattaaaaagtatatatcagggagggattggggagggtggtggcagtgaggcccagatggaggatcatgacctggaaagccaggataaggagtttgtccttagtttagccgacattagggagccactgaagatttttgatggtaagaatgataaatttatttcctaagatagctctgatggcagaacaggtggccaatgcttttttaaacaaacaaacaaacaaacaaacagtagttgaggagaggtcaggagagggaacatgaagaaaaaagtcacactagttggtgatcaggatgcattgaagaccaccctaaagaatccatttggtagaagggtggagttagaggccagatttcaaagatttaaaggaatgagtgtggtagtggagggaaggaaagcaagcttcagcaacttgagaacccagaggcctgaaggaaaagcttgtggagtctagagcatcactgaagtcagagaggaaggggcctgcagagggaggcactagaaatgagggagggactggccaattcatataaagagatgacagaggaggaggctgagaggggaattagtggaagggtttttcttagaaaggaggattttttttttttcagagataggactgaaggaagagagactaaaggaaatgtattaaggaagagaatgagccacgagaaaaggaaagagtagcaaaatcttatttgggtctacatatagagccttgctgtcttggcagaatgctcaatgctcagaacacccttctgaaagcttgcccgccatccgggcttcctccacaagattcaaggtctcattgattctcttcagcttcagtcagagacaatctgacagctgcagttggctcagcccttcttgcagcaagctgacaccatttctggtgggcttcaaaggcagtataaatggttctcccttaagagcaggttacactcggcacctaggcagcctcattacacaactaattaaacctctatcacttgaaaggaatcaatggcagttcaagatctgcttgagtagactttgcatttccgtgttcacacatagcagtcctacagtcaaggagttcccaaccactgcaaggggaagatgtaaacaagaccttagaaatagattgtttcatttcctataagggggtgtcccagaagatcttactcattagacagtaggcaagacccctttaaccttttgaaatagaagggagtttcgggcagctctttaaacggtgggaagctcaagctttctgctctggtgcatccatctggacaaaggcatgtcaacttctcagagtctgtccttcctggcagttccaaagggaggtccccgggtgttgagtgcagtaagctagagcctgggttttcccctacagaaaggctccagccctgttgtaaatacaactttcagaaactaatttaactggttccacttaaatgaactgggaaatgacccaatagaaggggacagagggacttgtgccagttctaccatcgcaacaggagcagccacaccagaccttttactttcagcaggagaatgttgactttctgaatgcaacacacttttccatctacttactgtgttatttaaataaattgctttgctcttgagggaccttatactctttggctcagtgagaagctggtagattggagtcagaaggggctgtcaatgtggaatctaatagagtttcagtgtgggaatattaggggtcagaagcaaccttacattagttatcacatcttgtcattagatgacatggatattattataaagaggaaatctacagggagcgtggagatgaaagccataaattggctagaagaagtaggagatttcaatgtgaaagcaagtgcttcaagatgtggactgcctgtggactgccaaactgccctatggactgcccaggctccctgctctactctcatctcatatcactttttactccttgaaatactgtcaagtttggattattcactgtcctcagatgacaagggttcagcgccaacagactaattttcacgccggcctaaacagacttaattagggaagctgttctgtggccaaaaatcacccagtgcattccaaagccagatctaacaggcttgtggattttcaattgtttgtcatcatctgtactactgctttccttctttcatgtaggacaaggcacacaggaacttactgttatcctggctttgccactgaccagctgtgtgaccttggctaactaacttaacttctctgaacctcagtgcctcttatgtaagccggagataataatggtactgaccgggcatggtggctcacgcctgtgatcccagcactttgggaggctgaggcgggtagatcacctgaggtcaggagctcgagacaagcctggctaacatggagaaaccccatctctactaaaaatacaaaaattggccaggcatggtggattagaagtcccagctttcgggaggctgtggcagaagaatcgcttgaacccaggaggtagaggttgcagtgagccgagatcgtgccattgcactccaggctgggtgacaaaaacgagactccgtctcaaaaaaaaaaaaaaaaaaaaagtacttaccactgaggactgttgtgcatgttcaatgaagtaatgcctttgggagtggttagcacaatgcctagcacacagaaagcactaagtgattatagttgtctaacgataacaataacagctgctgaaggcaaacatgtgcccggtgtggtggcttgcacctgtattcccatctacttgagagcctgaggcagaggatcccttgaggccagtggttcaagaccaacctggcaccatagtgataccagtgtgggcaatatagcggtacctcatctctacaaaatttttaaaaaataataaaaaataataaagcaaatatgtaatgaattggatgtgtgtgtttttgaggggtgattcgtttcatttgcc

SEQ ID NO: 7462 - DNA, 605 bp, artificial
  synthetic oligonucleotide
ctcaatttttctcatcacacacacacacacgcaatctcatttggtgcatctgttgttaattagctgtctctcatggctagtccttgggctcgctccttcctccaacaatccctctaaacctcaagatcacgtaaaatgaaatggaaaaaaaaaagatctgtgaatcatttctgtagaagactaatttttatcttcctccaccagtatgtagcatctcttttccttccttttgtccttccaatggtctcttttctgcattaacagaatcaggtctataggtctctccctccttctcccccctctccctttttctttccttctctccctctccttcccttaacatctctaaatgtaaacttgttagcaaggtagagtgtaaagagcccaggctcagaagtcgggtagtaccagctgccatttactggctgtgtgaacctgggcaaattatcttaactctctgagcctaaggctttttgtctgtgagatgggaatcactgtgcatatggtatttttgtactttgcagtacgttgtttggaggaataaattatacatatcgaagtgttaggctcagagtgagcacttgataaatgctggttattgtttt

SEQ ID NO: 7463 - DNA, 1046 bp, artificial
  synthetic oligonucleotide
ggggaccatgaatcactcatgattttcagtaatctttataacaaacttccaatggcgttaaattcagtttttacatgtatgaagtctcactctgtgaagaaaaaaaaggctgtaaatacaatgctttcaaatgaaagtagtgattagtaattgactgtcatcaactttgttttgctctatggattacttcagctagaatttctggtgctgcagaaaactagttgagaaaataacaaccctttatgagcgatttcaggttttcttaccattttgcaatcttctgctttaatttgttttccattagtacatgctcaagtgtagcttaaagaaagagcactaagctggaagtgggagactgaaagtgttccagctctgccatcgtctcactctgtgactatgggcaggtcattttccttctctgcctcagtttcctgatctgtaaaaggaggggattaaacaggatagccttgaagggtccctccagctttgacgttttgccattgcaatcaaatatgccattttgatggattttttttaaaacaaaagatggaatttgtaacactggcattagctgttttttgttcttcttctttcttttctctcaataataagccttagaggtgggatttcaaaattagaatttcctacaagctgcagccataatgatagaaccatcacaggagtactattagagttaatattcttatctgtatatatctagagaagcaaataacgtttgaaaatcttttcgctgtttctctctgggttctttattcaaaggtgtttatgtaactaatgtgtcttagtggtaagaaaagtggaaatgccatgagtgaaagaaaataaagccccctcattttatctttgtcccagtctgtctttgtgattgtttctcggctaaccacctgtgttttactgctcagggagctcagcatatatcgctggcactcattcactgctaatagcagctgctaatagccttccatctcctgtcagggctgtcacagttgatttttttttttttaacatatctatgagttccatca

SEQ ID NO: 7464 - DNA, 3208 bp, artificial
  synthetic oligonucleotide
ggatctacataaagaaaggaagagcatcaaagaatgaaaaagtgaatgtaaaataaaaacttttggctgggcgcagtggctcatgcctgtaatcccagcactttgggaggctgaggtgggcagatcatgaggtcaggagttcgagaccagcctggccaacatggtgaaaccccgtctctactaaaaatacaaaaattagctgggcgttgtggcaggtgcctgtaatcccagctactcaggaggctgaggcaggataatcgtttgaatctgggaggtggaggttgcagtgagctgagattgtgccattgcactccatcctgggcaacaagagtgaaactccatctccaaaaaaaaaaaaaaaaaaaaaaagagagaattatgctaaatctactcttcctgtgctttagaaacggaacaacaaagtctgggtgacagcacatctgtttacagtatggtttaccaaatatcttaggcccactgttgagacctactactcagaaaagaatattcctttcaaaatattactgctgttgacaatgcacctagtcacccaagaatattgatggagaagtacaaggagacaaatgttgtcttcacacctattaacacaacatccataccgtagcctgtggatcaagaagtcattctgactttcaagtcttattattttaaaaaatcatttcataaggctatagttgccatagatagtggttcctctgatggatctgtgtaaagtagattggaaaccttctggaaaggattcatgatgccattaagaatgttcatgattctggggaggaggtcaaagtatcaacattaacaggagtttgggagttgacttcaattctcactgatgaatttcaggagttcaagacttcagtggaggaagtaatggcagatgtggagggaatagcaagacatctagaattagaagtggagcctaaagatatggattgaattgctggagcctcctgataaaagtttaatgaacaaggagttgcttcctatggatgagcaaagaaaatggtttcttgagatggaatctattcctgatgaagatgctgtgaacattgttgaaatgacaaaaaaggatttagaatatttcataaattcagttgataaagcagttatggggtttgagaggactgacttcgattttgaaaaaagttctactgtgggtaaaatgctatcaaacagcattacatactacagataaatctttaatgaaaagaagagtcaattgatatagtatacattattgtcttacttgaagaaattgccacagtcacatcaaccttcagcaacctccaacctgatcagtcagaagccatccacataaaggcaaaattctcccccagcaaaaaagattacaacttgctgaaggctcagatgatagttaacacattttttttagcaatacagtcttttaaaattaaggtatgtaaattgttttttaggcatttgcttaaaagactacagtataatgtagacttaacttttatatgaactgggaaaccaaataattcatatagagtgctttattgcaatattagctttattgcagcggtctgaaatggaacctgtaatatctgtgaggtgaggtgaggtattcctgtatgcatttatgtatgcttatggacaagttaaataaatgacagcaatgatacaagaaatggaaggggagaatcaggagcattttgctattataagatacttgcagtacccatgaaatggtatagtgttatttgaaagtggggttgaattaattgtaaatgtatataatctagggaaaccattaaaaaatgtgaaaaaaagtataaatgatatgataaaggagaaaaatgtggaataatataatatgttcaattaaaaatacaaaaggcagaacaatggagaagacaaaagaaacaaaaaacaagggtaaccaaaagaaaacagcaacaaacatggtagatatttatccaactatatcaataatcagttaaaaaattattgatctaagtatgccaattaaaagacagatgtcagtgtggattaaaaaataagacccaaccataggttgcctacaagaaatctgctttaaatataagggtgcatatagataaaaaggaaaaagatggagaaagatataccattttaacactaattaaaagaaagtggaagtggctatattaatttcagacagagctgatttcagagcaatgaaatttatcagggagtaagaggagcattgcatactattgaaggggttaatactccaagaagacataccaatactgtttgtgagcctaataacagagcattagaatacacaagtgaataactgatacgactgcaaggagaaatacatgaatctactattacagttggagagtttagctcccttctatcagaaatggacagatccagcaaacagaaatcagtaatgacacagttgaactcaacaccaccatcaaaccactgtatataattaccatgtatagactatttcatctaataaaagcagattacacattcttctcaagctcacatggaagtttaaccaagagagaccacattatgggccataaagcacaccttaaaaagtaaaagaagagaaattttacaatgtatgttctcagatcacagtggaactaaattagaaatcagtaacagaaagatagctggaaattccccaaatacatggaacttgaatagtatacttataagtaacacatagattaaaaaagaaatctcaagaaaaatttacaagtattttaaaataaatgaaaatgaaaatacaaattattaaaatttgtgaaatgcagtgaaagcagtacttacgtgggcaatttatagcatttaatccatctattagacataaagaaagttctaacactaataatctaagcttttaccttaggaaactaaaacaagaagaacaaattaaacaaatccaaagtaagcagacattttgtcagtttcttacaaaactaaacatactcttaccataccatccagcaatcatgctccttagcatttatccaaatgaactaaaaacttgtgtccacacaaaaatctgcacatggatgtttacagcagctttattcataattgctaaaagttggaagcaatcaagatgtccttcagtaagtgaatggataaataaactatggtacatccagacaatggaatattattcagtgctaaaaagaaatgagccatcaag

SEQ ID NO: 7465 - DNA, 980 bp, artificial
  synthetic oligonucleotide
aaaagtgaaaagttcagttgctcagttgcactaatcacatttcaagtgctcaatagttacatgtagctagtggctgctgttttggacagcatatttatataacatttcaatcatcccagaaacttctgctggacagtgctgctctagagtcagatctgcattcaaagccacatctgcaacttactaggtgtgccacttactaagtgtgccacttacaaggtgtataaaacaggtcacttgatctctctcagactgtttctgcattgtaaaatggggatgataatgccccccttacagcaaagtgaggaaaattaaataagagattgtatgtttaaggtgtagcacatgttggacactaaacaaatgtcaatgcccttctaacccaatggggggtttatataaatttgtctcaaaaatggaataagaacatttgagtagtgtggctccttcggcctccaggctacagtctatttacagcttggaagatgttagctttgcattcctcttctaacctactttttcttaataacacaaagccattaaagtaaatcatgaataaataatgcgggagtagtcagtgattgctctttgcttggattctgtttaggagaccatattcatcactaccttgaactgtccaacatgaaagaatcacattttcccctaacaatggaaatgtctcctcccaaatctttcaggaatgctctgttccatctgggtgctgtactatcagaacactgctagcagtgatactacagctggactagagagagtatcatttctctctaaatccatattttcgtacactcataatgttctctgtgttttttctgtggggctgacatctcccaggcctggtaaagggtgaattattcgagaaaagtctgaactaaatctgttaaggtgtttgtgttccgtgagcagaaaagcaaaatacatatttccaacttcaagaagaagaacacttcaggacttttttc

SEQ ID NO: 7466 - DNA, 2637 bp, artificial
  synthetic oligonucleotide
aaatagggtgttaggggtatgcatgcctgtaagcataaggaattccaaactttcagacattttctggcccaagaaatgatacagaactttgggtaacaataatggctaacattttttgagggtacagtacatgccagaaactgttctaggagctttacacacattgactcattcaatccttacaataaccctcttaaggtatatgctactatgacgcccatggcaatgatgaagcaactctggcattaaaaggtgaaatgacttactcaagattgcacagcttagaactggtggagctagaattcaaatttcagcagtctggcttcagagtctacatatttaacaaaaacattttattaatgagaaattggttgagatcaagaattgtcacaagaggaaaaagaaaataatcacagagttttagagttaagaagaaccttaaagattatttagtccaatcttcttatgttcctaatgagaaaagagaggcagagcaatattaagcaacttgcctaaggtcacatggcttgtaattagctgagcttgcatcacagcccaggccttctgacccctagtcatgtgctcattctattatatcatattatattctccctgatgcactcatgtaacaaaatgtgagttgaattcaattaaattgcctttctggacctgcacctgagctactaaacttgaatggggaaaaatgcacatagctgagcaaatgggcttcacgttcatttaaagcattcatgatcacaagcctcaactgagcactcatctctgctcaacaatgctacttctgtattaaacttgctttcccactctttaaagtgacaatatcttcattgttatcttcaatcctcctatattttcccccactccactccacttcctgccattaactaatgatatgcctcatacttcatggagaagaaaaaggtatcagaagaagtagctctttcatcttcctaccaccaaatctgcaaacctgtctatgtctctatctatattctgtgttgttaaaatggaacaagtgtcgctaaatcccatcctttcttgctgcttagactgcagatgttcctctttcttcttctgcatcatcatttctgtctttctactggaagttggccttggctcctactctttcaacattccatatattccaaccatcggttaaatcttatcttttgattataattctaaaatacatcttgaatctgtacatttttcatcaccattgctaacatcatccaagtcaccatgttctcttatctaggctcctgcagtaagtaaatagcctcctaactggctgtgtcatgcttccactcttgcccatctttaactcattctctgctgagcagctatctctagtacattttctgttgctataccagaataacacaaactgggtaatttataaagaaaagaagtttatttggcctatggttctgaaggctgggaagaccaatattaaggggctacatctggcaagggccttcatgctacatcataacacggctgaagggcagaagggcaagcaagcacacaaaacagagggaatgggggccaaacttctatctttttatcagaagtccactcctgcaataactaatccagtcctgtggcactaactcattcatgaggacagagccctcatgacctaatcatctcttacgggtaccatttcccaatactgttaacattggcaatgacctaatcatctcttacaggtcccatctcccaatactgttaacattggcaattaaattttaacatgagttttggaggagacattcaaaccacggttgcagtcaaagtagtcttttaaaaagtgtaaaacaattcattatcactcctgtgcttaaaatctttctatggattctcactgctcttagaataaaaatccaaacttgtttggacctataagcccagtatgatgtttacctctcccaacttcatctcatgctacattccctctcattcaactatactggccttccctgtgttcccgcaatacaaccactcatctcttgcctcagagacctgtgcttgctgttcctcaggctctttgcatgacaggtacttcctcaattatcaggtctcagcctaaaattcactttctcatagaaaccttttttccatgatatcaaagtaggtcctctcatatttttactcatccatagctatcttagcacttcctatagttgataagtattttatgcatatatttatgtatttccatgtttatttgtctgttgtaaagctcaatgagggcagcgacctttgtatatattttttcactgttgtttttacaatatctagcagagtatctagtaccaaaaaggtgctcaataaatttttgctgaactaaaaagttaattcctggattgctctgaataatatctgggacaatgctatttaataaggatactctaagtaggggaaaataattcttacttctttaggaaaagaatctggttgctttcatgatcccaaaccttttgccaacctttaatcagcaggttctaatctttttgtggtgatctctgtctgaattaaaaaaaaaaatctacaaaattaaaccagatgagggacaggaccctgaaggtgacagccgtttaatgctctctttgtcaa

SEQ ID NO: 7467 - DNA, 1088 bp, artificial
  synthetic oligonucleotide
accacccccttttagcaaaatgttggttatgctcaaatgctttgggattaggtgtgaggaaatcttgaattacatacctaaatataactccctaactggtgggccagataaacataagaaagacacatatgttttaataacgtcatctgaagtataagtattcatgtataatcacacacacacacacacacacacacacacacacacacacacacaaacagcactgaattttcttttcaccctagaatgaaagcaggtactaaactttcttgagtcttagcattgcacatttaaaataactgctttacatgttgatttggagttgcaactcatctgagatacggaggggattttccaaagtgcactggaatctgggcacacatgaaattgcaattactttccattccttttcttcaatttccccataattgctcttcctgatatatctctatcttctttgggggactatggaaaggggaccaacaaaacaggtagtctttcaaactgtgagaccagacagggtcgtttcattcaataaatatttattgagtacttgctaggtgccaggcactgttctaggagctggcatgacgagcccacacagaggttacacaggttcaaattagcttaagagagtaacaaggggggaagaatttctgatgtgtgaggctgtttttttgaatcaagcaatggaacagcaactgccataggctgtcagtagcaggtgaaatgtcaaatagggagtcttgtctttggggatgcctgactttagcttcccttctaatgccagcatagtacatctaaggattcagggaaaggatatccgaaaaatgaaggcgattttgctgccaactaagatgaatggaacactttctaaaggcagccctcaaaccattcttgccctgagccaggtttccactgttactttgatttacatcttgggtttaaggtccttctttaccttttactcctcatcactccaaagcagcaattagaggcagttcagggaaacaaattaactttattttataggaggaaacctcatagtaaacttctatcattcactaattcaacaaatgttcactgag

SEQ ID NO: 7468 - DNA, 4447 bp, artificial
  synthetic oligonucleotide
gtataacatatgatagccaggcagagatcaggggtcaggaaagctcacctgagtcactagactaatgaagtaggaagaaaccacaagagactacggaagatcaggttgagaaatcagggtctaacaaaggggtcagtctttgaaattaaaaactttatatgggaatacagactataggtgtgccctactttaagaaaatccactgtttccttatccaatccacaaaccagaaaagcaagagtgcttatgtgtattacagaagcactccatgtggcaatttttttttttttttttgagacgaagtttccttcttgttgcccaggctggagtgcaatggcatgatctcggctcaccgcaacctctgcctcccggattcaagcgattctcctgcctctgcctcctgagtagctgggattacaggcatgtgccaccacgcccgcctaattttgtatttttagtagagacggggtttttccatgttgatcaggctggtctcgaactcctgacctcaggtgatctgctcgcatcagcctcccaaagtgctgggattacaggcatgagccactgcgcccagccggcaatcttttacaatgctaagctaacattgtacatgcaagtaagatttgtttctacaaatatggaatttatatgttcagtttatcagaagcacattttcggtacaaagtgaggtatccatgtaccatcaaccttcatgtggacttgcttttgatttttcttttataaatctgaattttagcatactgtctccttaaaagttagaatgcctgtactgtgggaaataggcagagagaaaaaatccatacttcataagcagaaagctgaaactatgtccaaccagtccctattgaggaagtagagtttttcccacaaaagtgaatggggaaacattcttgaaacatcttaaagccctaaggccaaattcaggaggctgtaataaatgagaagtaggaagtccccagaaatctcctgaaaaggttgaattgtattatttatatttgtaacgaaatgtgttttcacgtttgtgttaaagatgaatctctggggtgagttcagcctgaggtaagcattgaggtctagtttaatggaggatgaagtgttttttttttttacactatatttaagcattggtcagatatacttaagacctatgaataaataaatataaataggattgctttaaggaactcctgagactgtctgtggttgtctattcatattaatatataagcataatttctagttgtgctactagtggcatccatctgtacattatatttctagaaaaatgttacaagtttgtaaaaatatattattctactgcatagagcacctagttattaatttcacttgtgattgatgttgccttgaatccaattataaaaaacaattaagctgctatattagcagagtggtatctattaggtgacctctaaggaaaaaaggccagatgacaaaggatccatagaaaaatcaggactaaaacctagacagttgtctattcttctgcctaacccagacacatatcataaagaagaatctatgtacatcaacagtataaaactttcactcagtaacagaacaaatttaaaccagctgttgtgaaactaatatctgcactcctacggtgaatgattaaagtcaataaatgtttgttgactgaccatgatacaaactattgttgtacattatataatgttcaatgattctattgtgttaaagataaaagtcactctaagtatgtaaatcctagttccagtattattctaggctaggagatcagctttcagtctaataacttcagacaagttttagttacagtctcatgaccacaaattatctaataaccccagtttcaaagctctctaaaaatagcctggtcatctactatctggaaaatgatgaaactggtcttggtttctccaaacctctagggtttttttgttgttgtttttgtttttgtttttgttttgagatggagtctcgctctgtcgcccaggctggagtgcagtggcgcgatctcggctcactgcacaaacccctaggttttaaaaataactgtacaataaatatgattacatatagttagaagatcttatgcatataaagagccatcgttcaatttatcaatgtcattaaataaagatgaacacctgaaaagattgaattacagattctcagtacataatgccaaaatctacaccacaataaatacactactcaagaaaaagtcatctatgagggaaaaaaaaagcagagagtaaaagaaaactgtgcaagtacccttaaatcaaatattgtaaatctagcatgaacttttaaaaagtggaggtcctatttttttaccaaatggagaatggatttctacctttgagttctaaactctctttgtaatacttttctctattaataaggtgctaataagacagaagtaaaatcaacccaaagcaaaaataaaccagaaaaacaaacaaaatctaattctatctggccacaaagccaattttctccctcccattgcactggcaacagcagtagcagcagtggctgatggcagcagacccttcctaaagcaatcttatatttgcaccagagagaacattctggccaaattggtcctagaagatgtgtctgcaagatgtaaaaaactgcaatcccagtgaaccaagattgtgccactgtactccagcctgggcgacagagtgagactgtcaaaaacaaaacaaagcaaaacaaaacaaacaaaaaaaaaccaaaaaaaaactgcaatcctaaatgatctctccttgaggaaagatgaaaatctttgtcagtaatattaggtaacctgggctggagaagatgtccaactgcaaaacagtgagtaggcaacaggtgaggaaaaggaaaaggaaaccaactaagcccaaagaaaccatagcaagaagctgaaagcactagttaaaatgaaactcgcatctgtagagaagcagtgagaaggataaatcaactaatggctcaattatacttttaaagccatcagtcaaacaaacaaaaaacccaactgaacttttaaaaccatttttagtacaacttatatttcacagttatttattttcttaatcttaacaataaacaactgttgttacataattaaagatacaaggtaaagggatttaagtggcagcttaagctagctagttaagttagttaagctgtaagttagaactacctatatatgttccagttttcacactcagtccatcccaaggactgtagtcagagactaaagacaagaaagatgtttgaagggatggtggggtggaggggagactatgagaatagaataaaaggattagagtgctttaatctggaaagataaacaatcaatcaagaataaccaccaccatacaaccatcaccattaagcacctactgtgtgacagtcactttgctaagtgccgagatattgaattatgtccaagaagagaagaagtgttgtcaaagtggattttaacattctttctttcagttatgctctctgtgtcaagcattgggctggtcatggaacagttgtgaagcaggaaacagcagaatgtcgtggaaagaaccccagattggaaattagaagatttaggttttagttctaagagcattattaactatatgtatgaccttgaacaaatcactcaacctttttaggcctatcttatgatagagatgttggacctgtcagcggattccaacttttttttagcagccaaccctttattcaaaagacaacttacaggaatatcctacacataaaagagctgaaagtagaaatcttatgcttgaagcacagggaaggtcataacaggctcataagccttctcctgggcctctccttctccctgaaccagtcttacatgcatctatacagatgccttcatggatcctgtgaacacagtttgaaaatctatgggctaaatcatctttaacaattccctctagatctaatatcctatgactgtgaaattttcctcacctacatcttcaatagcctttattcaattcagtccaacatgttgaatatctagaatcatagaaagcacatgacaggatttctaccatagaagagctcaccatctttttggggaaaacaaaataaataaaatgggaatgcacttgaggggaaggggggctttaagcagcaggacaccatcaagggcccattggaatagaaagtccacttctgtatcttttttatgagtgtatcatcagtgcctggggcaacagacattcaaataaacattgaataaataaataatgaatttatggatggatgggtgaagttattattaatcatgttcactgaaattcagcaaaaaggtataaagtactttccatattttatagaatttttttcttatatgtacagggttataagaaaagccatcaaatttctccat

SEQ ID NO: 7469 - DNA, 1405 bp, artificial
  synthetic oligonucleotide
tcatgggttagccctatggagaagcccgtgtggcaagggtctgaggtctgccaagaaccacccgagcttgaaagtggatcctctccccagttcagtcaagccttcggattcaaccacaggctcagttgcagcttaactgcaagctcacgagagaccttaaggcagaggaattcagctaaaccatttccagattcctgacacacaaaaactgtaagataatgcttgctgctttaatgtgctaagtttgagggtaatttgttacagggcagttgataactaatacaaagtccaagctcaaaacatagtcattgctatgtaagtagtttatgagggaatccatactgtttcctccagtaaaatcacctattttcctcttgtatccattatggctactcatgccaaaactgaaataaacaaatctactttaacaactaaattggacataatcttttggctgggcatggtagctcacacttgtaatcccagcactttgggaggccaaggtgggtggatcacttgaggccaggagtttgagaccagcctggccaacatgtgaaaccccatttctactaaaatacaaaagaaatccaggcatggtggtgtgtgcctataatcccagctacttgggagactgaggcacgagaattgcttgaacacgggaggcagaggttgcaatgagccgagatcatgccactgcactccagcctgggtgacaaagcaagactctgccttgaaaaacaacaacaaaaattggacacagatttttttttttttttttttgaaattaacgaatacactggtcttctgaaaaaacttgcaactaaaatttatgagccaataccaaaataagtttaaacaaaaatcagatttcttaatgactgtgattataactatttaaattctaaagtagttattcattttgaggccaatactgtttgcaccatacatccgcagcaaaagaatatatccgattcagatgaagagcacaaactaaagactagaaggtaaggctaccagcagggtcttggtctgtagaattatgcaaacagacatatcatctgcctccctctggctgcctcatatgtgaatcagcaaggctaaacgatctacctccatcttcactgtgcatttcaacaacactgtgctggcttccaataatactgcctgataagcaaatagagagaatcaatatgtttacagaggtttgtatctgaagatgttgctcattagttatttttcttcaatatgcttatatttaaaagttttgcacaaaactttcagcatcactagctaattatactcatttattgattcactaccatgtgccaagtacaattctacacacttaggaaacatcattgagtaaaatatacagagatcatttaagagagctttcacagagctt

SEQ ID NO: 7470 - DNA, 1336 bp, artificial
  synthetic oligonucleotide
agaagaaaagccaaagcaccccaaacccccactataccctatccctaacccacccaccccattgaggaaaaagaaaaatagctataattcagcttagatctgacgcttctgtttagctcagctccagccgagcaactgagcttcagcaacggagcatagggaggaggattctgatgccagtagcacttccatccacttcacttacacaaaagcaggcagtggaaaatccaggagccttgaagacaagggctggaactggcttttatgaattgctattactgcatgtgtcaccatccatctccaatgacggacacttataggctgaattgggagtggagggggtggggtggaggaggttggagagcaggtggagaagcaattagcagtatgttcattggagaattcgttcgggatttcatacatcagtgcctaaagaaacagcatgcagttgacaaatcagaactttacgatttgcatgccttggaagaaatcttagctcacagctccaaacaaaataatgtttgcccactcttacagggcacagaaagtcacccctttgctttttctttcctctggctacccttattcctgagaaatcaacattcagaatgaatatttgctaattttccctaaagaattgtatttttaaaaggctggaagcaaaggaagtataaagaaattaaattctattgaacatgacatctcttaacacaaaggcaagaagctaattattttaaggcaattcttcatccctagtcccattccccaagcgcagctttcacacctataatcagtggatcacacaacttttgtccatatatttaacactgaaaaacaaatctatgtctacctaaaaatagttcagttaaaatgaaggtgaaaagccaagagctatgtgcaggacccacttcattaggtgacttgagaaagcactttacatgtaagtgcttcagttttactcatccactaaactaaagctcatttttagacggattttaaaattaatcacgagtaggaacaaaaaggagatagtgtctttgggaggaaacatgatacaaccgaaggagcactggggctgggtatcaggaaacctgggttcagcttccagttctacaactttctaactatgtgactctggccaagtcacttaacttctttgagcctaagttccctttatttgttaactggagataatagtacctatcctgactgtctcacaggattgctgtgaacagctaatgagataataggtatgaaaacccttttgtaaattgtaaagggttatacaattgtatgggattattactaccatgccctaaacaaatcttgccttaat

SEQ ID NO: 7471 - DNA, 1318 bp, artificial
  synthetic oligonucleotide
gtgaaaattagaatggtatgtgaccagagtaatcctagtgaagtatgtttgaggacctgactgaagaaaagctgataggaggacaccttatgggggcttattgtggggcagtttctatcccaggaaactcttattagcagttgttgctggctaaaaatgaagagcagctggagcagatgacaagggcccttactggggatttctccatccttatctttcatagttcaccactaaagcaatgttgttctctgaagtaacattttccatagtgtctcaattctcctgaatgattgccatattcatttgtgctctgcctaccgaggcatttggaccagctttgttaaagtgtggtcactgaaagctctttgattcttctactcacctatcgttattatgctaaagaacaacattttgtgagtaagagaccactgaaaaacagagcaccagaaaggggagggaagcagagctaataaaaattatcttttttctcctcctagattgccaatgtatttcaccatgtttccatcctacagtgttttatactatgtatcagtaaaggcaaaaaaaggaaaattaagacttcagcaaaactttacactttgtaggcaagaaaaaaaggaagcaacactgagggatagaacataaatctttagacatatgatcagtagccatttctgaaaagtacacatttgggctgttttaaacaaatagcaaaaagcaattaggtctttctgactaaactgaggtgtatgctgatttctttttttaaactaagtctgttttgatcttcaaaaatgtcagactggtaaacactttacttttttgcacatataaatctaagagccaagcctagcttgaggaagatttaagagacataaaatttgtctgaggtgtctgccaaatctctacagcagagacagaaaccctggaaaagctgacacaatcataactctcacatcaccagcaggcttgtgcagggctgggaagcacagaaagtcactgttccttctctcatactgtttgtaaacagagaagcagatcatttgcttatcagctatctggtagctcatttttgcctagctatcccactgagaaaaaaaaaacaaaaaaacacacatccccacgggtacatatcccagttttcagctgggtgaattttcatttataagatgggcccgcttgttaaaattttctcttttatttgctcttgaattctcttactcttgtgtgcttgcttgctctctctctcccttgttctttctctttttatacagaaggcattaaaaggggtatttatgagtatctagtgcagtgccta

SEQ ID NO: 7472 - DNA, 201 bp, artificial
  synthetic oligonucleotide
agacattattttaaaaggataattataggtcaatatctgtcctgaacataaatgcaaaagacctaaaatttttagcaaattgtatctagcaatatgtagaatactgtactatattataaatacatagtaaaatttattgtagtaggagcagtgtttcagtatttaggaatttagggtttaaggcaactttatagagcataa

SEQ ID NO: 7473 - DNA, 907 bp, artificial
  synthetic oligonucleotide
taggttattcagtctctaaagagagtactttaataggaacagtgtcacgcaacaagcctgggaacatagcaaccagggcacaaagaaaaagtgtcaattccaagttatgggcagttactggcttaaagagaaaattgctcaaatagtgaaagcaacatttcaatactgagctgtttgtggcaaaaaggaattgcatactcaaaccaaaagtgtgttaaattaatacaatgggggaaaattacaaccattgaaagagactgataccttggtttattagggaaaaaaaaatatgctttggtaggatgattgctgcttgtagaactgccaaattggggactgaatgaaaaacactcaggtataatatagctacctcagagtcttttaattccacataccaaggtagatattaataataatatatattttttaattcagaagatgttttcccacatagctgtggacaacacaaggcaattgttagaggaaatttgatgaagttgtcctgacattgttctctcagtgggtttcccctctattatttcatttcatctttacaactacctttacagctatggtgttattattttctctatttgagatgtgagaatgttcagaggtgtgaaatgacttatccaagatcacttaggtgtccagtgaaaatagctgccattcctagcccagtgttttttccatgacatcagaaatagtacagtaacaatcaagtaaggcctaatcaagtcgtctagtcaaattttgaacatactcaacccataaaaattcttgtgctaactctaagttcagcagttccctaaagggtctagggatagagcagagaagagagggctgataataatcatgtaaaccaacacgataatttagcagctgagatacttatctattgttgcat

SEQ ID NO: 7474 - DNA, 313 bp, artificial
  synthetic oligonucleotide
tgctgtttctgtcccaccaccgaagagatatgaaaatcctggttcaatggcccatggagatcccaacctaaggctacttccttcctaatgacagcatatctgaactgcaaagtaccatggaacatgtatgttattatacttctagaaagctggcttgggaataccaaagtgggattctaacctaggttttcctgacctctaatctcattattttgaacctttagactagctccacttttcacactgggagccctgataggacacaagtgggtactgggagataaacctgggctatggtcagagtttttgcaca

SEQ ID NO: 7475 - DNA, 5799 bp, artificial
  synthetic oligonucleotide
tcattccattaaggagatgagagttctattaattggaaagaaagtttcaaaggcaggcaggtcagcaaccaaggcccatggctaagcactactctctgggtaggataaatgggggcattctccaggctttgtggtagaggttggagagcaagaaggcagctgagctcaaatggagagcaccagcctggcaaatacaattagaaccagtcagggctgcccttacccactcctcatccctgccacttcaaactccttcacatcgacagaattccatgtcctgttttcaaaccccagcccattccccattactttctgaatttgtcctccctgcttatgttataattccctgatgctgtggaacatttcaagcatgatagaaggctctctcgtgccttttcccagttaatattcctccaagaggtaaccactaatccagaatcatctggaaggcttgttgcacggatgactgagccccaccttcagagattctcattaaatagatctggatgcagctcaagaatctgcatttataacaagttctgaagtgctgctgttgctttgagatgcactgtgctagtctgacttctatcagcaatgttcagcttgcttgttcttcaatgtactctttcatgtctgccttcttttattcatccctacgtctgtaaaattcatccatgttgttgaatgagccagtagtttattttttactgtatttgtagcatttcattgtatgaacatatggcattttatttatcattccactgctgagtggacatttgagtgatttctaattagggactattatgtatgatgttgttgctatgaacattctttctttgtcctttttagaaggtttatttttatttttattttattttaattttaagttcctggatacatgtgcagaaggtgcaggtttgttacataggtaaacgtataccatggtagttttctgtacctatcaacccatcacctaggtattaagtttcgcatgcattagctatttattctgatgctctccctccccgcaccccctgacagtctccagtgtatgccagtgtgtgttgttctcctccctgtgtccatgtgttctcattggctataaacactcttgtacatgtttttaggtgggcatatgcacttatttctcaatatacctaagtatagaattgcttgatcataggttaggttagatcaagtatgtattttactttgttagatactgtcaaacaattttctaaagtgattgttcctatttgtacgcctaccaggagagtatatgaattcttggtgctccttatccttcccaacacttgtactgatatcttttaaaagaatttagccatttttggatgtgtgtgtgtgtgtgtgtgtgttcatggttttaatttgcatttaggatttaactagatttcatagtgtaaaattgtttgtagtgatggaaatgtccagtacagggccttcaaacaagtgacagctggtatggacactgcacataccagctcagatggtatggaggagcactggatgaagaaaggatggggaaatgctcaagggaaaatccaagcttcttcacttttttggttcactattctcccttgtataaacaaggcaattctccccttggaatggagttgaggcctcaaagttggcttttgagcttgggaatactgagactgttaatgccaatcctccagatggaaatgaacttggtatattggaggtatagaagaagggtaatatggtttaaatgtaagaataaaaggggaggatatagataatatcagagagatcagcagggaccatcttttagagggtcttgtaggttttgggaaagagctaggagctcattccaagcacaatgagaatccagcaaagggtttttgaagggagagtgacagaacatgatttatattttgaaaatatcactgtgtttaatgtgtagggcaatggttctcatccttggctgcaccttggacttatctggagagctttaaaaaataccgattccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgacatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgttggattcggtttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagagttgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcatcctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggttgggggcggggggagggatagtattgggagatatacctaatgctagatgacgcattagtgggtgcagcgcaccagcatggcacatgtatacatatgtaactaacctgcacaatgtgcacatgtaccctaaaacttagagtataataaaaaaaataaaataaaataaaataaaaataaatgaaaaaaaaagaaaaaaaaaaataccgattcctgagtttcacctccttagattctgattcaattggcctggagaacagcccaggaatttcaagttaagacagagagaagtggacatatttgagacatattttggatgtgagacatactgggtttggggagtctctgtggactatagggagagaaaggggtaaaagaagtgacccagcatcttacttgggacttttaacagatggtggtgccattcactacaatggggagcactgagggaagaggagcagattgggggtgg

SEQ ID NO: 7476 - DNA, 1449 bp, artificial
  synthetic oligonucleotide
ggatggaggaatacagggagggaagggcaaacagccccttagttagggaaacctagggctctggagctagccttgcatctttgtttaaggtgtgggttgtcccaggattgagttataatggagaaagacctatttgcattgacaaatggcacttaatgaagggaatgattaaaagcgagggaagctacaggctcagaaatgtcagcggttgttgtacaagagaattcttttattgcactttcctctcccccttctccctcgtcctttttcttccctcccgctattgctcatcttccttcttctcctctgccctcctcctgcttgctccatccacctccacccacagcaactgatgtgatttctcatgatctacagtcaaatgccattaatcccgacagactcacgagggtccagctaagctgtcccatgaaccaatcctgtgagaagacagaccagggtacgcaacgggcaggcagcccccccaccccgccccctcacgagtaatggcagataaaccaataaaccagagtggctgcccctaaaataatcaataaatcacttggggtccaagagaggtggaaagctccccagcaaacagtgctcaggatattttccattaccttctctgccttgaatgtccatggcacgctagccgcgtgggccaggactgactctgctctcaaggtgccgctcccagattccgcctggccctctcagtttcagagggaggtaattcattccagtgggatgtgacaggtgccatcttcaggcgcccggctctgctcccagcagcagggactgtcactgactgcaaatcccccaagtgccacgctggtctgaagaaagcaagccctggggtgggcagatgacctttcaagaacccaggaagccaaagtgggatagcagcatgatgtaatggaccgagccctggactaggatgctggacacctggcttttagtcccttttcagccactaacttgctagatgatgttgggtaagtcactttccctttctggatctcagtgtccccttcccaccagcccccgtgatgtgaagaggttggactagattatctctaatggcactttcaaccctgataagcaagttttgaaattaaagaaaaaattatttttggaaaattgccagctctaattagaatttgtttaaggactcctctcaggctctaatttaagctgctttaccatcaaatccttcaccctaaactcccatgcagtacaggcagccacttaccagcacccaagctccatctaagacatcacaaccactcacaggtgtagccttcccctcctgcagagctagttctgtgtttggggctgggtcatcctgatagggtcctgaggtagagccccatgagatgcatgcaccactaacactcagattttagcgtagaccagtggggtggctgcctgggaggagattctccttaa

SEQ ID NO: 7477 - DNA, 1914 bp, artificial
  synthetic oligonucleotide
agctactcggggctgaggtgatgcctgccctaagagaggggttaagggtgggggtgggagggtccccaagggctgagacagcatctcccctttagattcagggatcctggggaacacactgcttcccgcttagactaggcctcttgagggctgagataacgctccgctaaatcgtggagttttctagagcctgggatactgtctcgctctcagatctgaggctccctgggacaggtgcgctacctcgccttcaaattccagcctttgggggcaggcctgcttttatgtgcccgatcaagggctcctggggtggggctgggggacaaggaccttccctccctctcagatttggggctcaccagggctgagatggcgtctcccctcagactctgggctccctggggtaggggcagggtcccgccctcagaatcagcttcccaggacaggagctgtgtgtctctgcctcccttcgcgtggggcaaggggctgcgggaccagcggcctctcttctggcaggagggggggttccccggaggccctgcccccttcgtgacatgctcgaggtgtccggtgaccgaaacactcttagctgggtgcagggtgcggctcagggcgtggtcaccgggggctacttagggccgccggtgcgggggacgacgcaaaggttaactgcgagctgccgggcactcagcgcgggtcatggcgtggatactggactgccttttcgcctcggcctttgagccccgcccccgccgtggtgagtggggcccaccgagtcggggggctggggtgctcggccgggggcggccggcggctgcagccccctctgggcgccctggggcttggctggtcgcccccttgcctcccttcctgctggcttttagctaattgttcctggctcaagggactgccccgtcgaggccccgcataaatcaccagctttgccgggaaccgcgagcaatcgcgctaatggctcggcggtacgcgggacgagcgcgtgggcggagtcgctggctcagccgccggcagggacagccagagccttggggccagacgcgcaggagcggcgtcccgcaactcaaggaccctcaaggcccaaggatgaatgtccctgacagggcaagccaggccccagggaccctgaaggaggcgggtattcattttgccttgaagttcgtccccttgtctcaatctcaaacacagaatatcagcaatggaccccctagagtcgtcgaatttaaccccttcatttaagagatgatgacactgaagatgggaaaagcctgcccaaggttacccaacaggttggcagcatacctgggtcagcttaggctctgccagctgcccactgccccagactgcccagtagtggacccctgcggtctttagtcgggttctttccttgggtacttgagatcaatgcttggtttccctatttctgtggaattgaggacacaagtgtgcaaagatcacagcaccggcatatgtgggtcacatttcaccccttttcgggaactgcttctacaaagtacattttgacaactgattatattttcatccttaaagtttcaggagactgatattttctttttgacataccccaggacccccacccacactgtccttcactcccccttgataataagccccacccccttcaggctgccacctgcccccacagccacctgttttttcatagtctccacctccaaaatctatattggtgagagtgcgtcattgggcaccagccatagaccaaacctggggttgtctcctctttcctctgtcccttcacaggcgggggaggggaagcagggaaaggaggggcctcagcaacttaattcagcagagacctgtttttagttcttgccagccccaacaccctgctgagaaccatcccaggagtttgacctc

SEQ ID NO: 7478 - DNA, 4524 bp, artificial
  synthetic oligonucleotide
catcactgaggtctgggaggaatgagggcccagaaaggccttctttcccagggaaagagacagcacaattgacccacttgaaattctctccccagttcactcttggcattggatttggcctcaaacaattggacttctgtaaagcagccaaagctctaaagctgaagggaccctggggcgcactttacatacaaatttgatcttttcttggagatgggaccgaatcgatttgctgaggccaggcctagttgtgctgcagcaggatcagtttccaaagctggggcgtgactgccaatgagaccaatgagacaccccattctccaagtcaggtcgtcagataagcacccccattcaccaatggcaggacttccccaattttctttattacttgtttgtacctcaaaatacatttctcccaaagaaaaaaaatgtgatgctctagagcttagcccataccttacccatcgtgaggataaaatacagaatctgtgtgatgaaaactggcagaaaataatactcttgcaaatatatctcaggctccagcagtagagctgacatttatcaggcttaaatatcaaatgatggaaagcattgagcactgatacagcaaggcaccaggtccgtgagggtgattatggcaatggtgaaagtaacatcattccttttttttcacacctacctactacaacaacctaaatgtccaacaatagtggaatggttaaataaattctgtgatatatccccttattagattgcacagaatcataaaaattgtttttgtgaagaatatgtaacaacatagaaaatggtatgattgtaactgtcaaatatgcatttttgaaagactagaaagaaatcgacaataagataaagttagagaatctattaaggtggtgggataatagttatttttctctatgttttctaaagtctatgaagtttgttcttcaattactgttataatttaaaaaggcatacaagggtaaatttagtacctgtgatatgcaaataatctatacagtgatctagaatttcactatacatagtttaaagaattttttctcctaattttagtttaaatgtaatgactagatccggccagccaaccatgatcttcccaatgatcatgaaatttccactaactctgggtgggaagaggaacaactggtttgaatcccaggccagctcttataaggttgctgtgagagagttacttaacctctcttaaaatgacataataatgtctatattttggggttgtaaataataataatagttcttattactgctgttgtagatgtcattatgttaaatgctttctatggctcagttatcaaaagaagcttttttcccaaatgtttactatttgtaaataccagtcatactacataaactatctctaaccataacaactttctgaggttagtattattgtctctattttaaggacaaaatctcagagaagtttagtaacttgcccactgtcacacagtggctgagcagggattacaatcctttttgatctgacttcgaagcttgagtgaaattaaaagagagaaacatttgcaaaactcctatgctgacatatggcagacatttactaggtggtcaacatgatgttggtgatactttgcccaggacccagatgctggtctttgacttatttgattatctataaatttctttctgtgaaaaggaatttcaactgaaagatgcaatacaaacgcaccacctgtgtcctcatagatgtggctctgagtcactaagaaacgatttctgtttccttcggcagtatcatttgttctcacatgtatcagcagaagtaggtagatggcatgtttgatgagccttggcagctactgtcacgtctcagatacacttcctgagaaaccacgcggcttcctcgggatgagtactcaatactcagcagctggtaggtccctgcttattaaggaaacttactaagtggcatgggcatatctggaacccctgctctaactattctctgtctgatgtggttgacacctaattgctacccctcccatttcccttttcaaagctaaggctccaggatttccacagaagcatacaggggtaggagctggagaagtttttcgaaattcttaaatcctcagagggactcacttgcaaggaggaatctagggttagtgaaggtagcatgcaggataaatagaagggatgaaggagagggaggagttgaaggcaccttccagagtctgggaacatctaggggtggacctctcagagcttttcctgccatgaatctcaatacctctctactctgtagtctctttatccctccctgggattatatccaccaccaccacccctcccccgcccccaatttcttgatcttccaccaccgctccctgcttaaatgcagctttagcttgcagtgacttgcttttgtctctagagggaggcaaaagcaccagggaggagggggttcagattggggtcttcttccacttcactagttttggcaaagagtagaatttattttcctttcattgggaacatatgaataaaagctaatcagagatgtattttaagtgctgcatagcatatctcagagaaccatcatatctttctctatcattccatctacccctcaacgtaggtggctgctagaaactggatggtcttaggcactattatttctagagtgaaagtgagggcaaagcaaaacaggagtcatagggcaatcttagccaggaaatagtcatgcttttattttctggggcacaatggcacatatttaggagactgggttggggctgggtcagcaattggggtggagggaagtctggacagtgagcagaaagtttgaaactttcctgtgtggagtattacatctgaaaccttggtctcattaacactgcgaggagaaactgcagagtgagaattggacttaaggtccagttcttccggggctgcattaggctgatcaaacatcttcctaaaagaagagggactatttcaagagtgtcagacaagccagtaatgaggaaaattggcagtttagtcagttggctccactccctgaacaccatggttgagacactctgggctacatgagaacgaaaaaaagtgcagaagggaattaactaaccttttcttaaacatttactgtatctgttaaccacttggctggtggtttctatggtttacctcctttagtcatctgagcaattctaggcaggtgttaacatctccattttacagttgaggaaactgaggctcagagaggtgaagtatccttcccaagatcacacagcaagtaagtgctcgagctgggataccaacacaaagctgtctcattccgaagcctgtggtctttctctgccctccccacatggaaaaaacaaaagccctgattttcaagggctttactctcatggggaaaccatgatctctctccccacaaaaatccacattttggtgccctgctcctccagattcttatatttagggtgaaatcaaacaaatctctgtttatattggacagtaatgggagttagtaaagcattttcacctttacaattccccatataatcttcatgttatgggaacacattttctgaactccaaagagagagagagacttatgacagcgattttaagctccaaggaagtgtgtgtgtgtttgtgtgtgtgtgtgtgtgtgtgtgtgtctgcgtgtctgtgtgtccatcccatggtggtggcatattgatagggattctgatagcccctcttattgccccaattatatgggtggggggcattagagaaggatagctttcaattattctaatagcccctggcccaggactgcatctttggagacatagcctggagcttttggcttcttcagagttgaagtttgtcttccattgcacaggcaggaacactgagctggagtgaaccagatggtctttatgaaccaaagtggaacttacacaacaggatttagatgggtagtctagcgatgtgtttatgcatttgtgcgtatgtgtgtgtgctggtgttgagaagcaggggcagaacctctgaggaagagaggcctcacatgaacagctgtgaggaggtggaagtgaagccagtatattcagaggagaatgaggaggtgtcagattggccccacagcagcaggaaagctgagcatctgagaccagatgctgggagataccaaagtttgcctgaacaccttgtatggatttaagtttaatgaaaccaaggggcttcaggtggtctatgccctgcctgagtaagactgacgtatttaggctccctttccccctccaaaggatactttctggctacataatactttaggcaatgctttctgtgcccacccaggatgaggtgctgacccaggcccagctggggggaagctttatggatgttccaactgcttttcatccacgcaccaggctcatttgtgccagatgaaagggcacaataataacagtggcaatttaaatcgtgcttctcactttccccctgaaaagtggcgaagtg

SEQ ID NO: 7479 - DNA, 6548 bp, artificial
  synthetic oligonucleotide
agttaggtagcagagatggcgctaaagtggcaatgaatcagtccaagatggcatgaggagattacctgagtgatgatgagaagggggatgaggcaggagcctgagcccttgaggctgggactgagtgatagaacgtctatattcatatgcacaaagtcagctcctaacctgcctccccagttccacaaccaagtccccaaggatagcattggcacactcctggggaggggaatgtttgggagacttgggttccaatcctgactctgctacttactatgtgactttgggcaagttattttcccctctctgggcttcagtggcaaggtaagtgctaggtacttcacctatgtcatttcacacattcctctccacggtattattggagcactaattttcctattttgcagttgagaaaactgaggctgagtgatattttgttatctaccttctctctatatcatgcggtctttgtgtatgtatgttaccaggcaatcgctgtaatccaggcctcttctagtatgccagtcctctatttaaattggatccctatgtactcaggttcaaatcgtgtctcccagctgcccccaataccagcccatgttgctagttacctgggtgggttttcttttcctctccggcgacaccctctcccacctcaactcaagtttttttcctggcatataggtctaaaatctcacattaaaaagcaagcgtcaccagaaagacgtactccaatgttttgtgttttatcacagtggagggtgctggttgcagggtgctggttgcaggatgctgcagtgaggaaggggagcagagcttccagggccagagggaggggctgcagaaaaatccagggagagagagaagacagagagagagagagagagacagagacagagacagagagagacagagaaagaggggatgccagggacaaattggaccagcctcaaactgctgctccctccctttctccccctctacttacctggtgctctagaatgtataaaggggcagcacccagtccacttacagcaggaggagagggagaggtcctctcctctcctctccttcaatggaagggcaaattgtcctgagtattcaaattgtactcctgtgttgggtaagatttatttaattctggggggaggggagggcgagggcctcatcatggtagcaatgatggtgaggtggcacttaaattgaaaagagcaccaccagtgctgcttagagccagacgctctctctctttactagaggataagtgaaacttgacactgggcttctggatcttatttccaatccaggcacctaagagtcatatctctgagcctttggagaataagtccatgtctgcctgggcttccacagcagctatacttggagccagcagctgtactctatcctttcccttcctttttcttccttctctcctttgcccaggctctgcttccccatgtttccctcttgctgggctcacccatagtctcttatattcttgactcttctctttcttctccatttctgtccctctttgttgacaacactgtcccttgtgcatttacttggcccaagacaggagagaattcaattggggggggtgtaattgtgtatttgaaattctcccacttaagatcttgtgattataaccccatattgcccttgttgcatcagataagaatattaagctcttgtaaattatatatttttgcttggttgaatggtgatttgtatatatgattggtgggctgcagtttagaagagagtatttttggaagaggtattaaaaggtaagatggtttgggctggtgtagatggcctcctgacttctctaagtgcctagatatgcaaagaagacagtacatgaaaaattaagactatagtagtggggggcaggggtgggagaccattgccagccaggtcgatggaggactttgtgaagtcagcttctgttttgctcttgctgatcattgaactttgaaaaaaatgacctttttatctctgagtttggaagaccagaggccctagacaagaagaccagaggccctagacaggaaggggaaacaaaaagcagaaagagtgaggcaaggaggggaaaggactattccttgtgcagtccttgtgtgcaaagggccaacaaagaatgtcccctgccctcaaatgccacaccagtcaaggcagaagggaagcaaagtgctgtggcaaattgtgtgctgagctgggatccaggagttctggaccttcatcttggctctgccactaattagctgtgtccttgggtaagtttcttaaccatctgaacctccatttctgctcttccttcacttgtactgtgagattgtgtggcatggccaggggaggggaggttcagagcattcagagggaagggacccttgggctgaatcttgaaggagagctctgctttgaataggggagagaagattgtggggtacagtgagaaccagtgggagtggcccagagaattcagcaaacaggtatacgtaaggcactgagctggctgctgggtagaaaattgctatgaatcagccccctcctcaccgcggcaagctttccagagagtaggggaatctgagaggcagagccaagcgctggcagtgcctgcagctcctctcagcactacccgctgccgcccgccggactgtcgagcaggtcacgcagcctttccctggccggaccaagaggctcgccaagaggtagtgcaggggtagggcaccagtggcctgagcgcagcccactgcggggtgagagagggaggtgagggcacttccacgtggaaggcccgacgtgagggagggagaggagacctgagagtgtggaacaagttgcccaggcttttgcgttcgatgtctcaaacgtaagagcgcaagaaagatttaatttttctaattctcagaggagcaggaagcagtgagtggtttccgcgcgccgcagggctttgtttaactttacaggttctgcgctgcctggagctacccaggggcaggacccgcgcagcgcacctcaacccagcctaaaggccatgctctgcagcgcagtggcagccagagacccagggcaaccccgagaggcagagggcgcacattccgcagccccctaccctcacctctgtccctagctcagagccgagggcacgcagcgggacgggtgctcgggcggagggtcggaggtggagacaggctcagtcccctgcactctggccccttggaggggcttgggggtggtgggctctctcttcaactgcgaatagcagccgtgtggccctgtgtcccggagttagctaagtccagtggaagaatcaaggactttgcagacgtgagagttgtgtctctacagtgcccttagataaacagaatgataataaattatgccagtatgtttcgggcttggagacgctctctgacttgcccaaggccacccagctgcttagtaactgaggaggcctcctgactcctggtctagggatttttctgattgcgtcatagccatgagagtggtccaattttgaatggggatggatagatggatggatggatggatagacagacagacagatattgatatttttaaaaatatgcttatttgaatgtagttttaaaataccattcctgccatgaaaactacagggaaaaacatctcccacagccccagttccctatgacagccactcagacaggattttgaaaaagaaaactgacagaaaattggatgcttgttggggaagatatgatcaaaggagaatagagggggtaggagtgggggaacaaagatggaggagaagaagctctcagcacggattctgagaacttccttattctgaaggtttctttgatatggcctctgttcagatggcttccgggagtgtccccatcagtcctttatttcttatgcccactctgtagaagccacagatgtggtctggagaggcagatattgatgacccttcttttaattaagtctcatttccctttttccctctcttgtagtgagtacatcgaagaagggaattttgtatgtgtgtgagtgtgtgtgtgtgtgtgtgtgagagagagagagagagggaaaatgcttatgtaagagagtgtaagggtgtgtgtgtacatggatgtctgtgagtgggaatatgtgtgtgtgtgtgtgtctgaaagggagcaggtctcaaagagggaagctttgagagaggcaagggagataagaagaatgaatccgaatttacagagtgcaaactaaaaacttatagctgactagggatctgtccagtgctggtgggcctggggaaatagtcaattcttaatattccttaaaagaacaaaggaaaggaaacatatttaaattagtgcaagaaagatgatgttaaacccatgggcctttcttgatagtcttcagacacttgacatttatgtgaccttcgactaggctgtgagatcccagggcaggaacaagggctttctactccaggtagctctccccttccctccaccatctctagcatgggtggcttccatactgtgccaaggaagccaaagttcaggattaaatccattttgtaggccagttagcttttatctacatttcatagactagactaatccccacatatcacacagttagctgccttgcatctctgatcatgaaagacccagtgaaaatacagttcatcttatcccatctagaagtgtgcttcctgctgacagtgggtgagtacccattttcatcttcaaaggatgatacagaggcattcttcagcaggggacactatctgcctcattccagatagtagcacttctgctaagtcttcctctcaagtttggctcccaggtattttggagggcaattcctcaccttgcttgtttgcttgcttggcatagaaatgtaccctttggagaacactttcattctacccttttattttatcttcacagccacacttaataggtaccatgattcttgttttgtaaggtcatggatctgaggctcagaaaagcaagataatttgctctctgtcacatagttagtgagtgtgtaaacttacatggagtgaagctgggatttgaagctaagttccagtctatatcacaggaccttgccaggataccatgctgtcaggttgggggtgggctggggtaagaaatatggtgagatgcctacacagggcttttggtgtctttctcctctgtcaactcctctcctctacctttcataatagtcttttttttccaaaaacatatatatactcttcctgtaaatatatatatacacacacacatatataaacacacacacacgcatatatatgtgtgtatatatatgtgtgtgtgtgtgtgtgtgtgtgtgtgtccatgtatctatctttctttctatcttcatttcccacggaatggcacagagcaatgtataaaaataatacctcaaaaatccaaccacatccttaggaaagaaggtagtcttggtttagactttcccagttccaggcagcagatgttggtggtgaataccaagaactgctatggtttggtggaaagggcaaggcttgagttggggataggaagggagagctggttcccagatcatattcctccatggcatttttgtgcaactttagataagtcacagcctctccaaagtcttagtttgttgctattgtaaaatggggaggaaatatccaacctacctctttcccaggggttattgtaagaataaagtggcatgattcatttattcatgaatcacgaatagctgttttaattacaagactctcaagagcttataatcctgtgattcactcgacaaacacttattgaacatctattgtgtgctagggtctggagataatgggcatatggaaagcttttaagaaaatgaaaagcaggagacaaattaggcattaaaaacttttacctcctattgatagaacattttatttttaacttcttccaccacaatttaatagaagcagcaaccaaaaggggaaaaaatgatatgcatgacacagcttgtgatgccaacactattatgcaccctgatacatattgcagataatagtgagaatatctgtatcttcgtgtacttgatgtcacattgccttgtttacactatcctttgggatgtttatagcataaaaattgcctttcaccatcctgagcctgagttgtttctttagtcaataaaatttaaaaacaggattccatggaatgacgactgtacttattttacaaagatgctgtaatatgtggtggctgcctgccgtcagatatgacctaccctggcttatggaatcaggctttgattatgtgtattcttttgatttctttatttagcaatgcagaatcttgcagctagtgaaagcaagtatgggtgcgtcaatggcaagagccctgagactgaagagaactgggttcttgtccaagctctgttgtcaaattgctgtgtggtcttgggaaaacccctgtctctctgtgagcctcagttttctgacctgtataatggaggtttgggaccaggtgatggctaaggtcctatttctgaaacat

SEQ ID NO: 7480 - DNA, 4767 bp, artificial
  synthetic oligonucleotide
agctgttttctcctttctgctctcacaatactttgtttatatcttggaggtctaacatcacaaggttttgtaaattgttgctaacttgtgtatctccttcactgcactgttaaatctttaaaaaaaaaaaaaaagaaatagtattaccttgctcatcctttcaatctttagcgcctggcacaaagtgggcaattaatacaggtttttgttttaatgaatgaatgaatgagtgaacaaatgagtaatagagaatgtgcgggaaaggatgctgtgtgaggtgtaggggcataccccattggggatgctttgtagtctggaagtagtataagatagtgggcatcatggagaaggcacatataaaataggttttaccattacactaagacaaactccactttgataccaattctgtttaaggagtctcactagaaatggtctggaaatgatgtttgttggttttggtacaaatgatttttttatgaaaaagtaatataatgaagttgtacaatgtttggtaaatagagaaaagcaacaggcaaacaaaatctcaccagttaatgcaaatgctgttagcatttgggtgcatttccttcagtcttttatttttatgcatgtttttcttcacatagttgcaatcaaaattaatacaattctgtgttttgtatttgttgttaaaaaactctttgtaaatataactttaatgattgcataatttttccatactgtggccattacaaaatttatataactaatatcattgctgggctagctttttttccctttttttgttactattatggtttatgtggatatgcttttccctgtctgtaggaagattttattaggatagattcctagaaggggagttactaggtcaaagggcctggggacgatttttggctctagacccatgtgtccattttgttttctggacttgtctgaatttgcagctctcctaacctagatgaaagtcccctttttatccaacctggacagcatcgagtatcgtcatggaaagaaaaaaaaaaacctctaaaaacgctctaattaattaactaattaattaatggaaaatactatcttatttttgtttcaaagtgcttttgttaaaaaatgtttttctcttttattttttcttcttattttctctctttgtactttttttttctaattaggttttctttttcctggactatctgttaagggctgaatttttgaagttggattttttttttcttttttagcaaaaacaaccagaggctgctctgcttgagggtgaagccgcctcccagttttccctccccctctacccccacccccatagttctctccaccaggtccagtgacaattggatgatgcagccttgataatcatccgattccagaatgggtggctgcattccttttctgaaggcagcaagggcactgtgccccagaatcatgccccctttgctgttgttgtccgccttcatttttttagtgagtgtcttgggaggagccccaggacacaaccccgaccgcaggacgaagatggtatcgatacacagcctctctgagctggagcgtctgaagctgcaagagactgcttaccacgaactcgtggccagacatttcctctccgaattcaaacctgacagaggtaagctgtaccccggattgtggcatcctcgccttcgggagagtggaccctccgggcaggacggggcggattaggggtctggcagggtgggaggggctcacgcctgatctcggacttgatcagttctcctggcgtctggggaactgaagaagccggagttgaaggctgtttgttgaattgcggaagaggtaaaaattagttgagtttggtcgaaggctgggagttgagggggcagtaagacagacgggcagatgtcagggacagacaagtggacagagggccggtgaagagacagccgcagcaggtgcggtgcgagaatagggcagagcgagacggaagcgcagagggacactctggagagaactgggagagatagagacagcgcggtcgagagacagagagtagagggagatagcaagacagtgcgtgagagagagacgctcctagccgggcggtgaacgggagggcggtgcgggcgcgggggcggcggcaggaggtgcgcctctagcactgcccacctcagctggctgccggggagcgagcaggacgcggcgcaggacgaggttcgagtgcaccagggaatctcaggggtaagcgcgcggatttggcagcggagcccaggcggttagcgcggacccaggcgcgccccagaggtattggaaagtgctgggggtggcagcttcgctaggcgcgcaccgcgaacgcagcttgaattgagcgaagcaaagggcgaggagcccccgctggcagccactgatgccagattcggagtgcggggacagccaggtgtcgccgcttctcctaccgcagcgcagggagccgacggcaacctggtgcgagcgcgcccgcagtaacttggcgaccctcacccgcggtggcgctgcaggagagcccctccctcccctctcctgttgcgtgatctgggggcttcagagccccggaatttatgttttaagtgttgtattgagcgactacgggtgcgtagcaagatgcgcggtgcgcacgcggcgcattagattgtctggtttggttaaattcttggagtctgataagagtgagataggcttgtccttgttgttaggtggggaaactgaggctcatagaaagcaaattacttttcgcccgctgggcagagctcgcctctctgccgctccctccccctgctgcagatcagggcattgggatgttttagtcacttattaagtcctatttgtaagtgtatcttttcttttttctctttctgtagctctgcctattgaccgtccgaacaccttggataagtggtttctgattttgagaggacagcagaggggtgagggggctcttgtattttctttagaaaagaaatagaatgctaaccccctgtgtagtgtggccctggctattggagactgggtggcgtccactgtcccaggggacactctcctcagctcccaaaccccacagtgggtgatatcaggaaatggcgcagtagctgtaggtgcttggggcggtcctctcagaccttcctggtggactcaccccacacagatcaacccgaagaaatcgccctctttgtttcaaggtagtcacccccagggaaaatttaaggcagggacctcgagcctcgtcggggtggttgagtggagctgagtcctttcgccaaaccactgcggggtctttttggctagctccccagggaggggcgctgcggttctggagaggtggggttggctgcgggtggttgctgggaggagtgctacagcccctgcttcctcctgatttaagcgctgcgaggctttgacgtttctcattctttctctcgtggctccccagctgtatcacacaagacatttggcattagcctggaagaggtcctggtgaacgagtttacccgccgcaagcatcttgaactgacagccacgatgcaggttgaagaagccaccggtcaggctgcgggccgtcgtcggggaaacgtggtgcgaagggtgtttggccgcatccggcgctttttcagtcgcaggcggaatgagcccaccttgccccgggagttcactcgccgtgggcgtcgagtgagttaaaccctccaggtttcaggcaggggcctctcctgaggtatgcaggaatgtgaggccggaggatcaaggcctgtgccctcagaggcaggggggagctgaacacaatatgttgaagtggtgtccttggcttgccacaaagggaatgtatcttgtcctgaatgtcatacatacagtactcaggaaggtcctaattgactctctttatttcccattttaagataatctggatttctccacagggtgcagtgtctgtggatagtctggctgagctggaagacggagccctgctgctgcagaccctgcagctttcaaaaatttcctttccaattggccaacgacttctgggatccaaaaggaagatgagtctcaatccgattgcgaaacaaatcccccaggttgttgaggcttgctgccaattcattgaaaaacatggtaagggagctgcaaatgggtaaatcaaggaaggaagcaaagggaaaggagggatgttctggaaatggggggagaaaagaggccgaggatgaagggcttggataacattcccctgacacccagtggaggtcgcgatgcagtagggggtgaggggagaagagaaatgccatgggaaagggattcagagatgcttagcatcccctggtcttttctttcaggcttaagcgcagtggggatttttacccttgaatactccgtgcagcgagtgcgtcaggtaaattggctatgtttacatgtttgttcctccaataagaaagagcaggaggaggtggggtttccccatagacctgactacctggtggggggaggagcagggtcttctttgtagcccccaggcccaccatattgccagctacctccactgaatactggaacctgttgaaggaatgaccaagatggagctgtggtgggccaggcagacagtccctgtcttctccttttcctagctccgtgaagaatttgatcaaggtctggatgtagtgctggatgacaatcagaatgtgcatgatgtggctgcactcctcaaggagtttttccgtgacatgaaggattctctgctgccagatgatctgtacatgt

SEQ ID NO: 7481 - DNA, 2043 bp, artificial
  synthetic oligonucleotide
cggggtgccgggtacatgctcagctgagggtttggagggaagactgagaaggaaaaggggagatatctacagtgcccagagattctcaccgaggcaggtctgggatccgggaaggaaaggagaaaggcaggaatgaagcgggtggggggacagactggggagcagtttgatttacggcaattaattacagcaaggagactctttcggggttttgtttaggatccggtggccagtatttaatattcagccactgaactatgcgctcatttgtaggtacttacggtagttgaaggcccgctccgatgttggagattctccagtgagctcctccagatgcagcaaactgcccggcatgagaagagctgtctaaggacagcctcttcggctctgagccccgccttcctctctcccccgcccgcctgccggcccgccccaacctcctcccctccctgcgccgggctcggggagcccacctacaccaactctgcctggcacctgcagtcctctgacgacggggatttctacgcccctcccagctccccgcctctctccggactccctgcagaggttgctggagccaaattcaggcccctgccccctcgcctgtctctcagagtttcactgggtcactgtattgtgggggggagaaggccagctctcaagaagatttgtagatccttctctccagctccccaatacctttatcgggatctcagatcttcccctgcccattttaacgccccatttatgcataaacatcaccacagtttaagtgcctactgtgtgcccctgggccctgggatccattatttctcatcttcagagcaactctgcaaaataagtgttactcccctcagttttacagatgaggaaacggaaactcagagagggttaagtaacttggacagccttcaaagtccatcttggggtaaaagcccaggctttagagacatacaaatgtatattttagtccacattttacattcaatagttgtgtgacctcaagcaagtgagtaaactctctgagtcccaggttccccaacagtaaagtaaaaaacaaacaaacaaacaaaaaacagcagaacctatttcacaaggcctcaatgggatgatgtaagtaaaactaacagcacaataggcctagcatgtagtaggtgctcaataaatggtagtggttgctgctgctaccactactactactactattaatctgtaagcccttccccaaatgtcttagagtaacatgattttaataatatagagcaacctttcacaaatgttgattatgaaagactttttataatgataatgtatgaataagacactaatcaaagctcctgatatataacatatgatgagattaaagtatagcatccaatgggctcacagactaattgataagaaatatcaacatgatagactaattggctaaaaaatagacaaatttttctttatgtacatttccttttttttaagacagtctcactctgtcgcccaggctggcgtgcagtggtgcgatcttggctcactgcaacctccacctcccaggttcaagcaattctcctgcttcagcctcccgagtagctaggattataggcgcgcaccaccacacccagctagtttttgtattttttagtagagacggggtcccaccatgttggccaagctggtctggaggctcagcctcctaaactgctgggattacaggcgtgagctaccatgcccagccttttatgtacattttctacctgcataaaagatttcaaattatctaatgaaaaacactttaattcaagaacaaactgtgtaaaaataaagtaacagctcttttacagccaaattgattatcatatcttcatgcatcaggtgatatcaattgtggcttccattataaactatagattattgtgtaatgaatagaataggcatatgaataaaaagatgtgtttctgggcaagttatttagcctccaagcctcagttttcttatttgtaaaatggggataataattgcacttactacaatgaagggtttggggtagga

SEQ ID NO: 7482 - DNA, 469 bp, artificial
  synthetic oligonucleotide
aaggtggtatcaaggatgactctcaagtttctgtttggaaacttgatgcatagtggtaccattcgctaagttggggacacaagaaagagaagcagatgataaatacaaattcactcttggacgtatcagctcatgttttttacccttgaccactcttgttcacatcaacctcccctatgggaaatcctagagcctgggccgttcccttgagcctttgtgtttgtacagactcctgaaggagaatggaaatccttggggacagggtttctgtctgagacttctatcacctcacaggccctatccagtgctaagcatagaatgagttgtcaaaaacacttactaatcaattgagccctgtcacggggcaataaaatgtgatgtgcaggtgggcttgtgtcatacccactactgaaaatggttagcgataaagaagagtttcagtacaaaaaccaaagaaacatagcaggga

SEQ ID NO: 7483 - DNA, 1206 bp, artificial
  synthetic oligonucleotide
gataacaacttaaaggctaactcattaatgctcagggatgaatgaggtaatgtgtcagcagaccaaattggtgcccaaatgttttcatctagaggcccgtatctctttcccgcattgtgatatattaatggggatgtcttgatccgttgtcgctgcctgtagacatttgaataacgtagaagtaataccttctgggcactcaggcctgtgcgctatcaatttttcaaactccaaaggtctctcagtggatagaagcaaaattctgatagtgccataaagtgcctaatttataaagattcaaaccacggcatcagtgcagtccctgcttttttctgataggtgttttctactgagcactgcaccattcctaactatttggtgggggtagtggagcaaattagtcctccaaattgtgaagcctgtggatttatgcatagttgaaaccatttccgttctagcaatgtctaagtgggtgacctttctgacgttaatttgtttctccatctgtgccatgcattttgagaggacgtgaagaataggcttgatgatacccaaatgcatttccccctattttgtattgctgtgctgatggcttgaaggaggagttacctatactggggacagattctggagatgtcctttcaccagtgtgcattgaatgaggccagaaaattcatcttcatggagcctggaacatggaaggttttactgtcctccttgaaatgaatgtcctctcttagttatgatgtcatctggccatttgctgtcccaaattaaattttctcctactcttccctggctcctgaatgtgttttgtgtagcttggaggttacaatttcatgttacatatttttaaaagatttattgagccagtcagtagaaggaattgtactaaatttaatcacaaaatttcatgttattcttacaacaaccctatgagataggtacaattttatttctattttacagatgaagaaagtgaaccagataaagtaaataattttcccaggatcaaatgggtggtatgtaactaagccaggaatgattattgaagtccttctgactgtacaacgtatgctatttctgccatagaacactgaaatcatcttttaagaaaatgtatttgccaatctactcagcatttttctttaaaatgaatagttctcaacactgggtgcacattaaactcatctaagagcttaagaa

SEQ ID NO: 7484 - DNA, 550 bp, artificial
  synthetic oligonucleotide
atatatctatatatctatatctatatctatctatatctatatctatatctatatatctatatatatctatatatctatatctatatctatatatctatatatatctatatatatctacatatctatatatatctatatatatatctatatatctatatatatctatatatatatatctatatatatctatatctatatatctatatatagagatatatagatatatatatatagagagagagagataatatatatatattcctatttactggaggtgtgacatttaaaaatatactatggctcttgtatacaccaatggattctaggaaggagacatgaaatcacacttagcagtatccaagtgagtggagcaagggaaacaacaaaaaaaataccagtggtaagtggttagtgtttattggttatcaatctattagaaagtttttattgagtacctactatagttataagcccaacactgaaaaattatgaaatatagtccgagtctttatgaagctaatgatgtgtttggggaaggtaacaattgatt

SEQ ID NO: 7485 - DNA, 1901 bp, artificial
  synthetic oligonucleotide
aagattgaataaagtattgtaagtaaagcacttggcacatgttagatgctcactgattcctactttctccattccttcatgaccactcccatttactactttttttctccctattttaccaaatggaagcagaggtattatgtgtccacattattattattttagatggacagaagtgaacctttgacagactagctgaagtatactgaagtataatttccatactccactccctattacacacacgcgcgcgcgcgcacacacacacacacacacacacacacacagagagagagagagagagagactttgctcagaatggatgaaagaagggtctttcacttgtgatggtaattcactcatttttgctctacccaaactgtgagtgttaacttccgctgccgctgcagctgctcctgctgctactcaacacagcaccccacccaggggaacattcagcaacttacacgattaaatggaaagactcagggagaaaatttggggctgaatgaaggttatggaaagagaactgttttcagagacaaagacatgagttctagtcctggcactaattaatttgtattgtcattcagctatagaaaagccacttaacctctttgagccccatattttctcatctagaaaatggtaaaaaaaaaaaatacctactatgcctctcttttagggttggcatgataagataatgaatgtgaaagcactctgtaaactctgaagggtgatacaatacacatggaatggatccctattattattccatcatggaaggtgggagagggaggaggaagatggcaagatgataattttctgttgcctcctccagttcctgcttacagagttgcactctttgccctcccacacaccccctacacacacatcatctgctctgcctctctactgtgaaagtttcaacctgggaggcttgaaacaaacagctctaagctgttcacttatattgtatcgtaaaaaataatttttaatgttagtttcatgttcttgtatcattttaaaaatttcccattttaggataactctatttcttgatgttcccatgctctgcaggtatttaataaataaatattatttcaaagagtaagtgactctctattagcccctaaaacatgatgaaatcttttttataagacagaatttcttgttcttcccaaaggaaataaacagacaaaattatgactttatgaaggaaatgatttgatattcccattcccatgtgccactgcattcactagtgtcatgatagcagccagaacagttttattattattttggctaatgtatcttggatgtttacctgttggaaataatcaagcactcctatttattgaagaagtgacccttcatgtttttaaaaagtgaattcatgtatttgtccctggaagcaattatattattttcagtactggttcttaaaaaaaattgattacccctttatcagttctttagttatgtagttcactgtgaatcttctaaaaatagcctaacatttagaatttaagtaaaggttcacttatttacctattcaataaaatttcttcagtggttaataaatgtcaggcttccaaaatatcatctattcctatccgcccatttccgggtgaagaaacaaacaagtccagagaggtcaagggacttgctggagacctcacagtgaattagcgacagagctggtgttggaacccagatctcctgacctaattcagtgactttgtaacactatctctcttctttcttattttctgaagttattctggagcggactttcacctttggtatatttattcttccaataacagataaaaggtcattctctgtcactgtgtttgagctatatgatcttgagcaaattgcttgctctttttgggtcc

SEQ ID NO: 7486 - DNA, 2502 bp, artificial
  synthetic oligonucleotide
gtttattttaatttagtttccaacaatctggggttgggaagccaaataaacacgtgattcatgagctaaagaagatgtctgacctctagttataagctttgggagacatgagtataagaattagactcagatataagtttaattatatatgagaggtcagatatgaccatctatggaaagagtaaagttacagaaattagtaagaaatacatggtggtcattagagcctgttacaggtactccagttctcacctccttccaggtacataacaacattgccatgtgattgcttttgccaactaaatgtcagtaaaagtgacttattcacatccaggcaaaagcttgaagaagccatacagaattcactgtgcttcttttatcctgcttcagcaatcattaaagcaggtgtcaagaagaatcccctattcagtctgggtccttgggtcacttcaatgagcggagacaaatgtcattactatgtagcatgagcaagaattaaacctttgttgtttcaagcccctcaaagtttaggggctgtttgttgctatagagtaagctagcttatcttgaatgccactgaaaacttagaaatacatacatttagaagttagaagaaagagggaactgacaagtgactctttcatggggatggcgcagaagagccatactgaagagagagtgcagtagcaaaagtcactgaaccttggtgattttacagtaaagtatacaatttacagtaaaagaataagcagaggtgagaagtacataaagcgaaaatgaatcttagaagacaaaagaagaaaaatattcaagaagtgaaggtagtaagtagtgttagatgaaatgaatcaaagactgaaaaagaacattggatttggtcattagtagtacattgggttactttctaataagttcagttgtgtgacagaaacaagcaagggattgagaagttaacagggagtgtgtaaatggagttaattaatgagggtaatcatttttagaaatttggtaaagagagaaaattccttaagcaatgtcctaccttccgttggataagcatggttttttctctctctttccatctctttgcttactctgcttcctccatattatcctggttctcttcttctagatctgcctcttctctgtcctgccttctctatgcccctgtgtctctttgcctctttttccctatgatggcatgataactcttacagctggacagagtgggcctagttcagcctgtggtccaatacaggagactcctctattttactgctgatcagactgaaattaaatgttgtatcactgaaggagttagctcactaattcatggaactgcctatcccgtaattgtcagataaatctagctatctagacagaaaacttgtctcctactcagctgaactctgcctccctttaactttttctcagtcctaattctacgctccctataccacaccagaaatgttactctcttttgtaccttgtacttgatattcatgctctcttttctctttgcccattccttatcctcacctttccattgtctcagagatgaccctcaactataaagaaaatattaattttcttattaatagcctcagtttcatcaagtggttgaataaatgggccttctaaaaatatacataatttagatatagatatatagatatacttttatgaagaacactaaatttgtaacattgcaaacaacttacgttaaagtgtattttcaactattctgtgtatgtgtgtgtgtgtgtgcagtgagtcatataaagaagtgctagccttcttgttttgaaaaaagaagaatttttaagtttgcaaggaaagagttagattgagtattttaaaatcatcatattcttttcttcacaaacaaaacaattaagtttttaacttttttttacttatatatgtccactgacttatatgtgggagttgggtcagttatgctcagtagtaaaaagcttcttatacctaatttagataacttctagaatgataaatccatatggctcaattaagaaaataaaggagcttggcggacatcactcagccatgcaccctcttaaactttcctttgtatttctgtccaacactgaatccttagcttgaataggctattgcaatgctcttatgagggcttattgtcaagaatacagagatggtgggaaatcagttccaatgcttaaaaacactgtttataaagcacttctctgactgaatgtttttcccagctttggagagtaaggaaaggtgtaaaaatgcaactactgaattcctaggctcccttacaccttaaagagaggcaacaagcttgacttcggtgaaatcttagttgtattccttcttccagaaacaacagtcttgtgtttgcatatctttataattttcacagcatttccccgaccattatcttgttggaatttcacaattctatgaagtaagaaaggcacgtagttttccttattctatagattacgaaactgctgc

SEQ ID NO: 7487 - DNA, 1204 bp, artificial
  synthetic oligonucleotide
tagcaacaaatctacttttatttttaatattagccctgtattccatggtgagaaaaaaaactgttggttagcagaaacataaacctggtcatcaaatcatgaaattcaaagacaaaataaaagcctttcttgaaagaaaacaggaaattaagaactaaagataaacctgcaataaccattaataagtaagcagcagctgggcatggtgacgtgcatttataatatcagctacttgagaggctgaggtgggaagatctcttgagcccaggagctccaggctgcagtgagctctgattgtgccactgtactcctgcctgggcaacagagtgacaccctgtctctaaaaataaataactaactaaataaaataagctagccccaaaagttccactgagttccaatttaaatagactaaagatcccctggtcaaaatgcatctctattgttcactgggttccataacagagagtgacaagaattatttgtctggcttgtttaaagttatttgtcttcaggccgggggcggtggctcacgcctgtaatcccagcactttgggaggccgaggcgggcggatcacgaggtcagaagatcgagaccatcctggcgagcactgtgaaatcccgtctctactaaaaatacaaaaaaaattagccgggagtagtggcgggcacctgtagtcccagctactcgggaggctgaggcaggagaatggtatgaacccggggggcggagcttgcagtgagcggagatggcgccactgcactccagcctgggtgacagagcgagactccatcccaaaaaaaaaaaagttatttgtcttcagagctcatgtccccttctgcttgttagatggtggcctcttctagggcaggaagtatgtctttatctctgtttcctttcaagtatctatacatttctctttccaacatttattgtgcacccttactgttcttaatactgtactgagtactggatacacatgaaaaaacacagtctctgactcagtctggtggcaaaacagatctctaaaccaatagctgcaatttaataaagagtgttctaatatccaataaaagtacgctcagagtgttgtaagaacatagcagatagcacaatgtcatgtcatgcacattgcaggtgcttaatatccatttgtccaatttaatttactcaaagagaagaagagcttagctcaatagaagg

SEQ ID NO: 7488 - DNA, 606 bp, artificial
  synthetic oligonucleotide
caattacatgtcttgatcagtagatagggctatattttctctatgagtgtgcactattccttccaacttccaaaggtgatctaaaggtgttgaccttacaaacacagcaaatttaactcaggaggaatgtcttttaaaaagcaaatatatacagtatttttaaattataatgttaattatttaaaagtagataaaacggtagagaataaatttaaaaatcacctataattccaacactcaatgaggcttgcatcagtttggggttcagatatgcatgtatttaagtctgctatgcacaattatttcagattcagctcatcactttccatatttacacctcagttttctcatctataaaatggggattataagagtgcctacctcacaaaagtggttttgaaaattaaatgtgataatacaagtcacatttctatcacaatgtctagcatatggtggacattgaatatgtatcaaccaaaaaaatacctgtcaatttgccctttaaaatccacacccattgtatgagtggtcatttgcctatgtctataccaataatgactgtatcatttaaaaatattccatgacaatatgacagactgaaaattt

SEQ ID NO: 7489 - DNA, 4396 bp, artificial
  synthetic oligonucleotide
tacctaagctctcatttctattattcttattgtgcttttcatttctctaaaaaaaaatttattctttcctgttacatattgatatggtttggctgtgccttcacccaaatctcaacttgaattgggtctcccagaattcccacatcttgtagagggacccaggggcaggtaattgaataatgggggccagtctttcccgtgctattctcatgatagtgaataagtctcatgagattggatgggtttatcaggggggttccacttttgcttcttcctcatttttctcttgccaccaccatgtaaggagtgcctttcaccttccaccatgaatatgaggcctccctagccatgtggaactgtaagtccggttaaacctctttttcttcccagtctcaggtatgtctttatcagcagcatgaaaatgaaccaatacagtaaattggtaccagtagaatggggcattgctgaaaagatacccgaaaatgtggaagtgacttaggaactgggtaacaggcagaggtgagaacagtttggagggctcaaaacaagacaggaaaatgcgggaaaggttggaacctcctagagatttgttgaatggctttgacaaaaatgctgataattatatgaacaataaggtccaggctgaggtgatctcagagggagataaggaacttgttgggaagtggagcaaagttgactcttgttatgttttaacaaagagactggaaacattttgcccctgcccaaaggtttgtggaactttgaacttgagagagatgatttagggtatctggtagaagaaatttctaagcagaaaagcattcaagaggtgacttgggtactgggtaaaagcattccattttaaaaaggaaacagagcataaaaatttggaaaatttgcagcctgatgatgcagtacaaaagaagaacccatttttttgaggagaaattcaagcctgctgcacaaatttgcataagtagcaaggaacctaatgttaatccccaagaccatagggaaaatgtctccaagccatgtcagagaccttcacagcaagccctcccatcaaaggtccgaggcccaggaggaaaaagtggtttcgtgggcctagcccagggactacatgttgtgtgcagcctagggacttggtgccccaagtcccagccactccagccatggctgaaaggggccaatgtacagcttgggctgtggcttcagagggtggaagccccaagccttagcagcttccacatggtgttgagcctgcaggtgcaaagaagtcaagaattgaggtttgggaatctctgcctagattttagaagatgtatggaagcacctggatgcccaggcaaaagtttgctgcaggggcggggccctcatgaagaacctctgctaaggcagtctggaaaggaaatgtggggttggggccccccacaaagagtccctactggagcactgcctagtggagctgtgagaagagggccactgtcctccagaccccagaatggtagatccactaacagcttgcaccatacgcctggaaaagacggagacactcaatgccagcctgtgaaagcagctgggagggaggctgtaccctgcaaagccacaggggcagagctgcccaagaccatgggaacccacctcttgcatcagcgtgacctggatgtgagacctggagtcaaaggagataattttggagctttaaaatttgactctgctgctggattttggacttgcatgggccctgtaacccatttgttttggccaatttctcccatttggaatggctgtatttatctaatacctgtacccccattgtatctaggaagtaactagtttgcttttgattttacaggctcataggtggaagggacttgtctcagaggagactttggagtgtggacttttgggttaatactgaaatgagttaagactttgggggactgttgggaaggcatgattggttttgaaatgtgaggacatgagatttggaggggccaggggtggaatgatatggtctggctatgccctcacccaaatttcaactagaattgtatctcccagaattcccacaagttgtgggagggacccagagagaggtaattgaatcatggggccgatttttctcatgctattctaatgatagtgaataagtctcatgagatctgatgggtttatctgtggtttctgtttctgtttctgtttcttcctcatttttctcttgctgccaccatataagaagtgcattttgcctcccactacgattctgagccctctccagccatgtgcaactgtaagttcaaataaacctctttttcttcccagtcttaggtatgtctttatcagcagcatgaaaatgacctaatacatatgtctttctggagctctgctagtacacttgtcatttctggtgtcttgtctcttctttgaatttgtgtacatcatctttgaggtcctgtttcaggcatcccatattttctttaatttattccatttcagagaaagatctttgttcaatgttttctgatgctttgtggcgtattttttgatgtatatacttcaactacctctgacttgtcatgtttctttccttatttccactgctggttccttttttttagttgttactcatcttttcattgggattaatctttggttaagaacataccctaaggaaaggagctaggataataagcttagataactggaaacttgacttctgttttaagaaaactttgtaactttctgtactgggggtatgtatctgctctgaagaagcaaaaaatatccatatgccacatatcctacatggaatggtttcatattcatttctcttttattggcccaagattaaaagctacagagtagattacaaaaaaatgtaataaatatccaccacatccatcttctgttctgtggtcatttctgaatataaacccctttagattttttttttttgagatggtatctccctctgtcacctaggttggagtgcaatggcacgatgtcagctcactgcgacctctgcctcccaggttcaagtgattctcctgcctcagcctcctggtagctgggattacaggcgcttgtcacaacgcccagctaatttttgtatttttagtagagatgagcttcgccatgttggccaggctggtctcgagctcctgacctcaggtgatctgcctgcctcggcctcccaaagtgctgggataacaggtgtgagccaccgcacccaaccccattttagatcctgagcactgggtttctccaggatttcatggggtggaggaaagcaataattacattgccaggtgccctatccatttcctaagacttcaagatccttgtctgtttttactttcatcatgaacttcaacctggatatttttattttcccagattattcttaaattgtttggtctcctaatagttttcacttctgaaagctttattctctattcatctttgctactgtagtattattcttgcttttacagttattctgacatcttgatggtgtttgaaaaatatgatgaagtgtcatcaaggactcaattttccatcttaaatcaaaagagtgtccaatggatttatatattttctaaacaatttagttgattgacctatatgtggagacacagatagatattatttaataggcagggaaggtacattgatataacatgaatacttggctgtgtacaacttctcagagaagtaatgcatttacttttaaccacgaagttggtttctctattgtcagaaagaaagaacatcaaaacagccaagacacctgctgtggaaatgtctctttcattgatctctgaaatctctattttatgctgactttcataagaagtatctaatcttccatactcgttcacctgggaagctgggatgttaactgccaaaaacctgcattgcaaaaacaaacaaacaaacaaaaacaaagaaactgaagaacaagaagaagctccatgtggatcagcaagcaagggcagtgtgagtccctttctaggtgtacctcatgaatttgcaagaggaaatacaagccttgcagatggcatttcctttggccattagttttcagaaggctccctgcaaattctcagcagaggaaatagcaggaatgataagtctatttccaaagccctttccaacaaccttcagatttcccgcattcagattgcacttaaaaatatcaaacgacttgccagtcttttcagcagccttctaaatacgtttctgttcaaagaaataatgggagtgacaggctgagaagtcaggaggcactcgataaatgtttctatgaatgagcgagtgaagtgaatgaaagtatatgggcatgaacgaaaagcctacaaatgtgagtctaaatctgtaaatgatcaaaaaa

SEQ ID NO: 7490 - DNA, 868 bp, artificial
  synthetic oligonucleotide
tgagagtcgtcatcataaatatggtaattgaagtcatgaaagtggataattttattctaaggagagtagagtgagcaaggaaatctctttgaaatcaaaacaaacatttaagagttatatagaagagccacgaaaagaggtagagatagaatggtagaagagatagaaggaaaaccgggggagtagggtttgcaaaatcaaaggaaagagagtatattaagtaggagactaatcatctgaggtgaatgctgttgagttgccaagaacgaagaatttagcaatgtgagtgtcattgtgaccttatcaagagctatttcagtgaagttgtgtggggcaagcgacagattggagtgggttgaagtgaagaaatggaaacagaaatgtagacaattcaagaaatttgtgtttagtggtagcagtgcaattgttcagtaactgaaagggctaaagaatccagagtgttttgtttgtttattggaaatactagaagatgtttaaaagcctaagcaagaacccagtggagaaatattggttgaagatatagacaagcaagaagttaactgatagcataagtctttggggaaggcaagagggtatgggatctagaatataggtggagggattgtcttttaatagaaggaagtatttacctccttggtaacatgaaggaaaaagagaatagtcaaaatgtctacgtctaaatttggaggtagaattgtctctagatttagtggtggaattttggaggtagagttgagtaggtggtaaagcaatttgctgagattggagggaatgagaataaaatggaatttcgagaagataatttttagccaaactctctggatggaattttttttctagaactccc

SEQ ID NO: 7491 - DNA, 824 bp, artificial
  synthetic oligonucleotide
ttattcactaaaatggcacattttatccatatgctggttctttatccattgacattaacataatactacaactgaaattagtgagctattttgttttcagaaactctgatgttttcaactatgacaccaagattgaagaataatattgaaggccttttgtaattgcatctactatacatggctaaatgcagcacaaccagttttttgaggaatacttcttctgttctgcttacagacaactcaatagttcaacctacttcgtagagtttggctgcaacataaaacattcacatgaaacatcctcttcaaagaaaccattattatactagaaaagaaaaagaatctcaggaaaatagaaatggacaggaacttccttaacttgccaaacaatatctttgaaacatacaggtcatattattcttaatattgaaagactgaatgcttgttcttaaaagcaacctcaagagaaggataactattcttgccacacctattcagcgtagtattgaaagttttagatagtgaaataaagcacggctagaaaattaaatttatgcataggagaaagaaagaaacaaaacagtccttgtttgcagataatatgattgtctacatagaaaataccaaggaaaccataaaaatctcctagttagtaagttgcaggatacaagatcaacctacagaaatcaattgtatttttatatgctagataagaacaggtggatacgaaaaataaaaaacataatgccatttacaattgctcagaaagtggaagacttaggggtaaatctaacaaaacttgtaaagaaattacaagctgaaaa

SEQ ID NO: 7492 - DNA, 434 bp, artificial
  synthetic oligonucleotide
ggcctcattttgctttcagatggaaaaaaaaaaaaagtaaaaattcaacagtaagaccaggttgcaccaaactggacaaatctccaggtagccatattgggtggcatctttgtctctgggtggcgttttttcagacgggaagggcgggagtaaagggctccaagatagggattccttaataatgtgaagcacgactgccaccgtgaggaaatcctttgaagacacaatacgccattacagcgtccttcccagaaagacttgctgtggggggaagtctgaactgtgggaggtggcagacgcttgggctccaggctaggtcttctagctttctcctctaagacctgaagagaggccttaacattggtagtagcttggtgtagaaccaggagagtgaggggcttgtagtgaaccagcagctgccaggcgatcctggc

SEQ ID NO: 7493 - DNA, 991 bp, artificial
  synthetic oligonucleotide
gctctgagtgatgattagtcttctcctgatagcccataactcaaatattatgatgtaaaattcacagtacttaaataccaatgtaaagtcaatacatcttgtgttacatgattagggaataagagaggaaaaaagaaagatatttgcttactatatgtatatacacactaatatattcattaacaaaacaaagaggaaacattcataacatggctttactcaaaaatggcaatattatatatgacctggtaaatgagttggagcaggcacaattgaatgtggtgtctgctctctccaatatccaaagaagcctaccaaatattgtactcttttcttagttgtgagtgatgccaatgtgtagcaatttgatttccagactactggactcctaataacttctctaatgagtcaggccacagaatttgatgaggtttatctctcatgctctggcacgcaagtatcttactaaggtatctagagtggcttctactttctgttcgtcagctccattaagcatgatatcatcattgtaagtggattatgcaatgatttgtgtgacatcaggatgattatgactcctctgactatcttgtgaaagagcaagataattgacatagtactgatgtaagaaagaaagaaagcgaagcagtttctccagttctttaaaaggcagactccttattaccttgatagggatgggaggcaaagcatttgctaggtcagtatccacagagtgatgaaggagacattgactttccaggcccagagataaagtgtggtgaagaaagatcatactgaaagagacattctcgctgggtttccaggattagagaggagttcactagttgagaaccacgtgcatcttacaggcactgcgtcaatcctgtgcacagaattggaaaggaatgaggtgtctatgggaacagtaataagtttatgtagatggatcagtaagagttagggcatgcacataggctgggtttatatcttg

SEQ ID NO: 7494 - DNA, 497 bp, artificial
  synthetic oligonucleotide
ttgaacaaatctcatctctaggatctcatggttgggagggaaaataacgtcctttctgatatacagtgctttctttctactatatcagctatataatttttattttgaaaaattcaactaataatctaatccagaggctatgcccaatggaatgaatgccttttaagctgagttgtaaataccaagtttgtttaaatttcctgtccccactgtaaaattcttcttatttttgaagaatataaatagatagtaggtactcacagagatacctgccaaatgcaacattttaacatttgtctgccccgagtgctggcaataatgtgataaagtgcctatagaggatttgaaacaaataacattgactattattacaatgactttaacattctaaaaaaaaaatcaatgataaaatactcctcccctccatggcagacaactcataccatctgactgttgattcactgctgcacttatattccaggaactttaaagacgtt

SEQ ID NO: 7495 - DNA, 680 bp, artificial
  synthetic oligonucleotide
catttcattcaccatctatattggagatatttttgctagttgacgccagcatattgttaccttattctggtaatcataccccaatttctttctgcaaaaccacgacagtacccactttccgtctatgtgcttccagtttcagaatttcacctcttattcagggataacacttgtgacctggacttgcattctcttggttacagtaaatggcttaagaatgatacgggttcaactgattagtatcgtaggaaagaaactcttgttcttccccattggactgaaacaaaaaggatttaaagtcagaagctggggaagttatctttagaccttgaggtgagagcctgagaatgaaatcaacaaagttcatggtaaagctgagagattgcaaagaatcaagttcttatcacattgctttaccctgaatccagctgtggctgtaattagacgacctcttaacctctccattttgtaagtcaataaattccccctttcccataagcctgtttgtgttggtttttctaaaactgaaggagttcttacttttaaccaagtaacttctaggtcagcaatgcacatatattgctagccctaaggcagtcccacggacttctaacattcttgcatcatcatttcaacactgtgctgaaactcattcagaaattaatcctttccactcttct

SEQ ID NO: 7496 - DNA, 2227 bp, artificial
  synthetic oligonucleotide
agcatgccttcttagccattaaactatactgtccaatatatgcttcctagttacagcaagattgctaaagtacataccatggggagttacttaaatctgtaaaatcaagtcctggttttcaatggaattcgtaatctatgctaagcaacaggaatgtacattccatggataacaagacaaagtatgctcacgctcactctgtctttccttgttggataggctcagagataaatatttttgacatggatttaaggagactctaacctctcacctttagtcaataaagtgactcctaatctccttaatttataaatcagcagggactgagagggcaaatcctaatcttaggattttggtcagctgaaagtacagtttactgtactgtatctgggaaaatatactgagacagaaatcctgttaatgcttctaggtccgtggcaacatgttcccagaacacaagctcttcatggtctagagtgtgcactgccttttgcactttcagcagtgaacagaagcagcattactcttttaaaaaattattttatcctttttttttcaaagttccggggtacatgtgcaggatgtgcaggtttgttacataggtaaacatgtgccatggtgttttgctgcacctaacaacccatcacctaggtattaagcccagcatgcattagctctttccctaatgctctccccactaccgccctcccctgacaggccccagtgagtgttattcccctcctggtgtccatgtgttctcattgttcagctcccacttataagtgagaacatgtggtgtttggttttctgttcctgtgttagtttgctgaggataatggcttccagccccgtccatgtccctgcaaaggacatgatctcattcctttttatggctgcatagtattccatggtgtatatgtaccatattttctttatccagtctatcattgatgggcatttgggttgattccatgtctttgctattgtgaatagtgcttcaatgaacatatgcatgaaatatatctttataatagaatgatttatattcctttgggtatatacccagtaatgggattgctgggtcaagtggtattgctggttccaaatctttgaggaattgccacactgtcttccacagtggttgaactaatttacattcccaccaacagtgtaaaagcatttctatttctccacaaccttgccagcatctgttgtttcttgactttttaataatagttattctgactggtgtgaaatggtatcacattgtggttttgatttgcatttctctaatgatcagtgatgttgagctttttttcatatgtttgttggccgcatgtatgtctttatttgagaagagaagcggccttattttacatctgcagacactgcacagggatgtagcaccactatgacagtaatttatggccacagaaagaaggggaaaagatagaatgggaaaagaagaggaaagtagtaatttctgagttccatcactgtgctagatgtttcttttatcctctctcatttaatgaagggggttttatctctaatttacagataaggaaactgtggctgaaaaatgttaattgatttgctcaagatcacatggccaccaaatagcagagacgtgaatgacatctgcgtttatctgtctcagagcctgtatgttctcaaaactgcctttttgaaggagcctaagacctaaacaggtccaatccccttactttaaaaatagagaaattggggctcggaaagtgagtcaccttgcccagggtcaaaagtttcactaactttcttgtgagtatactctaggaagcagaatgaggaccttgccaatcgctgcagggccctatgcagtaagaaatgttgtccccttcacggagtgcacattaacttccttggccactagagttagagtacagtggaaacaacacaaagtatctgaatgccctttggaaatagtttttcactgcatcatgataaacactttccatgtatgactcacagaccagtatcttttcctgaaaagatagtgtgtgacttgaatcaaattttaagtagagagtcctatttaaactgaattcccaagctatggacatctctgaaagaccagagcatgcaagttagttctcgctcccaaactggaagagacatgaatgtcaatgtaggggtgccccttcttatttctcccactcctccgagtcaaaatgtttcatgcaaacag

SEQ ID NO: 7497 - DNA, 1388 bp, artificial
  synthetic oligonucleotide
tgtactcataaccttgatcccatactacctcctcatagccacatggctcctgtgcctggcaccatcgtctggggagcttctgtaaccacatgccaactcactgtcttggctagctgactttcccctttatgcactggccgtttcacatattatcccaggagaagttacttaaccttgctgagcttcagtttccttgtctgtaaaataggagtaataattatctcagaaggtggctatgaaaatcaaataggcaaacgtatgtgaaagtgttccaaactgtaatagaagggaaaggtatgatcttcagtttacagatgaggaaatgtaagctcaaagtggttacctggcttaaaaaaaacctgctggcctttcacctgttatttgagggtgcaaagagacttctgcccccattatatctccattggctactagaagtagagagccatatttaagaagtattaacttactttctattaagatgaaaacgttctcagtccagggcaacaaaaggtcacaacatggatacattttgataaagagaggtgagaacaggcactgcctgggggagtactgacttagctgctatccacagaaatggactttgggtagcctagccagaggacccagggtcagagtgagaggagtgaggggaaggcagagactctgctccaagaagtaggagagcacaaggactgacaagcttcatcattttatgacccaactacccatattaccatttaaaaccacatttaatcctatctccatttttcaacaatttttcaattgaaatctaacatgcttacagagcaatcctatctctttttttaattgagacataatttgtgtacagtaagttgcacagatcttaaatatacagttcgatgaattatgagaaacgtataaaactatggaatctacatcctcattaagataaagaacatttccatcccccataaattttcctcatgtctcttttcagtgaattcttgcctccagcttataaaacagcttcttatattaggttggtgccaaagtaattacttttttttaaagttccagggtacatgtgcaggatgtgcaggtttgttacataggtaaacgtgtgccatggtggtttgctgcacctatcaacccatcacctaggtatgaaatcccgcatgcattagctatttatcctgacacatagagcaatcctatctcttcatgtgtcctttttcccttcctctggaggtttctgaactctccagtatctttcatttttcttttcttacttcctttccaaagataaggttagttctctgtgaactagatggtcactcttgctctttcttctcttctgtttctttttcatggtttgtccagaacacatacagtgtttcaattagggt

SEQ ID NO: 7498 - DNA, 2236 bp, artificial
  synthetic oligonucleotide
gtagatgtcatgttgcctgttttagagtaaaaatatcaaacgaaaagagaagacaacatgaggaaaactatgtttttcttttaaaaagctcttattgaatgaaagctttataaacaacatgtagctctttataaacaacatgtagctgctttgtgataataggaaaaggtgttttgaacaacagcactggtcagttaattccactcatgacaatggatcattacagtgaatcatactttttcagtaatctctctccttggaaagcactgaaggcaaagttgattcaaaactattatagatcttatcacttttagaacaaacaactcactaaaaatactgtgaccaaatgatattaacaattagagtaaattaaaataaattcaaagttattatagacctatgatcctgcccatgaggcttgactgttagttgtgatttaaaaataaaaaatactccaagtatagataatgaagcactcaactttgcattcctttttttttttttttttttgagacagagtctcgccctatcacccaggctggagtgcagtggtgcgatctcagctcaatgcaaatgctgcctcttgggttcaagcaattctcctgcctcagcctcccaagcagctggcatttcaaatgtgctctgcaatgcccagctaatttttgtatttttagtagagatggggtttcgccatgttgcccaggctggtcttgaactcctgacctaaagtgatccgccctccttggcctcccaaagtgctgggtaaacaggcatgagccaccgcccttggcctctgccctccatttcttataatcaatataggtataggggttagaggccacactctctgggttcatattctggcttcacccctgaataactttgttactttggcctgtaagattgtcacatttagcaaataaaaatacagggtggccacttatatctgaattttagatataattttaaagcataaatatgtctcctgctgaatcattcatttatctaaaattcaaatttaactggcattatgtattttatctggcaactctaccttggacgagttatttaatctttctgtgcttcagtttcctcatctctaaaatggaaatgataggatgatagtggtacctagctcatgaagttgtagtgagaattaaatgggaatatatgtaaattgcaaccatgcctgacacacagtaataactatatacacgatacctattataattaactaattcctttatttgaattaattcaagtttggtggcttgggcttctgctttgaaaaagaattactttatatctcatatgctacgtgcagaaccaaagtagagaagtgtcactgaagcattttgctaggtatactcattttccataccttacaattttactaggaaacatattcaataacccagcattttacaacccagaaacagtttcttctgctattgttcatgtaaatgacctttccatacagcaataaccttttaatgcttttagagtctggaaaaaataggaaaatgtatatttttaaaaactatatttcatgaactaaatccatccttcacaacatagtaagcacccatttctctatatttgcatagcaagaatctgtatattgtcagatgctaaagttacattaaaatttaagagctggtacatttcagtttcttgtaacacttgacaaaaacccaaacacataataaaatgcagtgtacaaaacatttaaaatataatttatttgtatctgctttcatgatctcatactgtaaatgtctaccactattttcacaatttatatggaaagcatgatttatctatgttaatttcaagttggcatttagccatttgaatgcttaccttcacacatggtaaactataagaatgtgtgaagtttcataaaaggtcaacagcacagaaagaatggaagaaccagaacagtatgaatgatttcaaaaaattggaggaatattaactaaagttgctatgcactttcacagcaggcaaatatcatggttttgccagtaatctgtgctttagattgcaataaattgttcctgtttttctttccattgtagaagacactaacttggcttcgtgaaaccaggcatgcatgtcatctcccacctcattttcttttgagtgtaggaagggaaatataatacaaactcttctggtgcacaataatctattttacagttgcaagaaagaaaaccataccagaaaagctggc

SEQ ID NO: 7499 - DNA, 8653 bp, artificial
  synthetic oligonucleotide
gttattcaggagaattcggaagtcacacagttttaatgtttaaggtttaatgttccttgaccaaggtctgattcaataggtttcttcttgggatgctatgctggaacaatagcaacgatacatatgacatctgcaagaactatcataacatggtttccaacttgatgtccaatgagagtaaacagtaaatttgaggtatcatctatgcttttattaaaataaaaaatggcccttgaatgttgtacttccaaatatcagtagactccgcagcctgaatcaaaatattcccatcactggatggtgagcttctagaattacccagataattttctttagtttcaaatactcaggtaagtatatcaatttgccattatatttcatacatatatacattttatccatttcatcatagtcactaggctcaaaatgtgtaagtccaaaatgtgaaatcctacctttaaattttgtaaagtagaataagaggtcaaatttatcatgatgagttaacatatttgaaggctaggtaatgcctggtatattagaacatgctcagtaattaatttttttaaaaaatcattatttttttacttaaagttattttctgttcaacactatttttcattaagttgtattcacttttagggggcagatgatctatggttcattacagaggtaaaataagaatactgctttgtttctattacccacttgatgtggctcaatatcttatgagtcttttctttatttggtcccagccacaacactgagctaaaatcttcagagaacaatgattttcaagtctgtttcttggttagtagctcctaatgcaaaaagtgcggagcatggtttctcaaaccttatcattattgacattgtggactgaatagttctttcttgtggggactgccctgtgcgtcgtaagatgtttaacagcatccctggcctccactctctagatgccagtagcacctacctgcctatttgtgatacccagaaatgttctccagaaggcataattggtcctagttgaaaaacatgcccttatttcactgccgcctgtattaaagtttggctatttccatctacctacactttagctaagaaccagtcaattcagtaaatatttgtaaacatgggtaaagttaaatatttaatacaggttgagcatccctaatctgaaaatctgaaatctaaaatgctccaaaattggaaactttttgagtgctgacatgatatcacaagtagaaaattccatacctgacacctttgctttctgatggttcaatgtataccaactttgtttcatgtacaaattaaaaatattgtataaaactatcatcaggctatgtatataaggtgtatctgaagcataaacgaatttaatgttcagacttgtgtcccatacccaagatattacgtatatgcaattattccaaactccaaaaacatccaaaatctgaagcacttcttgtcctaagcattttggataagggatactcaacctgaatagagggtatgacaaatgtcaggaaattgaaaccaggtgccaaatgtaaattattaagttttgaggcctcaagaacactgtctaacttgaaattcactaaccttacctaatctgtgtataatgttactcaaaaccttacctaatctgtgtataatcttattttatttatatggttattaagtattcacagccattcagatcacatcaatcaagcaggtaccaaatcctttctgaggtgctatgttacactctacgtgtgaccaaaaagcataagttgtgtctctcctcaagaaacgttttccattaaactacgggaatacactgtaatatattttcagactctgggctgacttttttttttttttttttttggagatggagtctcgctctgtggcccagggcggagtacagtggcatgatctcagctcactgcaacttctgcctcccaggttcaagcaattctcctgcctcagcttccagagtagctgggattacaggcacacaccaccatgtccagctaatttttgtatttttagtagagatggggtttcgccatgttggccaggctggtctcaaactcctgacctcaggtaacctgcccgcctcggcctcccaaagtgctgggaacaggggtgaggcaccacgcctggcctgggctgacaatttgaagtaaaatatttaagtttcctttgtgtgtgtgtgtaacaaaagcgtacttgaatttcttgtcattttatttaagaatttgagaaataatccagttcaaagtggaaaaaaagtttctaatgctcataaaatttgaattgttttcaaatgttgacaccttcacaagatttaatttatagatacacacacacacacagacacagacacacacacacacacacacaggaaaaatcatttaaaagcccacaagcaatcccatgtaaaaactcaagtgatctctatcaattataacaacaactgatgctttatttaatagcagtaaacctaaataaaggctaaaaagctcactaagatctcaaatgcaatgtctttcaggaaatgtctcaatattccaggtctcagcattaagcttttattcttccacatagttacataactctggcccagaatgatgtcagagaaagtcatttctctgatatgcttaatttacttatctatcaaaattatacaactggctcataagtagttgtgaaattaaactagcaggaaagaattttggagactaaataatgaaagatgtaacacacaataaactgaacaatttaaatgttcagtaagggcaatgcctaggggtttaacctgacatcaataaaatatatagtgtatacattatgcacctagtaacctcagtggagaattcaaaagaagttcattcattcattcaacaattatttattgagggcctactacatgccatgaacctagtctctggggatacagcaatggacaaaatgtataaaaagcttgccctcagactcctgccatcctacctgaatcattctcatgtaagagaggctggatctctgccctcaaggacctaatatgggcacacaaaacaaatgaaatatatgaaataagaagaaagaactacagtgtgagcgctgctcacattggaggagtttgaaggagggcttggagcaactaggaagggtcaatggaggtgagatttgagacaggtcttaaatgatggagcttgattcagacccttgcgacttaaaagtgtgatctaaacatcatcaccatgtgagagcttgttagcattgcagaatcttgggcccagtccagacatgggagataaaaatctgcgcttttgagggagcaaaagaaccctcggatttctatggacattaaaagtttaggtggcactgcaggtttccggtcaggctggcaatgttgtgagctgggttggtgggaaatcgagactagattggagcctaacattaggttagaaatagtgaagggctggacttggggaactaggagtaaggaaaatgcaattgtaccttttatcatcattaaacacaaacagaaaccatagagaaagtagtaagtttatcaccagtcagagggacctgcgtctgaattcccagctgtaccacttcttaattgcgtgacatttcggtcaaattatttaacctggttgagcctttttcttcatctgtaaaatgaggggaaatcaataagactccagaaggcccttgtacaggttcagtaaggtattaataacacatagaaagcacttagcagtccctggcacaatgaaaataatatccattaataataacgatattgataagaattatatactattctctgaaaaagatttaaaaggaagaagagaaactatcttttaccactagaggccccccaccgtgtggtgcgtagagacccataacaaatttcaaggtaaggaacttcatcttcattttaaactggcactcgactattacttttttaaaaagtaattaaccccttacgtgttcccaaaggtgccttcataatgaaattcctgttactattattaccagtgttactgtcgctactgttagagtactctcaaaagagcctgtctccctctcctggagtagaacttaaaatggggcggaggcagggagttaccaaaaccactgcagtgtatgctgatttcaataacctgtactgctaacgatccaatctcatttcccaagcctctactatcctcattaatttttctgccgatgtaccatctgttttccaatttccctctgccttacacgtgcagaacttgtggtagagagaagccctagtttggccgttctgcaagggatagcccaggaggtagggggaaccttaagttgaagtcacctgaagcatgtttggggtcagggaactcggaaagcaagagtgtggccacagatctgcccagaggcgcgacccccagctgaggagaccagatggcgggaaaaagcgggggtccaccgactccgcggctatctgtaatcctacccttggccaggccggggagccaagaaagacttccaacactccccaagtttcagctcaagtcgtctccgaggctgcgtgtgccccagcctcgcacgcctccctgcaacgtggccgcatctggggcgccctcataccctcagggtttcccaaactcttccattctcttcccaggcccagccatgtcccaggtctccgggtccccgggttctcctctccgcgtgccgggagagtctccagcttctcagactccagcaaccccagccaaacctcttcgctgcctggagccttggctcccgcgacaccgcccggctgcggggcgggggcagggccaacggcggaaccgcccccaaccgcctcccaggccaggcgagcaggcgggtggctggggcgcctccacctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggtagactgagtcccagggagctgcgccgctaacagcccacctcctagccccgggctacgcgccgccagcccagtaaccccacttttgtgtgtcctcccaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcaggtgaggaagcgcaggccgcccccgccgcccacgtgactgcttgggagcccggtgcgccctcggtgctgggcaccggcgacaagggacggccccagggctcccctgagggcagggccggtcactatggccaggtgacctgggagtagggctggaggtgtttcctggtgtgtaggctaggtagtgctcttcgctgggaaggcgaggcgggactggagcgcgcaactaggtggagattgagggcggttgggggtataaaaataggccagagccacagacacctgcgcctgctgagcttggcacggttggggatgggggggcggaacttaacctgggagagatggaagtgccttggaatttgtggggtataacgcgagtagtgagtgccctacaccccccaccccaaacacacactcaagttggggcggggcaacaccaggggtggcggcggcggcggcttgaattgggctcttcctgtgtgcgtagggctaagagagaggtgacctctttctccctttcggtactgctgcttaagggcaaagttgtagcttgctccccgacctagcccagcccatagtgtggcgtgagaaatgctggttctgttcagagtcactgaggtgatgacttctcagccccctccgtgcctttcccacaagatgactgttacatgtggttaaaggaagctttttgtcttggacaagggactactgcatgggacccaacttgttactcgaagtctacccagcccaaccccctcccattatattttcattttattaaagataagctatgtcagaaaactttttatgctgttatgtttttaaatcggtgcattttaggctatctgctaagtgttatccaaatttactaactttttaaagcattcatgttctatttttttttcctttgctagatggcctaaacaacccatttaggggctaaaaccactgaagcctcagtctttcatgatctaaaatgtgaaaacaaacttttttgaagttcaaaaataaaatgtttatagtaaatagcttatatttctagtagaaatcaaagagctgtagactggggcctcaatttacttattgatacatggagtttttttttttttttcagtgttctcattttatgaatgtccacaaaagtgatttttaaattctttcccaaaatgggatttatttgtgcacctagaactcttggtgtgtcctaaacaccagacatttcagctgcatttagggcaagtctgggttgagtctcaggaagttagtgtatattaaataaagagagagagagaaagggaaataggaaatagtagggcttaaaaaaaaagattaatccactcaagccttgcaaaatgccttaaactttcttcctctcaggcggcctcccctctccttccctccttcttttccccacgcaccctgccccacaccccattcattcagttctgcctttgattgtatcaagggaattcatagttcacaatactaagtacagttttgctgtttgatctgggaaaaagtgacattttctcaccgtgctcttctttccattctgtggagagtaaaacgatgcacatgtgaagtttgtctctgagggtctccatgcttctcgctccattgtgtgcgcgagcctgcgtgtgtgcgtcagcagagtgagtgcctccagttcatcaagtttgtgattctggggaactctgtgtgctgaggggaaaatggtttctgatttttattttatttgtcttgaacttattgaatttatatggtttaggaactgcttgctgttcagtatttctgattgctccctgcttttaattatctgagttgcctatctcttgaatttttaaatcttaattaatgtggattcgaatgtgaatcatatactttaaattacaaattctgcctttcactctgtgccctctgagttgtgattactttgtcccacctaatttgagtagggcaaacatctcaacgttagcaaagaagagaggaatcttttttttttttttttttggtcattctcttcatcttaatgaaatggtaaattcttaacttcttatttccattttatttctaatgtagttcttaagcactttgtgcagcacacagttttttccatagttgaaaatgtacaataccttaataataaatttgatagcatgcagtgtgactcttgaagctagactatttttattattgttatgtagcaaaatattgcagatgagatgcagaaatctatcgtgagcttgtaaaattctcctagagttttatgaaggcgttaggagcaacttttagacctttagaaaacttcagttagccatgtgttcttgaaattactgtatagtgtttccacaaatcagggtgaggtagccgaccagcctataactttttaacagtttattttagagaattatgaagattgatgggaaaaatgatttttccagaaatacaaagaaaattactttatccacaattattttctccctctgaggagagacgtgaagtagaagcccagctacctgttctatcacttaagatttccagcattcctgactttcaaacaaagaaattgctgttgccactagtttaaaatagaaaagaaacttggagtgaagaaagaaaacccaggatttcgtccagttcaaactcttccttatgaattagttattcaaactcatattgttgatatttcttaatattgtggtaacgaacattttttgccacgttacaccaaatgttgagggtatgaagttttttgtacttaatttgtgcttacttctttagtgtgtaactagaggaattttccataccagtagctgaactcttgaaaatatttaaagtacaacttaaaaaaaaaccaataaacctgtttctttccactcaaatatttactctttaatgattcaaaccctgttttctttgaagttttcagttataaatcatacttaagtttaagatatttccccttagagcctacaatagtatttttgaggacaagtttcatttagaatattgttgattgttaaatctttcgtaagatgtaggtggaagaataaagttaaatgttgagttagagtactaaatgttatgctttatgctgtgcctcttgttaaagaacttttaaagcttctgctaaagaactttaaaattagccttcatgtatctttaaatatgaccaaggtggtacagtttaaatctagttgtcatttgagatgagaagtagaaatgaagtttaacgattaatgatcactttattgaagacttttatctaagtggtgggaaacactgcccgacattggtgaacataatcactgggttctgggaagcatactgacgtatattacatgttccacccttaaagatcttaaaa

SEQ ID NO: 7500 - DNA, 1305 bp, artificial
  synthetic oligonucleotide
tcaattcaaccatcaatggggtttttttcaatttgtttattatggaacaatagggtgtctagccaaagaattaatggttgctttgaattatggaaaaagcttcccagtatcaacttaatgaagttttactgaatttgaaatccacaccacactagatgtgttaggaaatttctaagcatgctagtgaattactctaccaggtttcaatagtgcctggtaacacaatcctaggagtgaatttttggcaggtggaggaaatacttcaagaacatctagaagcatccagatttttctttgaaaatgcatttttgagttgctctgttagtccctttttaacccttcttcccacccccagctttccactaaaccatttgctttgggacatatcaatttacagtatattatattaagctaggtttgactgcttgatgcactatagtataaataacagagcagtgggtggtgggggtgggatgggcaatatagataatcaggtggagcataagctgttattaatgcaagacaatttaggggagctgagccaatagaaaccataaagtcagaatttcttcccaaagcctctgcctcatcattatcgctgcccactagagctgggaaagtttctaaactccctgatctcaatttcctgccgcctgccttaacttttagcagaagcacaaaagaaaccaatcagcaaagcatgcacacatactactaagtatggtgacagaaaatagaactttgacctgttgtggttaaagagactaaagtcaatgtatctgacagcctcagggaaatacgcatatttcaaatttatgttttttaagtgctactgaccccataggaagaacacttggcaaactcattaattaggatcctgtttgagtttctagttttagttcaaatcctttgtttgaacttagtggtgagctttcttatgtgcttgtcagtaaatggtaatacattggactttaccagcttggacagtggtgacccaggttttatgtttttacacacacaatctacatggtttgatttaagccagaaaattattagcagcaaagtttggaaggcctgctttgggtaggacagagtgcttgctgtctatctttgaaatacaaaaaatattagagagtccttgagctcaagaagtttatactctaaccagagtgactagacacctacacatttaggaatctaacaatgcagaacagtagtaatgaatcccaaatgagatagaatctgatgtagaagcatccatcccaaggaagactggagtaagaaaggaaactatcatttatagaa

SEQ ID NO: 7501 - DNA, 955 bp, artificial
  synthetic oligonucleotide
gtgtgtgtgtatgtgtgtgtgtgtgtgtgtgtgtctgtgtgtgtatcatttgctcattctggtttactctttctggactgaatcccggtatttccagactcactctagggcaaaactgaatccttgctacttttaggcacctgtgacaaaaacactatttttggttgctgacctaaaatattaaatacgccctatttaaaatggctattccataatatattgaaaattggtactgatatggtttgacaattttattggttgcttatttattcatattcaatactcccatggaaaatgagtgacagctctatcttcttttcctaagatttcatatagagtgttttttaagttgcacagtagtatacatgtactagtcacccagtatttacttaatctttaaataattaaaaactagttttttgtttgtcccaaattttgattgtaaagtgtactcagaccagccagtgctacaaaaccatcgtccaagatagcttcttaagggattaaatcaaattatttttatctccttcacccatcattaactaaactctatgatataaaacactactttgaagaacatgttgcttcatgataaaattgtagaaatgtgcagctggcttatgttgattatttgtgttctgaatctatttaaagtaaataaatctgtgtgtatatacatatgtcttgagacatatgtatatacacacagagaaagaaatattctataatcttacaacgttttcataccatgtatttaaatcactttcttaaattgaccaactcatttattttccatttatattacaacatagtatgactgtgtgggtttgtatttttttctaaactaaaatcacgtcaaatataacaggattctgtttcatgtagtcaacataagtcaaggccacatcctctttgtgccatcagggaactgtgttatcagtcaacttacatactt

SEQ ID NO: 7502 - DNA, 1402 bp, artificial
  synthetic oligonucleotide
cagtgtgatcctatcaatgttgagtttctttcccttccttaaaaatctttattaatatgatactatgttttaaaattcagtatgacttatgagaggcaacttagtgtagtagaatgaccactgggctggcctggggtgtttgaggttataggtctggctctgtgcctgtgaaccagacacaaacttcctggacgtaggtgttctataaaacaaagaagttgcactaagttatttctaagttcccttccatctttaatattatattttttttatttgcgtgtttctgccttagaaattatagagtatgctgtttctaagaaagtgttttgattaaaataatcaagtaatattttaattcttatttttttaggtggagatgagttttcctaactgaaagtgattaaatatttttaaaaggctttaaccttgactgccagtaactcaaagcttcaaataattttatgaacagaaatgactataagagattttctttcctttaggcagaaccatatttaaaccattttaaagaaatggtaattaaacttgatggagagcctcatctactactaggaattcatgtcagtttaatcagttgctgaatttggtaatctttccttgtgtctaatctaattcttatatcctaaagcctgagttcattttttttctctcgtctctagtgagagaacaccactgatgtttctttgtgtaataatccttcatgcatatggagtcaggcttcattctcctcttgaagttaaatgatctcatttctatttgtcttgtcacagagtcatattattcaatagttttttcattagctctacaagaagcctctcaattgtttcatgatcctccttccattttttgaatattaagagccctttccaaatttatcagttgtcttatctggttcctcagggtgctcaccatatctcttccccattttggaagcactggcaaagctaggccactctgttcaacaggatcactgatagcaatgttaaacagtgaacactggcctaaccccaaccaatgacccaaatctgtgtcccctattagtagtttggtcagttttatgaaatctccaagttaaatgattgtgagatcttaatctcatcctgctattctgaactctacttaataaaacaaatagccattaataacagtttcaatgaatgaaaaatgttgttagtactgtattggttaagaatcaaaaggcctaggtcataaacccagtgctaacactgactgcctggcaaatattgggcggccctttagcctccttgtgtcttaatttattcacatgttaaatgaagaaattgaatcagtaatctctaattttgtgttcttagctctaaaattcaataatattgtgatttaattataaaactcatttaactag

SEQ ID NO: 7503 - DNA, 1894 bp, artificial
  synthetic oligonucleotide
agcaagaattggagttagccagcggaaagaagaagagtgttagaggcagaagagattagaaaacctggtttgaacaatgaaactgcaagcagtttggtgttgctaaaggagaaaatgagaccctggggctggaaaagtgggcagaagtcataccaaggggagttgttgtggcatgtgaagccatgtgccttgaaggtgaggtacagggtggggttaggagtagctggatgatattcagcagggacttgacaaggtcagagttgtgtcttagagacagcagcctaaaagtagttagggcactgctgcccaagctgtaaagtgcatatgaatcacctggggatcttgttaaaatgcaggttcagattctatagatatgtggtgaggcctgagaatatacttttctaacaagctaccaggtgagaccgatgctgctggtctgtgggctacactttgaggaatgatggtttaagggataggtggaggagggggtaaaacaggtgacaggtagtcaggttggggctgctataattcaggtgagagaagatggtagcctggattaagacagtggtagtgagaatacaaagaggtaaagataggagagatggctctgtaataggtgcagttggacttggggaggttaagagagagagagtgtcctagagattcctggtattctctttgcaggtcttacaggcttgctccccttttgccttctgctgggataagggtttgcgtccatcatcgctgagtttaggcttcattttaccgtctttcattcacctttatgcatcactttgctcatccttgacatttgtttctttaccaattggcccacagaccacatgcacaacaaggggctacccaagcagcttgcctcacttactctccatcccttgttactgaattctccccacaccaacctatctgagagtggggatgctcagaacattcctcaccaatgtgtgcacatatttgaacccctccttcaacactccgtagcctttgcacaggtctgaaaagaaaatcatggcttctcatatcaaaagctttctgctggcattaacttatgaaatctccttctgacaacctattttgttcaccagttccttttaaagtcacccacctgggccacgcacagtggctcatgtctgtgatcttagagctttggaaggccaaggcaagagaactgcttgaggccaggagttcaagagcagcctgggcaacatactgagaccctgtctctataaaaattaaacaattagctggacatggtggtgcatccctgtagtcccagtgactcaggaggctgaggtgggagcccaggagttcaactgcaatgaaatatgatcacatcactgtactccagcctggccaacaaagcaagattctgtctcaaataaaaagaaaaataaatataaaaatttaagtccagcacctggcattttctttttttaattttttaattttgtttttaaattttttatctatttatttacttattttgagactgagttataagactggctaatttttgtatttttggtagagatgagctttcaccatgttgcccaggctggtctagaactcctgagttcaagcaatccacctgcttcagcttcccaaagtgctgggactataggcatgagccagtgtgtctggccaaccatctggtatttttcttctggtcttttggtgaacctcagagcttctccatgtattatcccttttgtaacttaccccaatcacccactctggcactggcccagaaccagttccatctataatagtataagcacattgtcattcagcatatttgtggggacaactgtgaactagttccttctggctaatttccatcagtcttttactcttcaaatcctgaactccgaatagc

SEQ ID NO: 7504 - DNA, 1069 bp, artificial
  synthetic oligonucleotide
taggagaaggggtgttggtgggcacattgcactgccgagaaaagccaaccaaacagtatatatccaactgactgtgtaccaagatttctactttgaatcatgaagcatagtacattgtctcttatttgccctccaaccctggcttcctcaaaccccaatcccaaagtcagtatgcagctacaatattctgcaagtcatggatgccctcaattggcaaaacatagttaggtctttgagagcagatacattggaatccaccagatggtgacatttccaaacaaggtgatgtggagcatgactttgaaccgtctgggaggtccgaagtgtttactgatgccaaactaaaagaacgtttcagatgttggttcaacagtcaaagggcatctctaaaacccatgtagatgatgggtctaagcagatgaaaagaacagtctggtacaggctgtttaacagcagaaatcaatcattcgttctctagacaaggaactctttagctggtcaaggactaaacccacactccctgagggcccccagtactttatgtcttggagaaagagatacatgactaaaaactagggctgatgtcagagattgcagcaagaaagcaagttccaacatctatcctaagatcagcccagatgaggccccatgtcccgcatgatctatatcagtggttggcaaactttcagaaaaggcaggccacagctttatttagcccctctaatttaaggttgtgcatgccaggaataatttgagcatttgaggtctctcaactcaacccttcacatatgtacaggaaatatgatttcttaagtattcaaggactttcttttaaaattcaactgcaaaggcgatctggccaattttgtgtgatccctgccttgactttttcttgcagaatatcctcatggatgccttcacctgccttgacgaaatgtagcccccagcattcaccttccccctggcttatgccacactgccctgcaatttcccagggattagaggatttattttcaaaggccaagcccctggtattctcttttccatggcccccaagtcccttgtctat

SEQ ID NO: 7505 - DNA, 936 bp, artificial
  synthetic oligonucleotide
tgcataatggttgcatgcctttacttaaacttttctctctgcctggaatatcctccttctcaactcacaattacttaggaaaaggctaagggccagatcttctgtttgaagatgaggtaagagaggcaaacctatgcacctatgcgagagcttacttactcttgggggaagttccagcagacacgctgttggtaaattgcaccttttacatctgggctctggagccctatggcgtggtgaccctggatcccttccaggagctgcagggcaaagacaacttctgtggtgaactcttctggatgtgtgtcagttccgggtgaggctgcaaggctgccaaattctcaggctggatctcctgctggcaggctgacagtttctccatgccctgggtgccagcgttgtgaaggcttctgctgcggggttgcagttccccatagttccacagacagctagaccttcccttatcttagggcctgattcaaaaccgatgggtggataggaccattctcatccctactggctcctaggcacagtactccacctgcaaaagtgctgttgtttctctaaataacttataggataacttctctctctccctctctctcagcatttattcaatcaaccagtatttattgactaacacctatacagtaggcattctactaaatactgaggacatagcaatgtacaaaacaagcaaaaaaacactgccttcttttagcctacagtccagtatgggagacagacattaaatagaaagacctacaaatatttaattaatgacagttaagaaggaaaaagtgcaataaaggaaaaaagcaggggttctatgaaagaactgggtctttacagcctgatttgtggaagaaattacattcctcaaatgagcacaaagtaatggtttttcttgaccttttaagtttttctcctctattt

SEQ ID NO: 7506 - DNA, 1568 bp, artificial
  synthetic oligonucleotide
tcagaaatatatttgtattgaaggactaaggatcctcctgggagataatttatcctggaaaaagaaagaggtatacaaacttggcccagtaagaaagctttagtaactagaggggagggacatttctgagtagagcacagtggctgtcactcgagtttgtctccagacttagcaccacagattcaatgtctgagccttatgggtatgtaagaagttgtagtcaataaaaacaaaaacagctgttttacaaaaatattttgtcattatgcacatgcatgactgctttgggactgtactaattcattcatttttttcagtcaacaaatatatttatctaacacctgctctgtaccagatactgtgctaaaaacgctggggatgaagcagcaaacaaagtgacagagcttacatttgagtgtagcccccaaaagagaggcattttctgccacatcctcccaaatatcatatacttggacatctataggcagagttgcagctagtctatactgtatctgtacaaattagaaaatggcacctgctctaggcagccccaaatcttggtgagggaacaatgcactctctgagcaggtgaattagaaataggtatgcatcttctcctctaggacagattcaactccacaggcatactgcatgacaggggaacacgggatgaatttgacaactccttgtcctctcagagagacatctcttgtgcagtgtgcaatctgtacaacagtccatggtgaccatggctgcaagtctccaaggtgtcaacagttgctctgggcacaagatagtgatgcccagcactaattttggtggtattttagaaaagctactactaagggaaactattattactccatagaagtaacagcagtttctactgtgaattacagaagccagcagaggcagctgatatccagttgatgtggtaccatgccttccaaatgcagcattacacagcgcaagtgtcagctctgcctagaaaatatagcaatgcttagatcacatgagagcacttagaggatataagctggagcacaataatgggagaaagaaaacacaaaatccatgtacttattctgacactactcattcatgaccatgtgtgagaacccccctaaaaacacccagaaaaaatttattgtggtacaaacccttcgggggataaaggagaaggcaagaactagaaaatgtgtgtgtgtgtgtgtgcgtgtgtgtgtgtgtgtgagagagagagagcgcgagagagcgcatgcatgtgtgcaaatatgtgtatgcacaggcagcccaggggcttctctttgcatttcacataaaggatagagtcaaaatgtgtagctatagctttccagcctctccaagaagaggggtagttttcccttgcgtaaaataaaatccatttgttcagctatgcagaaagagttttcttcaatattggttgagcgattgaatttagatccacagtactcaaagtactattgatagcaatattaggatatttatatctagaatcttaaggctttgtttagatttatgtgagttatttgtatattaagaatatc

SEQ ID NO: 7507 - DNA, 1727 bp, artificial
  synthetic oligonucleotide
cttaaaatcctggtgatgggaatataagcaatttcttatctccgctttgcttatctgcatttaaaaaaattttcttcattgaatgttgactattttgtgtgatggaaaatgttattttaaaaataaagaaatttaaggcagtgccatatgtattaacactaaccagctttttgttttacttgatcaaaaaacaaaacactacctgattcatacagttccatcaaaaactaacctgctcggtatggccatgattgaggttatcttctttactggacgacacaagttgtacaacactgatcttgcttctccggcagggatgaatagttcatttgcctgacgatctcagcaaaaagttcatccaccattgatttactttttgccgatgtctccatgaaaggacagccccattcttgagccagagctctgccttctgaagacataacctctctttctggttccagatccactttatttcctactaggattagtgggactttttcatatctcttcactctgacaatttgatctctcattggcttgatatcctattcaagcaatcacaaagagaaagaaaaacattatgctgtttgtataaccataacagaaatattacagtattacaaaaagtcatacctcagtgagtatacaaagctgaatccaaaatgaaatcacacctaaacagagaaatcgtcatcattttgtccactgaagtaagaactagataatttccagagaccctacctgctgggtttgtcaagaatataaaacatgggttgcacactaaccttgactcatataatcacttttacccacccccagtctatactgattaaaaaagcaagtttccaaatgattaatccattcgtacataaggatgtttggccatctccctaaacctgcctgcttgtcatcactccttgtaacacctgttatcctagcacaggattgcagcatctatgcattcctagccatgtagcaagagggcttgagtgaaagtgttttaagtgggaaaaaaaaccactttgtaatgcctagaataaaagagttacaaccagatggatacacttaaatgttttattttaaattgaatggtatgcatttattccagtaaaatcaaacaccttacaatacacttaaattcactagaaactactgtaacagtgagcaactcctgggaaggacagtgcaaggggagtctgggtgggaagaagtcattttttttttttttgcctgtgtttgtttttactacttgtttccccatgcgtattactttttccaagtagttacaacgaattacaaaagataagagcgttagcaattctccagtagcatcagttttgggaggtgggggcaagtattgatttaatacaatattatagacttaattataaaaatcaccattttcggtaatatttcataattttaaaagtttgccttaaatagaaaatgtatgcttaattggaagtcatagtaagtacagaatattcacatgtgggcctacggaaaagcaagggactatgaaaatctataaaaatatagttatttgatatttgcatcaatttggtttgataatatatcaactcagatttctaggttacgcttatttcccattgtctttatggaaacataagttcagctgaaaatccaaacttagggcatttgggctcaaaagagtttacacctccactgaaataacggcacagtttttcactcccaattcatgtcta

SEQ ID NO: 7508 - DNA, 1926 bp, artificial
  synthetic oligonucleotide
ggaaagggtgggggctgcggcgaggggaccctgcggcgaggcggacgtcggaggagcccgcagcccggggctgcccggcactcctcccccgcccttcacacaaaggggcccagggaccccgcttcctgctcgcgcagcccagccggctcaggcctgagggctccgttccagttaccgctgcccgggcgggtttctgggccccggctcccgcgggggtcgtccggcctgtgaaggggagaaggacgcacattacccggctgacccccgccccgaacctgcggcgccggccgccgcctcccccaactcccacccggatcaagctactgccgcttaccccgccgtccgcacccgcccggccgccggggaggctctgtcacgccaaggccatggccacccgctggctcctctgtctctccgctgccccagcgctgctgctcgccgcggggaaagaagcgggggccttccgcggcggccgcagggactccaggcgaacccacctcttttttttctcacccaccccccacccccacccccacccccacccccacccccaccaagcacacacccggaagggtttccctgacacactggctgaggtgccccagttccccgagactggacgggatcacttccggtggggaaagtcccacctcttcggggcgagccgggtggcgctggagccgcgccctgctgagcgagcgagccggccggggacggtttcgggtcgggactccggcttcgggaacgggcctctggaaacctgcgacgtcagtccttacccgcccgcggctgccgcggaccgtcccacccccaaacccgtagaagcccctccgacctgcaacctccagccgcccggccctaggacttgagcggctccctggccggtgcggaacctgcgggctaataatctagcgaccgggagaacgccaaacatccctggactagaagttgcaggggaaatcaaacagcccagaaagtttattctccttgctggtatttcttccacttgctattttgctgagagatgcatgcaaactacccttagactttcagatgcagtgcgttttacttagccgtgcctgacaaacacacagaacttttaccgtctggtagatccgccttgactttaccagcgaatactaaagtcacttaaaaaaaaatcacaaggctcgaaaacagcagcattagaagtagactttatggtactctgctcagctatgttctcatttgattccaaccactacacggcagaaaaggtaaccaatattcaagaaagatttgattggaaacggtttaggcctaaagactaatttattttaatcgttgattatgtataacaatttgcttggctggctcttacatgctgaagttttgttttaaaggccatcctatgtagtctttgaaattcaaaagcaagtagtaactctggtgttagattctaagtttctatttttagataaaattgttacttccgactatctttccctttgctagctttctatttgtaaactttgtgtcggatccacagagccccagggccaggagtctaggctgtattttaggtgtgtcactttcttttcaattcaagcatgtacccagaaacctgcgagactcagtggccagcctagcaaaaatgactccaaattcccttacttacaagccctaaatggccaaactctataaagagatttattactcagcctaaattgttggacattagaacacaggcgaatcatagtagtgtgaggtcccactgtccctccctgagtattccccaatgtcacttacagtcttcaaaggagagtttagttcaatttctccttgacctcaggccggtgccatctctccagcgaagtccccagctctggctccagctggcctgggccctgtgtcgtatcagaggcactgccctctgctggaaggggt

SEQ ID NO: 7509 - DNA, 1235 bp, artificial
  synthetic oligonucleotide
aaggctcaaagaagttagtttgtacatagtcgaacagttgggtagtggtagagtttgaattcaaacctaagttagtctgagcctatcttatattagccaccttgttccacagaaagcagttttgtttctttgaaggacagggcagcgaatgggcagtgaggcaaggttaaagaatctagactttattaccctgtttctctgccctcgagtaagactgactgttcatactgatttcaagtgccctctggaaacatgcctctataacctcccaggggccccttgaccttggatctgtggcacctggtactgaacctgaggtggtcatagttactttccaaagtgctctggaacatttacaacaaggagcccccttgttttgacactaggacaatattagactctgtaagaggaggcattggggtaagcctagttatttttaatgctgctattactactattgtttattgagcacttgccacatgtcagaaattctgtacttcaatccttacagcaaccctataaggcaagcacattgtcatcatcatctctagtttagagatgaggaaactgaggctcacacaactaagttcacacagccggtagatgcagattcaagcagaaaactcgttcattcatttttacaaaccttgcattttcatttcttcctttgcctctgtacctataacaccttcaaacacagatgtaatcctcctgaattcttttactgcccacaagttttatttaccacatagtttaagccctatttttaatgatgtatatacaaatcgtgtttctcctcaaaattatttcatgccataaaaagtcactcttccctccctttatttacaaattcattcctctttagaaatgagcacttataataattacatgcaaggccaaatttttactgtttagtgtaaacccataatgtgaaattgagaatggttgaaaagcacggttatgaaaacatcgtggactccagactcatcccatacaatttccaaggggaatttattctaagtactttaaaacttacaaagagttgaattctgaactacttgggcctctatgcactcttagcaattcccccagcagggaaccaaaaatgagaatagaaagaaattgcctcaacattgaattcttagacatttagaaggcctggagtctgaatactttaaaaggctgttatttaaatgtgggaaatgatgtgaaaagtataatgtaaagataagata

SEQ ID NO: 7510 - DNA, 638 bp, artificial
  synthetic oligonucleotide
aataattggcataaaaataaatcagtataaagagaaacagggtaaaaatttcagatgccagagataaggcattcttaatcctgtccaaaaattgatattatgggaaaactccccttgagtttcagtttagttcactatttgaaggtggaaaagaaatacatatggatttggttgggaatttgtttacaaaatgtttgacacttggataaaagctgaaaaaaatctatcaaaaatctaatgggacatgaaacctgttctcaagtagcttataacatagttgaaaagataagacttccacacttggcatcattaaagcttgcaatgatgagtgaaatgcatataacttagtgtaaacctgcatgatacagacacgcatcaaaagctatggaaattcaggaaaagaatcaaaggattaatgaggagctcaagtcttaggaaaagcttcatgaggtatgtgtgatttatgtagactcagaggctaggcacagtttggctgcacagaagggagagagaatgagatattctgattgaaaagggggaagaaaaagagcaaaagcatgagagatggaatgaaattggtgggcagaaggcaaagaaaaggtcagactacctagggtagagtatgtgacaaggctggc

SEQ ID NO: 7511 - DNA, 585 bp, artificial
  synthetic oligonucleotide
tttttagtatattcacagagtttggtaaccatcaccacaatcaattttagaacactttcatcacctcagaaataaactgtgtatatagtatattttatttaacaataaaattgttaaaataaagaactgggtttgggacgtgttaagtttgaggaacaagtaggtccttaaatattgggtaggtcattgtatacatgagtctaagaattcagtggggagatccaggctgaggaaataaatataggagggtgtttttcatctctttaaactctatttcttctccctcattcctagtgaagatggagcttttagtgtaatgatgtgccaatagcttgctattaagaactcagtattggcaagaagaaaggtcttaagagtaattcatgctgaaggctccaaaagacatcaaggaggcctctaaaaagccattgaatggaaggatctaccataactctacaagaatgatgatttctcagccctgacatttactaattgtttcctaggattctattcataagttccattatgagtctgttacacatacctctttgtttttattttagggattgctgtaagatttaccat

SEQ ID NO: 7512 - DNA, 2170 bp, artificial
  synthetic oligonucleotide
tctctatgaagggaaattggagcaactcagaagaaggtttcagcatatacaaacaagtgagacagaatgtgctgtttaatgaaatagattaaatattatgcagctttaaagtatgcagtttaactcagtgtgaaccagctacaatttctagcaacagctgagaagatacaggaaaggttaatttattggcatatgccataaacacatactgaaatagcattaacgcaaaagtgagctctgagtattagaaaaatcaaataactgttaacttcatcaaaaagtgagattaaagttcttaaaaatatttcatttaattttttcaacaatattttcaacaattttacaaaatctaaatcttctctttgtcttttccatattcaagatgcaattaagtatcacctgacttttcaaatatcattgagaaattaaatacctagaaagttcaagcaagcttatctactcaagagcaaaacatgtttttctctgagtcattcttcatggaaatcattctaaaatgtattctgtgtaactttgccttcttaaaaaatatcaaacataatttggcctctaattaaagacttgggaccattaatgtattaggaagtataatagttctcctctttaagtggcagactgttgtcatatccactgtcacttctctgtcacaatatctaccacagtgaattttccagctctcttccaaaaaacctaatagccagtcatgaatgttgaataacaattagttacccactgaatgaggggcctgtggaacaagatgcagagctttcttgcagaagttctatgactgctcttacttctatgcaggcccttctgcatcaagttacatgcaggaccatgttctagagcgttgaagttgcaggcaaatgacttctaggaaaagtattttaaaaataacctgatgatagaaatgcaaaacaaaatcacaatgtgatgaccactctcattagtctaactataattttaaaaacagaaaaattggagaaatttgaaccctcatacatcgtggctgggaatatgaaatgttgcagttgctatggcaaactgtctgacagttcctcacttccgcaactcagtatatacccaaagtatctgaaaacaagtgataaagaaatcctcctacatgaatgttcatagcaacactattcataatagccaaaagtggaaataacctaagtgtccattaccagatgaatggataaacaaaatgtggtatatccacacaatggaatgttatttggccacaaataggaatgaaggactgatgcatgctaccagaaggttgaaccttgaaaacattatgttaagtgaaagaactctgtcacaaaaggccacatattgtatgattccatttatatgaaacgttcagagtagccaaatctacagagacagaaggtagattagtggttgccaggggatgggaagaggggataagggcgaatgactgcttaatgggtacagagtctcctttagggggtgatgaaaatgttttggaattagatagtggtgatgattgcatgatttttgaaataccataacccagtcactgaattgtacactttaaatagatgaattgggtaatatgtgaattacatcccaataaagctgttatgtattttttaaaaagtctaaagagacatgacaatcaaaaacagcctgactagtgatgggattagctatcccaagctttctgagtttctccttagccagagatttttctcagtagtgttactaagttgaatttcaagagtaaattcatttccacactgtaactgacttaatgtattatgaaaagtactctgaaagagtatgatattccaacctaatcccacaacccaattatatagtctgcctgaacacatttggaaggaaaatgacaaaaaagatctatctatctatacaagatctgctcaaaacataaacagtgagggtctggagactttttctacagaggtccatcaagtatagaaacataataaatgatacatgtgaattctgaacttttacaaatgaaaactgcaaaaaagaattggcttctggccatgcattttattcagagataggggaagaaggaattttcttttttctttttctttttaaaaattttggcctgtaacctatgatgaagccctggccaattcttcaaagcatt

SEQ ID NO: 7513 - DNA, 1020 bp, artificial
  synthetic oligonucleotide
ggcattttatattcattttctcatttaatcatccccaatatcctatgaggtacatacttttaaagggcaacattaaaatttcatttaaaaaccaaatcagtctttcacaaattttaattctagacttgttaccaaatcattgtattgagtttttcaatatttaaatttctcagaaatcataagagtcataaacaccaataaaaaatctccaagttctcatttcccccaccccagattcctgaaatgacaataagaaagcttactactccctacccatggaagccagagcatcctgaattgcttataatttggaaggtatatgttttcatacatatctggcaaataagttagaaactgcttgacatagtgggtttaaaatcatcattcaaaagaacatgtggtccagaaatctggcaaccagctggcagaagggaagcataaaagcccttgggcacggtaggtccttgctctaaaaataaaatttttctaccaaaaaaatggctatccaaatcaaagtgaaatctctgaaccaagatttggaaattatgaaaaaactaggaagctataatactacaacaagattgtcagtaccttcacaaattcaactctgttgctaacttgtaaatttactatatcaaaatctggagtgtgcaagtcataaaaagaaggcaaaattttttaaaaaaagatttcaccacaagaggttttcaggacaagatctgagtaagagcctacaaataaaacagggatttgaaaataaaactcaagggaaatactgaagtcaaacaagcaagcaagtctgtacatatatgttgttaagtaccaacatatatggaaagtaagaagatatctatagattaagaatcatctcaaaaatcaactcagcttaaatggctaggcaaaaaagaaggaggtgaaaaaggaggagatggaggaggaggagtcatggcttaaatagtaatttaaagagggcatttacatttatactgaagtgaagagaaagtccatcaaagttgatgg

SEQ ID NO: 7514 - DNA, 3928 bp, artificial
  synthetic oligonucleotide
atattatcagctgagctgtgggcagaagcccattttagtctatatttgaagaagtgttggtaaatatgaaagcatcccccaaaagtatcgcacattagaaaaaagttaaaaattattttaaaaagtagttaaacattcaggattagattttcatgggccaaggagaagatggaaatataatcaggaaaaatccaaggtgtctgataagcctcattgtctatttacctttcactggagggggaaacaaaacaaaacaaaattcagataaattgtatcaagcatggatgtttagtcattcccacataccaacaatctgttttccaaacattatatcagtaatcacccaaacgtttattcactaaagcagggagtccgcttaataaaaaaagtaccaatcacttcaaaattaaatcttgcaagttttgttttaattgattctttcccatgaagtctacccacaaatacggagaggctgtggggatcccagctcaatttacaaacgatgtaagaacatctaggagaaaataactcctttaaaacatattactttaattagagccacaattaatttatctgttttatctatcatctagctagctagctagctagctagctatctaagagtgctcagaaaaacacacagtaggtctattaccctaattatgaaaccacaacaaagaatcacttaaatgtcaactttcattactcgtctgggtttaatttcgttttcttaccataaaagcttattgtgtgagtgttaaaaactaaagttccctttttaatagtctcctaaaatctactctcatgcccttcaaaccccagtagtaaaagcgagctgcccaaacgtgttgactcagggcaggaagagacaaggttctgcaaggaagctgtggcactgctcacgatatcgcgtgaaaatggggaaattcgttgttaaaaagcatttgctgattatatgccatgcaagaagttcctttaaattaaaaagaagaaagtagaaaaaaagaaagaaggaaggaaggggaggaggaagagaagaggaggaagagaaggaagaagaaaaaggaggaggaggaaaggaggaggaaaatgatcaaagctctaaaatcgcaacaaagttgcaggatgacttttcctcctatttgctattttgtaaaatgaagtttaaaaggcattatttcctcggcgtccgaggaaggcagcctctcttacaaatcccaattcatctccagccttaccttacgctgctagcgcaaacccagaggctaaggggccctgctctcagcggcagcagcaggggcagcggcagcgacagcggcacatgccatctgttagcggcagaagcaaaagcagcgctgcgcgaggtggccccggtgccgggagagcctttagcaggggtgcatactgaatgccgccattttaaagcgaggttcctgaaatcattagatataagcaaattaaagcccgccccacctccagaacttcagggctgggacttgcaacccggctccaagtcggccgctctggggtataaaatgtcaagtctacagacacgcgcacgctgactctcggacggaggcgacggttccccctctcccttcggcccccttgaccccttcgtgctttttgcaagactcctttcggttccaggggccagaatactttcttttctgggctcctcgaggccccttcccggggccggccggcgggctgtgggaggaggggacaaggccacgggccggccctacccgctcctcccaggctcttggttcagtccactcggagcacacctcggagcgccccagctccctcgcggaggccgggcgtggggctcccgcccgggctcgcagctaccatagcaaccccggtcccaaccccgcccggcctttgccaaaggcgtgccctcctcccgggccagtgccctccgccggacgccagacgtcccctcgcgcagccccgccgaccccaggcagcccgggctggggccgcgcctccgtgcgtcccgcgccggacagacgcggcacgcggagggaaacggcgccagcgaggggctttaggcgccaaaacggaaactcccgcgaaactccgcgggccagcggagcgcgggcgggcatccggagcgccggactcggaagcggcgcacgcggccgcccggccccgccccgcccggccaggtagcgcggcgccgccgccaacctcacctggctccgcgcgccgctgcgggacgggcgggaatgcggccaagggccgccccggctcccgcgcccaccccggactctctggcctccgcctctctctcactgctcccaaagagcgccaaaaagtcgcgctgcggctcacgctcggagtgcgggcactttcttcctgtagggcgctgtttcgtcgcgaaatatattctttgtgtggttcgctcactcgtgcctggttctccgagagcgcagcgcgggctttattctcagggggtgtggcgcctcgcccccaaacccagcagcccagcccccgctgcacagaccctttgtcatttcattaggaagggaaagggggacaaatcataacgctcagattttacaaaagcgaaaacaaacgaagcaggcacacatccccagaggcggggttggggtaggggtgcaaagtttctggctcttcaggaactgaagtgccagtgagaaaggcagtgtggttcacagcgggacgctcatagacacttcccagacaggtgaggcgaaatgggtcctttcaaaattgatcttagtcgatgaataagtccactcgctacaggctaaataaatacattcatactcaccagctgccttcttgggggttttatctttcataaatgccccaatcgtttatttccctctaagaatttcagacagggaaatgctgatcagtgcaatctgttccccttcttccacggagtttgcaggataagaggaaccctgaggtaaggttccagatactttggaaaatggacaaagcaaatgcaattttatatcttgattaaaaagtgtgcatctgcacagggaaattacaagtttcgatttaatgcaagtgtaataggagcaccagctgtcccttaattggagccccacaataataaatgcgtgcttttatttaattttacgaagacaattgtagttgataacgcacacatatgcaggatcgtcagtgacaagctcatagcaattcatggctgctttcctgtaatcagctacttcacccagagacagagttctacatgctctgcacaaagtgcaaaacattgcaggagatatttaagcagcagttaggttgaaaagtggagtgaattctcaggctaattatactttttaattctgatggactgatccaaatagaattctccagctaattttaggcaagaaatcaatctgtttgttaagtgcaagataatagagtaggatggtaatggctgggaggacaagactgggtacaaactgcccttcaaataattgagaaaacccccgatggttttggcaagtatcgtgaaagtcattgggacaatgcgcagggatggtgtccgatactttgttatactgggtagaaacatagcataagtcaagagagtaggagttgctagttatttgagaaaagggggaaaagactctaattcctaaccacctcttcccaccttccttcaaatttgccgaattgcctgaactgctgtaaaagtcaaatgtgtctgacatacaggaagtggctttggcagtcccaagatctaccacagcaaaaagtaggcagtgttggctatcacagtcagctagagagaagggcatgggtgagttacataactttatacccaatgctctaacaaatgaggaactgttatcacagtgagtcaacaaaggagtctttatattaaacatagcttgggtcaacaccagctctcttacctctgtccaccattgcg

SEQ ID NO: 7515 - DNA, 2347 bp, artificial
  synthetic oligonucleotide
aatgaggataataatagtacctgctttatagaattattataaagcttaagtgagttactatttacaaagcacttagaacagtgcctgccacatatggagtgttgtataagtgtgtggtaaataaaataatcttcccaaggttatacagccattatgagaaggaggcaggacttgagcccaggtccaaatgcttcagtcctagcacaattcctacctcctccataaacctcaagtttgacttctcttcaaggactcgttgaagtcctgtatcccccaggaaacttacccagtccacgcctactttgattccctgcttcatatccagtttcagattgcctgcctaatgatttgaattcttcctgcacattatcttgtttttcaaactagttcatacacctattcttgaggagttcacttgcttattttcaccttccaaagtacctagcatttcttctgtgtattgagttcaaacactgagtggtcttaaagttttgagtacttgctaaatggctggagcatagtcatgggcactgcagaagcaagggtagatctgagcagagaggcagcatatagtattcaagaaagaaatgtatatggcagggcatagagttctggaatcatttggtcttatgtactcacattttccacatctgcccatgcattttaacagttttttgtttcatacctaaccaatggctgaaagaaatagacattctggtttttaactcattctatataaagttttagtatggtttttgtattttttaaacaattctctcagctaccatcttttttttattttattattattatactttaagttttagggtacatgtgcacaatgtgcaggttagttacatatgtatacatgtgccatgctggtgcgctgcacccattaactcgtcatttagcattaggtatatctcctaaagctatccctcccccctccccccaccccacaacagtcaccagagtgtgatgttccccttcctgtgtccatgtgttctcattgttcaattcccacctatgagtgagaacatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttgattccgagtctttgctattgtgaatagtgccacaataaacatacgtgtgcatgtgtctttatagcagcatgagttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccggcacctgttgtttcctggctttttaatgatcaccattctaactggtgtgagatggtatctcattgtggttttgatttgcatttctctgatggccagtgatggtgtcagctaccatcgttttaaagcatttgctgaagcacagttaataaaagaaagagaaacaaagacagagactgagaaacagagaaataacatggcaccaccaacgttcccataaaaacataattttctatgttatcccttcccaggcatatggcactgagtcataataaataacagtaatggaaaatggccaaatatacattggtatactggagctaagtacaaaaggagatatagagttatttttaagatacactctatttctaaaatgctttcaagccttaaatacactgaacagtcatatctttaaagggaaagaattgtacataagttctaaaaacacttgctgagatagtaaatgaatgtgctcaatttccctgatcagagcctttcattccaatttgatgtaagccataaatgaaatgacttggctgattataagtcagttccccatgaacatttgtttacatctgaaagccactacacataattgctgtctctgctcaggggaggtccagctgggattacaagaactgttgcaaggttctactgaggtgtcatcaccagttacggcatgaacctggcactgcatgtccacactctgtctgctttggcaattggatccatcagtcttcctccttcacacagctaaaattagctagaagacagcagaagtcttgggaaggaaaacatggggctgtaaataacattcagaccccaagtctgctttgctcctgagagatagcgtgtaattataccttagttactatgttcttccaaaagccagtaatagt

SEQ ID NO: 7516 - DNA, 1215 bp, artificial
  synthetic oligonucleotide
tggtctcttataattacttaagaagtgtttcctttcttcaattttatggggagtttatgtataattggtattatttcctctttaaatgtttggtaaaattcacaaggtctttttctggggggttccggagggttttatttgtgggaagattttttaactaaaagttcaatttattttatagctatagggctattgagagtatccatttatccttgaatgagcttttggtactttgtggatttcaagggacttgtttacttcatcttacctgtcaaatttattgaaataaaattgttcataatattttcttcttatgctactattatatgtggtgatatcatctcattctctatattaataatttttgccttgtttctttttttcctaatcagtctggctagagatttgtcaattttatattctcacagaaccaggtttaggttgcatccactattttccccactgtttttccgttttatattttattggttgaaacttgtgtctttattatttccttttttctatctactttgttttaatttgttcttttttctagtttcttaagctggaacctaagggcattgacttgacaccttccctcttttctaatgtggaataaacatccccttatgtacgttttagtggcatcccacaaattttgatatgtagtgtttttattttctttcagttcaaaatagttccaaatttctgttttgaattcaaagaataatttataccaaagtcctcattgtagtccatttgggctgctacagcaaaaagaccatagacttggtatcttaaaaacgatagaaaattatttcctatagttctggaagctggggtcaagttacccacagaattagtgtctggtgagggcctgcttcctggcttacagatgggtcttcttgctgtgtcctaacatggtggaagggatcaagggagctcgtcccttttatcagagcacaaattctattatgagagctctgccctcatgacctaatcacctcccaaaagcaccactttcaaataccctcacgttgtgggttaggttgcggcacatgaattctgggaagacacaaacattcagtgtatagtagttcacctgtaagagaaacataagataacaaaatgggcaatgtcttcaaaatatacaaatagaagtttcataatggttctaggtcaggggtctaaagttcgatctaatcccatcatttc

SEQ ID NO: 7517 - DNA, 2033 bp, artificial
  synthetic oligonucleotide
cgacaggaaattccctgaagcaaaacctgtttagtaaccatactgccgaaatgaagaagctgggatgggagaaagcagcaggagtaacagcagcaagcaccctacccatcagggtttaactgatcggtgtctgtaactgatagacacagccattagttacatccacggtgctaatactgaactaatgagcacctgtcatcagtgtgggcagagtggctgaagagacactcggtagcttcctaattgactcaaatgatggtctgcgggttcctgggtgctagctgagctgccaccggggttggaggtggtgctattatgctaattcttgtgcatcccatgggtcataaaagaacagatacttcatctgccagaggaggaatgacagcaattaaggccatcacgatgccatgaagtattaacacaacaaatgaggactctctttcggtagaatcaccctggacttttgggggcggaaaaagccctgcctaaatcatttctctttactttttgtgcttatagcccatgattgctccattagatcattcatgagcatggtgtcccaaatggaaagagtgagatgcacgggctttcctgtaatcccagctcctctgccagctggcttttcaggattagagcacacctgctgtcttctcagctgcaaacttccctgcacgataatttggacacaaccccttacccaagtccaccccatccagcaccacttcccatcctggagtgagagtcagggctggtgaaggccaaagtcactgcctagcaagcaggttgagtaaataaagcctgaggtcctcacatagacatatcactggcaggaaaagctgccgtgagtctgttcctggtgtgattattctagtaattcagaggaaaagttgtgaattaaattaactcgtttttgtttttgtttttgttttttgacagagtcttgctctgtcgccaggctggagtgcagtggcacgatctcggctcactgcaacctctgcctcccgggtttaagcgattctcctgcctcagcttcccgagtagctgggactataggtgcacgccaccatgcctagctaattttttgtatttttagtagaagtggggtttcaccatgttggccaggatggtcccgatctcctgacctcgtgatgtgcccagatcggcctcccaaagtgctgggattacagacgtgagtcactgtgcccagctgacttgactttaaatgttgctattaattagttatgtgaccttcaacaaatacctaacttccctggggtgaaaaaataggacctacttcatagagtagttatgagaatgaaataaaataatctatacctggtgtttggcacaaattgtgtgttcaataaatgttagctcttattataattattggcagggactgtggtgatatttgagagtaatgactttgaccaaagagctggaaagactgatgctatctaacatcagggtcagcatgtagctgttcaatcaggctggccttcaggtaaaattggctaatttcatagactatagtgagctaggacatctgcaatttgaaaatgaaaaatatttcctatgaagcctatgaagccttagttgtcggtatccaaaaggtacatttggttcctgccagcccctggggttcagctggaccaaatggcttcaaaaaggtatagatggcagttcagggtcattatggactagcttcctggtctgatggctaaatagtaacctgcaatgcgacatgtacagtaggcctctgaccccagccccaatttactcccttgttaatcagtgcgttagtttgggacctgcaagaagtagatacagagaccggattaagtgttcaatgatttcactgggggaaacgtgtgagagaaaatgggactagagccagagaggcccagagtggcctcagactgcaatgtaagtctgaccttgaaaaatcaaacagagagagatcaaacagcagagtacggcagctggagcccttggtcaaggatgttctctgtagttggaacagcaatgcacat

SEQ ID NO: 7518 - DNA, 1553 bp, artificial
  synthetic oligonucleotide
gaaagggaaagggaaaggaaaggaaaggaaaacagtttatttaaaattctgtttaaaagtatctagaatgccatgaattataagatggattctgacttcatggacaataaaatgtccaaaaaacttatgtgagaccctaggactgcccaactctagccctacaaaacagtggccaactctgccactctttatccatctgattatgggcaagtcacttaaactctctgaacttccatttatgccaggtataaaatagaagttaattccacaaaacagcttagcaccaagcctgaaacttgcactcaataaaagttagttattattgcttgtaatagtattgcaatgtcttccctctaattctgatagaaagcaaaaatgattagagaaaatttccagcaagaagttttccttttgtatgtgaaaatgtgaggatgggtttggtaggtctgcatccacaaaatgacttctctaatgtttacattttacttacattaattaacacagagtcatgacacaggcaagggaggcatctaaacagcaaaggtcagagaacaggtttcttttatatatttatttcaaaagactcattgcactatgtagagaaagagcatggggtttatgaaactgcaggttactcatttaaactctgggtgccacacctcactgtaggattagaagggggctctctcaggcattagcctactcccccagcactacttccaggagcaaacaattgcagtccttggcataagtggattgtgacagatctacctggtgaacattcagaaagtgggtttatttattaatacctttctcttgcccacaatagatttgagacagctacatttaaaaagaaaatggggagagccaaagcaaggaataagttcctactaggaacagatgtatgggaaagtattctttattgcatggaaggaaggggaaataatgtgggtctttgtgttggactgtgtgggaaggtagttcaaaccatgacactaaagtaaaaggaaattttaatgtacatacacacacacagacacacacacacacacacactagccatcacagcaggcagccatgagctgcctaactctccatatgcacagaattcatattgagcaatgccaattgatactgaacattccaaactgtcttgcaggactttcaccctaaagtgtgcaaagaatgcatcttgatcctttgaagaattacagagatgtctcatctttggaaattcttggaaaccggagttcctggagattagaaaaagccaactaaaaaaaatctaccttttcagaaaggatagagagtcaacatagagatgaaagattgaataacccaattttactcacaggataatatgtttttaaaattcctcaatgaaaataaaaagaacgataagaatagcacagagtactgagtaacaatcagcactacattatgaagaaaatagtcatgctgacccaatctaatttttgttgggtaacagatgacaagcctaatggatttggggcagcaaacaacgtaatatgtattaaccttggaaaggcttt

SEQ ID NO: 7519 - DNA, 954 bp, artificial
  synthetic oligonucleotide
acacacacacacagttctttaagtacatagaccagagattggcccatgtcagcacatgcagttctgcctcactccttttaacaactgcatatcctatggtattgatagtttatttattactggcctaattgatagacaattagattgattctcattttctccattttgttctagtataattaatgttgtgatgaaaggctttgtatacacaaatttgggcacatactgaatatttctataggagaggagacattcctcagagtctaatttcttggcatatgcattcgaatttttgatagaaactgccaaactgccatccagaattgctattccaatttactctcaaggatatatgacagtatctgtcgatactatcaaaacctctggatattattttttatttttatttttgcctgtctgagaggcaaaaataatgctttttgtttggacctgcatttccccattatcaatacctacactatccagtgagattaagcaccttttcaaatgttagtttatattttttctgtgaattgcttgtttaatgacttatacttatttggtatgtttatctctttcttatgggtttatataagttctttgtacattatggatgtgaatcctttgtcatatgtcgtatagttattttcttgcagactatcatttgtcttccatgtattgtaacatcgtaaaacaatctttatccctagtgctatggctcatgcctgtaatcccagcactttgggaggccaaggcgggagaatcaattgaggccaggagtttgagaccagcctaggcaacatagggagacctcatttctataaaaaataacaaaaaattagcctggagtggtagggcacacttgtagcccttagctactcgggaggaaggctgaagtgggaggattgtttgagcctaggagattgaggctgcagtgaattgagactcataagc

SEQ ID NO: 7520 - DNA, 581 bp, artificial
  synthetic oligonucleotide
atacggtgcatgctttaattcatttaatcattccctcaaatctatggggtgaatactgttataaattcaactttagaaatgaggaaagtaaggctcagaaagatgatgtgacttacctcaggttacacagctaatatgtggtggagccaggactatggacccccaaaatttggctccagagactgtgttcttgaccactatactattgtaatagaaatccattccattaggaaatggaacagagtgtgcaaaagaaaagtaagatagaaatcctttaaaaaatattttgttaaaacattagtgtagtgctgtgaacactagccacagagaaacctgagatttagtctcagctctgccactaattccctgtgtgaccttaggcgagtcaattgttctctctggacctcaaggtaaaatggaaaaagaggggtggaaacttgacatgggtttgtatgatggtgtcggagttgaaagaagctttaaaaatgctttttgatgatttcaaaagaaattttgctgcttcagatgtatcccacccacgaagtgtggagatcacattctctcttcgatttacaaaagta

SEQ ID NO: 7521 - DNA, 1871 bp, artificial
  synthetic oligonucleotide
ggtcacgcctcaagttaagtaggtgtgttcaggcttcaatccaggtctctctcactctagaaatggtattctttccatcctggtgctagggcacaagcccaggacttctaattctatgagttaactaaaaaagtggttcctaaagtgtgagcccagaaccatcagcatcagcatcatttaggaacttgttagaaatgcacactctcaggtccactcactgaatctgaaactcagaggctggggcttgccaatctgcattttgggaagcccatccagaaattctgatatacacacagttgagtttgagaatcactgtcctaggcatgtggcttcagagatcagaagtctctcagaaatcccaggtggtatctagagtgtagacaagccaactgtgcccccggatgcaagccctatcttctctctaccccttggagaaaccctgggggcacccatttccatcaagggaaagtccagggaatgttacttgagcaaagttctgaggatcatgctgtaaacatttactttcctttgaggctactggttcacgaaaggccatgataaggttttccctgcactactcaaaggggaaataaatatcaaagacattttttaatagaagaaggccagaaaacccgtagcagttaaggtcataggagtgatcaataaaaagttaatttaagaaaggaaacaaattcttatcccaaatcaataggagtgaacattctattatacctgtagcatatatatgtgctatatatatataaaaaatatatatataaaatattatatatttatatatataatattttatatatataatattatatattattttatatatataatattatatataatattttatatataatatatatataatatattatatataatatatatataatattttatatataatattatatataatattttatatatatattatatataatattttatatataatatatataaaatattttatatatatatataaaagttcagcctttgcacatcttgttcttggagaaacaatgagtggtagaaaaagaactgtggttggtggtcctaagtaactctgccaatagttggggtggttgtatatgacactgagtcattaatgttgaaggtctggtctccttccttggctaatgaagtctaaagcaaccacatggatcctcccattgcatgtaaatgactgggtcaaagcaaggaggaaggcgttcaaatcaaacaatattaatatgtgagcacaaactaaataaaagtatggtaaattgaatcaaaggcaaacatgcttctgatggagctggaccccttaagccctggaggtgctgttttaagtgcttttcttgtgtagctcatattagtagtccccaaacaggagtttaataaatgctgttatcagcagtggcagcagtctcataaaagaagtgtgggacttcacaaggggactactttgaagcagacagacgtgcctgtagatgtgttgtttttggcacatttgtcacaagttttatggcttagtagtcatgctttacctagtgagaagagtgagctgttgcatttgcagacagtgggttacatagagcagtgtgacacatgacttcatttaattgtcttcacaacactagaaagacctaaatgatctggatgctgaacctcttcctttccccttgaagttcatgctgtgggctgctgacttagccagactttctgggctacccacaggaggtggggagcaaggtgaactcttgggagcacagtgatccatgagacaagcaagacttattagacaaaagatctaccagacacaaaaccaaatctgaagaggctgaaggtcttgcacccaccaaacatgctat

SEQ ID NO: 7522 - DNA, 1390 bp, artificial
  synthetic oligonucleotide
gcatttgcaggggagagggacaatatgccttttccttggtattcctgttgactaacacaaatgccttgtccattgtaggcattcagtaatgaatggtcgcactgcctcccaaattacaagcaagcagaaaaaaataacaacattatgcatgtgtttcctcaccaccaagtgggggaatagaaacccagataatcaggtaaggaaactcgtggcctccagacttggtgtgtgtttttaggacaaagctgggtatgtgtagttagcccctgaaaatatggctgccaatggagggcaagtgagaaatgaatagtcggtgagacactaggcatgtggttgggaaaggacataacgatctgtgggagaaaaggggcaacctctgcaaacctggcacatagatggcaagaagacattctcagggaaaggggtaagagtctgtcaactttacttatatggagatgcattttttccccccaaagttactgaaaaccaccatgaagtatgtttttgtaattatttattttttgtaaggtctttggagacattatattgcttgttttcatatcctcctggtgatgccaggaggagtgatgagaatgattacctgcatttcacagaagaagggggagcagtactaggagagtgggcagtggcagcatactattaggttggtgcaaaagtaattgtggtgtttgccattaaaagtaatggcaaaaactgcaattacttttgcaccaacctaagatttttctgacaaatatcacaactgaacaacataccctggtgcctagggtgaaggcacaaaatagcttgatcatccttgaagggtccataggcacgtattggggaagtgaagataaacatgcagacgttgggtacagaacatctcattaaagcccgtggagcacaaatctcctccccaaccatgatgagaaagaaggacactcttgaagagccacttggaagcaagcccagccttcttaattccattaattatggtctttgatgccaaaacagcgaaactctttagactccaaagctgggagaatcattaccttggctcagctccacaatccagccatgctgtgtctgctgaaagtacccagacatcaccccaaagagaaccttcaatatttgggtatgggcaacaccatctaagctactgatgaactctccctgaatcaacgtcatggagtagttctcaggattaaatgaaataatgcatgcatttaaagcactccgaacagggcctggtgcataggaagcactcaataaatgttatttcttattatttaaaaattccaggcccttgctatatttggcagtctctggcatctttgttggaattgaagtctgtaagtttctctacctgcctgtaaagttgtaaaatatg

SEQ ID NO: 7523 - DNA, 1551 bp, artificial
  synthetic oligonucleotide
acataaaactacagcaattactggcaaagtcaaatacttggccagtggattgctatcttcatgcaacatacaaccattttgaagagaacactcacacacacatactttcatacacacacatactttcatacacacacagtggcaaaattagtgggggttagcaacagtcacaacccaatgtcttagaaaaaatacatgggtctcaattagaggaaaaaacataatcacgatataatatgcaggactctggtgccagcaatggacatagaaacagctgaagtcaaacatgaaaatgcaccatgctgagtccaaacagagcaagcaagacttcattttatctttcatttttttcttttcttttttttgagacggagtctcactctgtcacccaggctagaatgcagtggtgcaatctcagctcactgcaacctctgcctcctgggttcaaatgattcacctgcctcagcctcccgagtagctgggactacaggcgtgtgccaccatgcccagctaattttttgtatttttgtagagatggggtttcactgtgttagacagggtggtcttgatctcctgacctcatggtccgcccacctcggcctcccaaagtgctgggattacaggtgtgagccaccacgcccagccttcactttatttttctaaagctgaaaagtttttcatttgactcctgccagccaaaagcaaaggggtgctggtatgtttatttatgaagctatgtgctcttgactactcttatctggatactactgaatagataaacaggtttgttcactataaggtacttccggcaaaggcaggttagagccggtcttaccagagtcagctccaagtagatttgtggagtaagcagggtttgacttgatcatctcatattccccttctgtacaccttctttttctccattttaatatccctccttcccctagcttaattcatttaacccatcacttatagtgcttaattcaacatttatagtattgtttgccaggcactgtgcttggttgctctgccctggccccatatttgtggccttcactagtacttgaaaactggacttggtccttgttattccctagcctgagcctatgtgaaaaacatctcagactgagaggagtgatcgagttccatcatcatctcaactttgggcaatttaatttttaagtggatgcctctgaatgtcatacgtagatgtagatatatgtgtgtctgtttgtctatctacctatctaatctacatctccttagctttggttggctgattcgagagagaatagctatagtgatatatgagttctctattgcttcattgatggagtagattagaggcttgagatggctcaacaatactgttgaggaaaggtagctgtccaaatagaaccagagataccattattttagaagaaaaaatgaagcagttgagaagtacatgctttttcctttcatcaccgctactgctacatttttttaaaagtaggatgattctaatttttccaaaaagtctccattttcacagtagctggcagagcccac

SEQ ID NO: 7524 - DNA, 1830 bp, artificial
  synthetic oligonucleotide
actgattgttcccttctttctctggattacaaaaatctattcagacaactaaaaaatagcaagtacttatgcaaattgttaattatgaggcagcgataatcataatcttgtatatttatgaaactgcatatacaatggggattaccaaaaatgttatttgttttattgctttactagtggttgaaaaatatgctagccttgcaaatagttttcatacatcattcagctcaccaaaattcaaaaagggccccattgatatttaccaaaaccgtttctttcccatctcaccatctgtactcctcttgttttctctcattaagaccaggtattagttgctctggcaataatctggtccaactaatcaacaccatagtaaaaataaagagtgtgtcaggatttgctttgttatacagcaaaactgttttaaagagatggtcctatcatctagcaattttaaagcaaaaagaaaacaaaattctcaagacttccccataaaagctattatagggatagtggtacctatgttattgaccattgtcttaatggtcatccgctccattttattttacaggcgaggaaattaaggctcagagtggagctagtgcttgacaaaagtcacctcattagtaacagaacttggtactttgcctccatgacacacccaatctatgatatttaaatgttctcccatactaatactgtgtgattaggtgtctatgtgtgtctgtgccatttagctcaataaattataatctgactacaaaattaaacactaaatttactattctcagctgtcaagtaaatccattgaggctctaatgggagtatggaagcccagctacagaaagctaaactgggcatccccaaaatggctcaagtagtctattttaatgggagtctgtccttgtggagaaatgccagagctacagtctttgctcttgctaacctatttggccagggagcacagggtggattgtaggtgggtattaagaaaaaacagaggcactagtaaatatttctggagccaataagcctacaaaaagccaaagacagtactggtgagcatcatgaccttagaaaacaatgtgccaagcgactagagcacacatttccaaaatgacttatggttcttgctagactctccggttctggtggcaatatgatggtacagctcttagcaacagttgttgcctgcaggggcatcatctgggagcattctcagcgtccgtcttccccacagagaggaactttcttgtatttgattagatttgctctcctgcaggcttcatgtcaaaaaggcctctggcctatgggattacttgtaaatatgcaagtctacgtatttacatacgttaaaagccctgatattttcaaataattgatttcccttcaaggaaatgctgacctacttgttctctaaatcacaatccagcctagggacaggcagacgtgcctgaagcactgtaaagaacactttgccaacggttggggtcttctcaacaacacactctactgtgtcatcctatttcagcaaaaagaggaaaaagagctaatgacctactgcacacctgtctggggtggtcgccctgaacattcatcccccttctgaactaagtcagccttcagaactgagactccaagcctgggtagtttcagctgttttaaactaaaaaaaaaaaaaaaaaaaaaaaaaaaaagccctggaaagaatttgtccaagccaaaaacttaactatttgttgtactgaaattaaacggacaggcaactgcagagtctcttttttctagcttacttgggttcagtcaaactaaaaatacattgttacttac

SEQ ID NO: 7525 - DNA, 1001 bp, artificial
  synthetic oligonucleotide
aggctatgatcccttccacaaaatttggccttgtgaacaaaaacaacacaactttgggtgaaaagacaaaacacacacacacacacacacacacacacaagaaaatatttttagaaggaaaacataaagccatatattgattcctaggatcagaaaattccaaagttaagtatgcagcagtttccaaagccataatttttatttcactgtactaacagaaattctcaaatgatgttaagtgtataaataattgatttatatgggaacgggatcaaatttaactttaatcactattattgtctcttgagtttttttatttctaggtaaacttcttgactgccttataaaatttgcctggtgattgcactgagaagacttttggaagctcattgccttacctgggagcccaggtgggaagaggtggagtattgagtgacgatccatgaagacgttacaggtgcatcaatcaaaagggtggccagtcatcagaagtgagccaaagttcatagggaaaaggtaaaacaaaagatacatactaattagaagagaatgaattaattttaagaacccattttatgcatacacacacacactctctttgggaaggttgtttaatgaaatcctttaaaaaggccctttaatcatgatgttttattaaaaaatatttattatctattatgtgctagccattgttagaggtactgaggttagaggtactgagtagtgaataaaacagacaaaaatccctgactctacagagtttacaatcttgtggaatatttttaggccatctgcttggaaaagagttctacagaaatatactgtatattatcaattctaggaaagagtttctccctgttttatttatgcctttgtttatgtatggagaacatactcgatggcatcagattaaacatttgcattagaaagaattctcttttggattggaagggacgttacaaattcataatttctccttgtggaaagccctcccaacaggc

SEQ ID NO: 7526 - DNA, 2261 bp, artificial
  synthetic oligonucleotide
aactagtgtatgcatgcatgtgtgtatgtcaaggagtggaggaaggtgagggagcattcagaaataacgaagccacttttatttgattcatcctcttcatttcacattctctcccttttcttccaatgtaatcactgactgggtccaagcctcatagtttatagatgaagagcctgagggccagagtggagatgggagttgctctggatccaatttaggacccagatctctgtgctttcttgcctgtgttccttctactacattttgacccctaagatacatcccgagagaaatatattatcatagacggtatttcattattattcctcctaccaagaggcaaatcttgttagaagccagcacactcaggccaggcgcagtggctcacgcctataatcccagcactttgggaagccaaggtgggcggatcacgaggtcaggagatcgagaccatcctggctaacacggtgaaaccccgtctctactaaaaatacaaaaaattagctgagtgtggtggcgggcacctgtagtcccagctactcgggaggctgaggcaggagaatggtgtgaacctgggaggcggagcttgcagtgagtggagatcgcgccactgcactccagcctgggtgacagagtgagactccgtctcagaagaaaaggaaaaaaaaaaggaaattggggaagccagcacactccgtggttctatagcatcagcctgccctgggagctactctgactgctttttttccaatctaaactcatatttcagggccgccctggaaatattggtaaagccagcactgctaatacaggcaaacgatggcaatcctaaagggtagtgttgcactgaaataaattatttgcataggtgggatttctcttttaattttactatgttaaggttacaaattgttttctggcctttacgtataattaaatatagatgctcttggagcttaatgtcagtttaaattttagtctttggaaagtaatttgtttgcacgttcaatgaacaaaccatttcttattggtttcaaagacccaggctcatgcatcatgaatcaaggttgcctttatcaaagctaaaaaggtcaggcaaagtaggcttctaactccagtttagccaccccctacaagagaaaaatcaaggttttggttctctgtcttaagtacacatatgacttagtttcgttaggcataggaataataatacaaatgattcatctgttccctctccacacacacaaaaccagttaaatactgcttgataccgtttggccgtgttcccatccaaatctcaccttgaattgtaataatccccacttgtcaaaggcgaggccaggtggagataattgaatcatggggctggtttcccctatgctgttgttgtggtggtaagtctcactagatttgatggttttataaatgggagttcctctgcacaagctctcttacctgctgccatgtaatatgtgactttgcttctcctttaccttctgccatgattgtgagggctccccagccatgtggaactgtgagtccattaaatgtctttcctttataaattacccagtctcggctatgtctttattagcagcatgaaaatgagctaatatgctgctcattatgctaccaaggatcaaaccattgggagggctttgaactattcctctgctctctgggcctcagtttcctcatattacatttaaagagatctctgaagttctttcagctctgataatctaaggtaactagacatagaaaggctatccctagcagtgattttaaatgacactggtttgtcttaaaaagcagtttgtaaggcttgaagtgttttaggccaagcaatcaccaaggacattagagccatgagttcttaggcaaccttcttcctctacctttcctccctttgtcctctactctcagaaagatgtcagctgtctctgtccctttctcaatggctccaaggatattcccactcctttagacagccctgcagttccagaaatctcttcctctcatgcattttccaatctcttagggttcccctactaaatgtgcatgtacactagggctcataaggagttatttgctcattgacaatacatgaccaagatatattgttaagtgaaaataagaacaggctattaaacaggatatctagtatgatactattccccctacccaaacctcacaagtaaaccaatcagccactctttctggacatggcttaagtctagactagctacgggtctcttttg

SEQ ID NO: 7527 - DNA, 2307 bp, artificial
  synthetic oligonucleotide
tacaagggggagggaggttgggctcaatgttctccaaggccccttccagccctaatgctctcagatcttttgcttgcccaaggttagacaggcacagggcaaaaacaaaagtccagccagagaggagtcagctgtctcatctatttgcagatgttgggaccaccagaggatgctgcttcttggggctccacactctccaggtgggaggctcattctcctccccactatgggaaggaaactgcaggctggccaggtttggaaaacaaagccatgtggaaggcatgccatgagtgacaaaaatcctatgttattttctttgatttttttttaaaaggttgacatttttcaaaataaagctgttacttctctgccacaatgcatgggccagttagcgtgttcatgaatcagacatcaaatattttctttcttccccaacatagctctctctgtgggaacagagagtctagtatcaataataccattagaggggaactacccttcaacatacctaagctgcaattccaacctgccaagcagggaaaaagtgatcccaaatcctatagccgttactgtctacttcttttcttttgaaggaccctttgatttctttctttcttttcatcttctttggcttttcaagcctatcttgaacactttggtgatactcaggaggtcattaggcgtttgcctcttgttaagcctcactcagaaaaggaccgctggtaatagaaccaaaataaatcttctcacatttaactcctctctcccacaaagcagctgtccttggctgccaccactgttgccacaatttaaaggaaggtggctacataccaacctttggtgcccagggaggagccatccacaatgacacacacttggccatctacgaatgctgaccaggatggagctgagtcctaacgcttggatcatacttgggaaaaacctttctacagccagatgctctttttttgagacggggtctcactctgtcacccaggctggagtgcagtggtgcaatcatggctcactgcagccttgatctcctgggctcaaacaatcctcctacctcagctgcccaagaatctaggaccacaggtgtgtgccaccacatgcagatgatttattattattactattatttgtagagacagggctttgcagtgttactcaggctggtcttgaactcctgggctcaagcaatccacctgccaaaggcatataacacaggcaagcctcccaaagtgctggggttacaagcgtgggccactgttcccagcctcagacactcttgatttcatttattctctggaaaacctgtgcccatgggaggcctctcatctctaaaccgagattccccaaatatggcaaatgcatgcatgccattgctcacacagttctcctcgcttggaatagccttcccacctgacccagctcaaatatcacctcctctgagcagcctttcctgaccctctcccctcacaggcagagtaatccatccttccttcggattctcacagcacactttgttcttgccgctaccatggcacttattacattacattagagccaagtggtgactgccttttacctctgagtgactgtgagcttcttgaggacaggggcttcatctaatattggaacaattagccttgggctcagcccataaaattttcagagcttgaattgaaggggtaaattcagacttcagcaatgaagttggaaagcagtcctccccagccataaaattctgtaactgtacaaataaaatgtggtcccacagacacacttgttttgggggcttggggaggtacatatttggccgtgttagactggtctagaaatcacaattcccttaactaaactcaccagatggttggcaatcaagctcaatcacttagttaaggtgaaccaacttgatatgtctgtgtcaggcaacagacagctggctaagtgactgacacccctgagccgcaggccacgtgcttatgggaaatggaatagtgtgtgggggttgggagaggacaagggagtctggatgcatttattttgaattgggtgatgcacttgtataaaagcaaattggaacccttgacagagtcattcagcagtatcaaagatctatagtcactgcagcctggtggggggagtgctactagttacagttgcttggctgtaaataaaatctcccctggaatgaagcattttaattcgaagtgattctataaggagcagctgaaaaacctttcaaggaagctggcagtgttaagaggaacctctataccaataggaaagggctttgaaaagagc

SEQ ID NO: 7528 - DNA, 1397 bp, artificial
  synthetic oligonucleotide
aataatggcagttgttctaaaatttcaaataatactgaaggatggggaggtgtacttgtggttctaattggaatctgggtctttaaagatgacattgatcctgagcatgtatgtcccagaaattccattttggattaatgaaagctggagtctgtgccctgtgcatcttctcttcctcttccaccaactcaacaagatgaggggaaagcagctcctcatttagactttctcttcatctgcccacaaataatgtgctgatctctctcattgactcctttgccctgaaggctcgctctccctctcccacctcctttccccctttcttgatctcttgcactctcttgcttttgctcgcccagcctcctggcctcatagattccctttgctgtcactggtgctttttttcaaggttgctggcactcccatgtgtgctctcttgctcctgcatgagctttctccatccatcttgggctctttccctacctctaaaacactggcttgctgtcaccttctcaggcctgactgtgatctcgctttctttattgctttctcctactctctttctttctccctgtctctcttcaagtggctctctctcacacgttcttgctctcccattcccctgtgcatggtgtgtgtgtgtgtgtgtgtgtgtgtgtgtgtgtgtcttttcagtacccgagagtcatgagtaatttccctaaatacagagtaccccagagcagaacaagaacaaggctgatctcacagggagaacaggaaagataataattttttattcacaagaagaaaaatgccactggatccaaggttctcaagagtggtctcagaaaacgtaaagccctgggggtaaaaggtgctgtaaaagacatagatgtgtaatctaacattgtctattacagataaagccaatagcctcattagaagcaatcaaagtcacaaggagcatcctctggagaaaccctaacagctggggctatttaggactaattgcttaactcacccttaggcacaggaagctgaggctgaaggaggaagacatttaactcacctcaaatgtgttactagcaaaggaacttcccaaagtagaagagccagcatctctgagaagtcagagaggagaggcttctgaagagttgctaaaggatttcacaaacaagcctcgagcacagagtcactggttaagcccctggtttctgccaccaaagcagtcaggcaggctcacttcctcacctccagaaacttctctctggccactctctgccagggagcaaagttgtaatatgattcgtggcacctgggcagatgctgggttcatgtgtgggtgtggtgagaatgcagagtggggtggggacatcctgaagagcaaaatggagagaaacgaggggagctccaag

SEQ ID NO: 7529 - DNA, 1700 bp, artificial
  synthetic oligonucleotide
ctaggtgttgttcctgactcctgactctggtgtttcaaggggtatacccagaaacccatgaaacaggatcttggctcatgcctcctgggagaaattcaccaacaggaagaagagaattgcttgaacccgggaggcagaggttgcagtgagtcgagatcgcgtcactgcactccagcctgggtgacaaagcaagactctgtctcaaaaaaaaaaaattctatagttataatatcctcctattttcttgctcagtcccatttgcagcttactcattctccctcctttctcttgtgttggattcattttatattctttgattagttttactgccttgaaaattgaatattgattatgagacaaagtatggaaagaaacattaacattttttacttgaaaagaagacttggcaggattgtcctctgatggattacacagtgagcttcctaaagccagaccaccccacaggccagtagaattgcagcgccaggtggatgctatctgtttccttcctcccttggtccaacaagggactacagcttagaatggccttctcttgggttccttacttgctagggatctccactttcccagagaacttctgctgcctgtactttagcatgtagcactgttaagttcatagcatagtagtaagaaggaaaacattaaatgtgtgcatcctcaaaggatttggaacaaaggatggttttaggatgccctatgaaaccatcttcccaagtaaggattcctactattattttaaaaattcataccgaagggatccaattaaacatgtggcttttgttttttatgacaacaaaaatgatctaacagataaatacaggatgagatgtttatcctctccagggtaaatattaatgtgaagctgtaaggtaaatggtgggatttttatagaggtctaagtagtttatagattttaattgggagctgttctgaatgaatgcaattaacattgcttgtaatataaaatatctgtataacatataattaaatatatcaactcattaatgaaggcatgtgtcaaaggcaggtgatgataacaaggaaagccataagtggtactacagaaaactaccatgatgttgcttagctcacggaagactaaccaagtgagaagagaaaaatgaaaccttggttatgcaaaagtggtgacactcacttatgtaatctgcttattgtttttgtctaaaacccgggcagcacaaggataataacagatctcaataagtttgtgtcatacttcctttgtcatcaattgtcttggacttgaagagaagcccggatgcatcttttttctgtccgcaagtgtgtggtcttctcatacagcaaggctgcctgccttttcagtttcgcagatgaaggggacactgtaaagtagtaacacttttccaggaaaatacatcttcattccaaaataaactatgagattctacaaacagagcagagcagctatttcccctagaagatgactcgtggctaaacttctgggggagctaacgaatatttgaaaggcaagcgataacaggtgaaaatgcactcagatactgcctgggaaccgcagggcaccaggaatgcaccttcacctctgcctctcgtattttgcatgcaaaaacaccaaactgagcctctgtgatttttccaggctcagcaaagtttcagtgtcaggaagagtggctttagat

SEQ ID NO: 7530 - DNA, 1255 bp, artificial
  synthetic oligonucleotide
cactgtttgaattattaccttttgaattaataggggctcaattaaagaggtttaactatatttctgataacaatgttcactgctatgctgcccacgaacagattaaactagtccccaagattcaaaggttataaattgctctgagttcttcaagtgagagacctaataggaaaagatggtgtcactactgtaattagtcttcaggtacaaaattagttatttgaaccaaatgggtagggaatgattgtcaatgactgttttccacctcaaaggaaataaaaggagcatattaattactgggaatatagtctgaagtttgtgcaagggtctccactggagggaagttttctcaaaatatttgctggcttataattagctcatgcatctgattgacttaggaaaaaagagaaaaaaatctgaaaaacaacaactttgagaccaaatgttaagtgactgtacttgagaaaacccaactccaaagacagcaactttagagttcactgccaacaaagagtaatgaagcttccgggccctaggaagtctcgctgccagctgggttctgtgcctcagtacaaagaggcccattaggctgagaggcagacaacagaaccagcatggactcagggctctaattggcggtgattagagaataaaatgaaaagtaaaataagatcgcagcaggtaaaattagggaaacagtggaggccacaaagttaaaccttggaacatgtaatcaaggtgattaaaaactcaggctgctccaccttgttactcaccatcttgccaattcaccatacactcttcacaatcacagccaatttttgttctgatttttaagaatgccccatcctagagactcaactacagtcaacttgcattgaggtggttgaacaggattcgcatctccccccaccttcccctcaataagcttggcataccttgtagagacctacatttgaatcatgtcaatatgcagagggtttgggtggcttctggttggtcacttggaaataaaaggcaggggagattatgcatagtaatcaggaaatgaaacatcacatagattcatggggcctgcagagttacctagcccatactcaggggcaccacataaccaattggaacaatctagtgagccagttgggagaagaatgggcttggaaatcagtgtaacagccctccagggaacactgattgaaagtaaaatgcctatgctttgccaagccatttgtctttagaaactctaataaattat

SEQ ID NO: 7531 - DNA, 1649 bp, artificial
  synthetic oligonucleotide
tagatttacgttaatatatttaactacctgtttctggaaacttgaatactttccaacttcctcttattttgatctgttaatgttgtgttgggccccgtacattagcaattgatccaagattcattcattggaatgtgagtgccagctgtgacattagggcaatgccagccctcctgccagcctgtatttctccttctctgtcagagtttagtgcttggctagaattctgcccatgaaacacttggcatgtagtggctaaccttgtcaaggggaaactagggatcaaaagtgacccctgtgaccagctgtcagatgccggatgtctagtgtcctgatatcttcctgatctgatcagtatcacacccagaatactattcctccatttggcactgtaatctgatgccctcaggctgcagccagaagcacacagcaattaggaaacctgtaaaaatctagtccccacttggggaagtaagcaggaggcttccaggagcattcacaggaagggaagttgaacattccactctccccaatgtgaaaagtgatgggacaacacacagcaaacctggagggaacataagttttcacggccagatctttttttttttttttaaattattatactttaagttttagggtacatgtgcacaatgtgcaggttagttacatatgtatatatgtgccacgctggtgtgctgcacccattaactcctcatagggccatatcttaaacctgataatgaccgctgttaaggatgaaatgttaataactacaggtaacactgagcatttacatgctgtttatatgcacaatcacattctattatccatcctcatttggcagatacagaaactgaggctctcctgctatgtaacctgcccaaggtcacacagctctctgcaaccccatcctcccactccctaaaaaggtgacataggcaggactcaactccattcttttcccgtgccaaagttcaagccctctcattcatttaaatgccatccacctgctataaaagaagaggaacgaggcaatatcatgtgtttattagaacacttactatgcaccaagccctgggtaaaatacttcctcacatataagcactcaatacatgtgtgagttaaaggcatgcccattttacagttaaacaaactgaggctttgagaggttaaatgatctgtttgacctctcagagcttaacggatggcccagctgtgatgaaatctctgattccaactaaaagagcttattgttattccgcggcttaaagaaaaatgcctctgctttaggtcattcatacagtcaaggtcctgtggcaacatcattatttgaagacccaaggctcaggaaattgcactttggccaagttaaagaaaagcaggctaaactcatctcagggggcaatgagttctgaatacttcatttccaagtgtaagataaactcaatgaaaaagatataattttcttcgtaatttgagaattgcacatcacacataaatgtgcactttgtcaaagctttgcagttcacctttacgctttacagccctcttgggaagcagaaaaatatgacaattatgcaaatagcagtgttgagccaattacatggaaaagtggttgtactgaaaggcaaaaagggtttggcaaaact

SEQ ID NO: 7532 - DNA, 1768 bp, artificial
  synthetic oligonucleotide
aaggggattggaagatgggcaatttgtgtgagaatggaaggcttaatctaccttcaccttaggcaaatttcattaacctttgagataccagtcctcaactactagagaactgagacccatccagagttacacaggcatcaggtgctaagttaattggaatctggatctcctgaccttcctgaatctttcagtagttctttcaggggtagagctttaagtgaggctatttgtgatctggagacagaataacagcttattttcaagtaatcagcattgcgggttaggtgtttaccattaggattgtctttccttgcaagttttagttttgaggctttattgcctttggtcccaggaaagataaatcagccacagggtggagaggttctgggaagtatgtgtgggtgggaaaaagagggatagagggagggaggcgagtgcacagtcctgaaggaacacccactcctttatggtgggaggggggtgagagacagctgaagaggcagaagagtgagtgactgctaaggaattagctctggttccagcccaccagcaggggccccaacactccttgatgttaacccttggtttaccttggcaaagaaaaatcacactcctttgctggcagctgtcattgctgtttcaatacagataacaccttcaagtgggaaatgtagaggggaaaacatttttcttagttttcttctaaaaagccaaggcaggagtatgtgtaagtaaatatgatatttcctctacatcaaggacatgaattctaaaagaataatatttagtcctttttattggctgccattcaaaggcctggaaacatttactagcaaatttaattactctgcattttatagctgagaagttggaactaacaaggctacactttttttaagttgcctaatccaaggtacaagcagcctgatttaaatgcacatcccccaagggctggaaaagcctcacatcaggacagtcccgagaggggaattcatatccaggcaacatttattaaacacctcctatttgctaagcacttccacatatgttattctacttaatcctcacaataacccaataagaaaggtaggcatttacatgtctattttacagataagaaaaaaatgaagctctaaaaatggaaatgtactacgtgtgtttgcacttataatttcttaaaggtttgcacgtatattcgttcttctaatccttacagcattttttcaaattatgtatgccagatattaatatttacaaagcttaaaatgaggaaactacactcagaaaactgaagtaactggaagtcaccctactaatctgtagcaagtctggggcttgagtccttcagctctaacctctcagctctgtccacttagggtcagaccccgtttcacacaggccatttgactcaatgaatgctgcccaaaaggatcagctcggtataataaggaaggttgttcctagagcaaacatgcaggtgccaagaactatgtaagacactgtaggatcgaatccaaactgtgtacttgcttttctcaagcatctgctagtcaaatgggacagtggctagcagctcattgaaccctacaataagctacaccttgacaagcagggaacataagagagcagatgatgaagcccttggtactaacagtgataaacccataaattctattgtatggaaaggggagacaggagaggcatcttggaggagacggtcttggaaatcaagtaggagatggagttgactggcattccaaaagaagga

SEQ ID NO: 7533 - DNA, 4119 bp, artificial
  synthetic oligonucleotide
tagcagagactatttaaccaacaactttttttttctttttttttttattactatactttaagttccagggtacatgtgcacaacgtgcagctttgttacatatgtatacatgtgccatgttggtgtgctgcacccattaactcatcatttacattaggtatatctcctaatgctatccctcccccctccccccaccccacaacaggccctcatgtgtgatgttcctcttcctgtgtccaagtgtactcattgttcaattcccacctatgagtgagaacatgcagtgtttggtttctgtccttgcgatagtttgctgagaatgatggtttccagcttcatccatgtccctacaaaggacatgcactcatcattttttatggctgcatagtattccatggtgtgtatgtgccacattttcttaatccagtctatcattgttggacatttgggttggttccaagtctttgctattgtgaatagtgccacaataaacatacatgtgcatgtgtctttatagcagcacgatttataatcctttgggtatatacccagtaatgggatggctgggtcaaatggtatttctagttctagatccctgaggactcgccacactgtcttccacaatggttgaactagtttacagtcccaccaacagtgtaaaagtattcctatttctccacatcctctccagcacctgttgtttcctgactttttaatgatcgccattctaactggtgtgagatggtatctcattgtggttttcatttgcatttctctgatggccagtgatgatgagcattttttcatgtgttttttggctgcataaatgtcttcttttgagaagtgtctgttcatatactttgcctacttgttgatggggttgtttgtttttcttgtaaatttgttgagttctttgtagattctggatattagccctttgtcagatgggtagattgcaaaaattttctcctattctgtaggttgcctgttcactctgatggtagtttcttttgctgtgcagaagctcttgagtttaattagatcccatttgtcaattttggcttttgttgtcattgcttttggtgttttagtcatgaagtccttgcccatgcttatgtcctgaatggtattgtctaggttttcttctagggtttttatggttttaggtctaacatgtatgtctttaatccatcttgaattaatttttgtataaggtgtaaggaagggatccagtttcagctttctacatatggctagccagttttcccaacagcatttattaaatagggaatcccttccccatttctggtttttgtcaggtttgtcaaagatcagatggttgtagatgtgtggtattatttctgagggccctgttctgttccattggtctatatctctgttttggtaccagtaccatgctgttttggttactgtagccttgtagtatagtttgatgtcaggtagcgtgatgcctccagccttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacaatattgattcttcctatccatgagcatagaatgctcttccatttgtttgtgtcctcttttatttccttgagcagtggtttgtagttctccttgaagaggtccttcacatcccttgtaagttgggttcctaggtattttattctctttgaagcaattgtgaatgggagttcactcatgatttggctctctgtttgtctgttattggtgtataagaatgcttgtgatttttgcacattgattttgtatcctgagactttgctgaagttgcttatgagcttaaggacattttgggctgagacgatggggttttctaaatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgtcagttttcaaagggaatgcttccagtttttgcccattcagtatgatattggctgtgggattgtcataaatagttcttattattttgagatacatcccatcaatacctaatttattgagagtttttagcatgaagggctgttgaattttgtcaaaggccttttctgcatctactgagataatcatgtggtttttgtctttgggactgtttatatgctggattacgttcattgatttgcatatgttgaaccagccttgcataccagggatgaagcccagttgatcatggtggataagctttttgatgtgctgctggattcggtttgccagtattttattgaggatttttgcatcaatgttcatcagggatattggtctaaaattctctttttttttgttgtgtctctgccaggctttggtatcaggatgatgttggcctcataaaatgagttagggaggattccctctttttctactgattggaatagtttcagaaggaatggtaccagctcctccttgtacctctggtagaattcagctgtgaatctgtctggtcctggactttttttggctggtaggctattaattattgcctcaatttcagagcctgttattggtctattcagggattcaacttcttcctggtttagtcttgggagggtgtatgtgtccaagaatttatccatttcttctagatttttggtttatttgtgtagaggtgtttatagtattctctgatggtagtttgtatttctgtggaatcggtggtgatatctcctttaccattttttattgcgttaaccaacagctttttattgagtgcctaacatatgtcaagcatatattgtacagagcgcccttaacataagtaactccatcttagaaaaagactccatcttacatttcatagggcacttttttaagagggtcaagatgttttgcttaataaataaagactgcaaccaaccagataaggacataggcatacttttccactatcagtcctcaccagaggactctgtggccataaaaggagcaggacttcagcagctccaaatggctgtcttaactgacaccgtcttgctttcactcgtgataagcacccagcatctgccaccaaaggctctgcccacatgagacttttccttgcaaaattgacaaaccagctggtccagaccaggacattctttttgtctatatctgtcttcctagactggttcattaaccccttttcctatcctctttctcttgatgttaaatgttaatttgtttgttgtggaatgttcaatctgtaacatatatatatagatgaaatgtactgttttgtgtggtttgcaatattgactgacttatggagtggcttgtgcctctgtggcatggctctgacttccgagtgaatgggaagtacgaaggagaattgcctccttgggaactccatgtggctcatggattttgtgattgaaatagcatcaataaaagtctgacactgtggaaagacacaaacatgtgtgaaactggttatctctgaccttacaccattcaagatacatataaatagaaattagttttatatacaatggtagtaagagaaggagggagagagatgaaggatggaaaggagagagaccatgagaaataataaatttgaaagtccaaattaaaccacaatctgcagatgttatgatgttttgagtgctactcctttgctctgatccaatgctaggctgctctggggatgcaagaatgagtaagaataaaagattattcttgcagccaggaggaaattaacaaattacaactaaaacaaaaatgactattccacaagacactaagtgccatcacaaagtacaaagtgctatagagaaaagagtaactgtgtctaatctggggcatagagagtgatttgactggtaggaatgtggaagaggagtacaaaataattttcaaaattaatttgaagataaaattggccagatttggcaaccaattagataagaagaatgatgggaa

SEQ ID NO: 7534 - DNA, 3801 bp, artificial
  synthetic oligonucleotide
taaaacatcatacttatgtgtaaatcttcaatgtaaaaagtatttgaaataacttcggcatctaaatctttaagacgggaaaaaagagctgcagagttcaccttgaaagagtgacttttattaaatttttaaaaggtgtttttttaaaaacaagctaatatgttggatcttggtatctccagatagttacttcaggtctccattccacttagcttgtatagacttagccacagaaaagaaaaaggtttttggagatttgtctgagaatttagtagacattaaaatataccagacaggccaaatatcccagttgattttaaatgccagctccaatactgtgtagctgtgaagatttaggaggttatgtatcttgtccagttctgttttctcatctttaaatggggttttaaaacatctacctcagacgtacaaagaggagctggtaccattccttctgaaactattccaatcaatagaaaaagagggaatcctccctaactcattttatgaggccagcatcatcctgataccaaagcctggcagagacacacaaaaaaagcgaaatttagaccaatatccatgatgaacattgatgcaaaaatcctcaataaaatactggcaaaccgaatccagcagcacatcaaaaagcttatccaccatgatcaagtgggcttcatccctgggatgcaaggctggttcaacatacacaaatcaataaatgtaatccagcatataaacagaaccaaagacaaaaaccacatgattatctcaatagatgcagaaaaggcctttgacaaaattcaatagcccttcatgctaaaaactctcaataaattaggtattgatgggacgtatctcaaaataataacagctatttatgacaaacccacagccaaaatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattgggaaaagaggaagtcaaattgtccctgtttgcagatgacatgactatatatctagaaaaccccatcgtctcagcccaaaacctccttaagctgataagcaacttcagcaaagtctcaggatacaaaatcaatgtgcaaaaatcacaagcattcttatacaccaataacatacagagagccaaatcatgagtgaactcccattcacaactgcctcaaagagaataaaatacctaggaatccaacttacaagggaagtgaaggacctcttcaaggagaactacaaaccactgctcgatgaaacaagaggacacaaacaaatggaagaacattccatgctcatggataggaagaatcaatattgtgaaaacggccgtactgcccaaggtaatttatagattcaatgccatccccatcaagctaccaatgactttcttcacagaattggaaaaaactactttaaagttcatatggaaccaaaaaagagctcacattgccaagtcaatcctaagccaaaagaacaaagctggaggcatcacgctacctgacttcaaactatactacaaggctacagtaaccaaaacagcatggtactgctgccaaaacagagatatagaccaatggaacagaacagagccctcagaaataataccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaagcctaggcaataccattcaggacataggcatgggcaaggacttcatgtctaaaacaccaaaagcaatgacaacaaaagccaaaattcacaaatgatatctaattaaactcaagagcgtctgcacagcaaaagaaactaccatcagagtgaacaggcaacctacagaatgggggaaaatttttgcaatctagccatctgacaaagggctaatatccagaatctacaaagaactcaaacagatttacaagaaaaaaacaaacaaacccatcaacaagtgggcaaaggatatgaacaggcacttcttaaaagaagacatttatgcagccaaaagacacatgaaaaaatgctcatcatcactggccatcagagaaatgcaaatcaaaaccacaatgagataccatctcacaccagttagaatggcgatcattaaaaagtcaagaaacaacaggtgctggagaggatgtggagaaacaggaacacttttacactgttgctgggactgtaaactggttcaaccattgtggaagtcagtgtggcgattcctcagggatctagaactagaaataccatttgacgcagccatcccattactgggtatatacccaaaggattataaatcatgctgccataaagacacatgcacacatatatttattgcggcattagtcacaatagcaaagacctggaaccaacccaaatgtccaatgatgacagactggattaagaaaatgtggcacatatacaccatggaatactatgcagccataaaaaatgatgagttcatgtcctttgcagggacatggatgaagctggaaaccatcattctcagcaaagtatcccaaggacaaaaaaccaaacatcacatcactcataggtggtaattgaacaacaagaacacttggacacaggaaggggggcatcacacactggggattgttgtggggtggggggaggggggagggatagcattaggagatatacctaatgtaaatgatgagttaatgggtgcagcacaccaacatggcacatgtatacatatgtaacaaacctgcacgttgtgcacatgtaccctagcacttaaagtgtaataattaaaaaagaaatgaaaaaatgctcatcgtcactggccttcagagaaatgcaaatcaaaaccacaatgagataccatctcacaccagttagaatggcgatcattaaaatttcaggaaacaacaggtgttggagaggatgtggagaaataggaacacttttacactgttggtgggtctgtaaactagttcaaccattgtggaagacagtgtggtgattcctcaaggatctagaactagaaataccgtttgacccagccatcccattactgggtatatacccaaaggattataaatcatgctgctataaagacacatgcacacatttattgtgacactattcacaatagcaaagtcttggaaccaacccaaatgtccatcattgatagactggactaagaaaatttggcacatatatgccatggaatactatgcagccataaaaaggatgagttcatgtcctttgtaggaacatggatgaagctggaaaccatcattctcagcaaactatcccaaggacagaaaaccaaacaccgcatgttctcattcataggtgggaattgaacaatgacaacacttggacacagggtggggaacatcacacactggggcctgtcatggggtgaggggaggcgggagggatagcattaggagatgtacctaatgtaaatgatgagttaatgggtgcagcacaccaacatggcacatgtatacatatgtaataaacctgcacgttgtgcacatgtaccctagaacttaaagtatatattaaaaaatctacctcagagggttgtcgtgagaatt

SEQ ID NO: 7535 - DNA, 12913 bp, artificial
  synthetic oligonucleotide
aaagacagctgaagaaatgtatcctcagctaagtaaaactgagcccaacagcttagagcctgatgaaccacacgaccagtactgaccactggctgtaacagtccattctgcttaatgcctcagcctatatcacaagcctgttgtgtcattttgcctcactgcaaaatcaaggagaagaaagagggaaagcgtgggcttgtgaggcatgatcaggtacacacactctatagttacagctctttcaaaatagagccaccttttaaaaacaaatgggaataaaagaaagcttttcccacaattaaaaaaaaatagaatgaccaaaaaaagcttttctccatctaaacaaacactttttagtcctttcccatcaatgatatgctactggatttgagatgataattaattactcttccagatgcctcagcctgctcccatcctgctcagctttgcagggattcccaatatggcaatgaaaggcccctctgcaatctagccacaagacctacccctggtgaataaaacacctcagggatgtagaaatctgttcttctcccaatgggtgtggtacccccggcccaatcactcatccaaactgaaaattttagagatgctaaaagtctagggtacaacatgaatatgatcagattctttgacttgtatagccatggaccctgacctctcaaccccattctgtgcatgctggccagcatgatacttagtgatgaagaagggggctagtgctatttctttgggcccagttctgaattccctctacagaacaaatggcacactagagttggctacaaacagaggaaatttggcctaagaaaagcctgcagaatttgggacttttaacagcttgtgagcaacaatgtttggatacactttcaaaaatggtctcagaaattctaaaatgagcaggaccctgagtgactgcaaacaacatactggcagacagatggatgaaatccaatttctgattttttttaaagaaatattattcttaataaacaacttgagcctttcaccagccaagctctctctctctctctctctttgtcctctccaggcaacgtgatcacggttgtttctattcagcagttatatatcacccaagcacttaaccatccgcggaggcagagaagcatcccaaatgtagcactggaagcaggattcagagtcttggcttgcagccacaatagcctctgatacctccctaatgtggatgaatggctgtgagtcagtaggtggttcctgtcgcagctgaaggctcctactgaagctcatccaaccaggcctcagcccgctcccatcctgctcagctttgcagggattcccaacatggcaatgaaagacccctctgcaatctagccacaaaacctatccccagtgaatagaaagccttagggatgtagaaatccgttcttctcccaatgggtgtggtaatcctggcccaaaaactcatccaaactcacatgttgtaaaatgactgacgatgataatgatgtaggtgataacaacaacagccaacatttattgtgttcattcactttgtgggaatgactaactcaagacctcactgtggttttgcaaaaaacccttgttcatcaaggtgcagtcaacagagcaagggttgtggagtcagacagaagtgcagtcagattcctgctgtgccgctaaaaaaactcagtgaccccggggaagccctttagcctttttgggcttcattctcatctgataaatggggatccttttgtccactctggcctcttgctgaagatggtgcaggtttacagaggaataccagagataagggatatgaacgcttatcataaactggagtgcactctctacacaggatctggtcgagggtcacatggctggttagtggctggcctagaactaaggcccagctgtctgaactcccaggccagaaaggtggaactgttgttcccctcagttgagaggagcacagagaccaccagctggcatggagaggctgtttgacacaggaactcccaaaagcagactctcccatttccagacaccagcttctcacccccacatttcaccatcggtgcagctgcctttacctctaaatttttgcctcgcacagacacatacaacagtcacatacacacactctctcattctcacacacacatgcacaccttagctcttacagattatcagaactcacagaactggtcctgcaacctcctaggggatctgtcaacatccagagaaattctggaacccctaggctatccctattcttcaaagtgaatatttctggaggtgggcaggaatgaatgaaataaaaaggtgcccttgaggtagcaatgcatttctctagcaagttttatttcatttttgcaaacaccgtaaaatccagtaactgtgactttttagaacatggttgctctttgattagactagatgctactgtagtatcacccttttaataaccaagaaaatcctatgtcatttcaaataattttgcttcaatttgggacaatccaagaggctttgaggggttctggttatcttctggagaatgcgggaaggaatctgccagaggacagtagccaccaaacagataatctagaccacattaataatgtgtgtttatagacatcatactctgacctacatgttcaaaaggatcagtaaaggcacatgtgccccatggaactccagacaaggccatggctttcatggtgaccaagaccttgttttcacttctctgctatagtcatggctgtggaattctacttttgcccagaagagctttttaaatattaccacctctcaatacacctacaaggtctgtcagtatgagaaattcttttcaatattgccaaattgtttgggaacttattaaacaccagaatattgttgtgacaatgacttacacaattgtaccaatggattgaggtcctggggctaaggttttcttggggtggaagaaaaaatttgttagtattggaaaggaaatacaagtttggcagattctgacacaattccagcatttgagaaaggacagtgtaaactgagagaagagagagtgaagaggagagccagggggtgatgttccccttaaatctcaatggtaatctgaaagtcagagggctctagggctctatttgctgcagttggacagaaaaatccacactggttgttgcgttctaacagtcacctgcaaagcatccccttgtccagggtaccaagtgcacccgggggatggggatgggacacagacatgtccttgccggcccagagaccccatccagaggcctccaggccatgaaactcaccttgtgcaccccctggactccctgcttcagcccagatttgttttaaggagacttgcgaaacagtagccctggctggactaactgcaccccatagcactcacttcccccaccccaccaccacccactttacagtactgcatgacctctagcaactggacatcgcgtctggagggaggaaaatacccttgcttctggctacagactattaataaatcagcttttaccgcatcagcccaggctcacagaacatgggctggcagcgccccatgctggggctcaagctttttaaatattttttgtaaatcaggagaggctcctggtgactgaaccccacatggggtccagggcaccatcccagcccgcccttcggtccgcggggtgccccccgccactcccaaagagccacggatgcctctcatgcagccagtagtgataagcaagcctgggaaccatgagctctccttggatgtcggaaaatagcgacagagggacacccagtcgcccgggaagaccagagccagagcggggaaggagcgaggtgataaaagtccggcaagaagagaaaaacagaaagggtaagagagaaaaagaataaaagcgagagaggggaatggaaagaaggaaacagcgagcaaacaggagcagacaacatctaggacacaagagagaaagagggagaacaaggcaaatagacgaaataggggggaaagcggggggagggaagaatgcgggcgccgaaaggaggaagagagcgctgaaaggagacttcggaacccgggtgcagagtagaagaaagcagggatccagagacgctgcacggagagcgcggctctttagggctctccagtgcggagactgagtacgatgccccgtcccagcggccccgttccggccgctcggccgcctcccccgcacgctctgccaaccatcacgcaggccaccctgcggacagacagacggtcagtccggggccggagcggaaagcctttctgtggccgccacagcgcggcgaacgtgcgctactgggcgcccagcacctgcccagccggggtgcaaacgcccgggcgtcagggtgcgcgctaggtccccggcttgggccagccgcgcctcccagccctccgcccgcctaggcccgggtcccgctcgactaccggcgcgcactcacctggacggtctcagcctggcgtcgcgcttgccgtccaccacggagggcacacagctggtgagctcggtccagtcggcgtgcaacccgcagctccagcccgtggagaacctggagaagagccaggtttcccgcttacccggccggtggcaagtgcatttcttctgacccacgcggcactcgcacggctgctccagctggatgttacgcaccaagtggcggccgaaagtggtgcccccggtcttctggatgtgcaggaacacgatcaggtcatcgcccttgatgtcgaagtctaccttgcgcaggaggtcgccgcgggtgaaattgtagcggggcacgaacctggcggagctctcatcctccgagcggtacgggtccggcaccggggagctgaacgcctgcaggcggaggagctggcattctgtgccggggcacacgtattggaggacgatcacggcaaataggaagagcatcaccaaagctagcagcagcttgttggatttctcatccatgttcccgacgctgggggaaacccaagctcgttacgtcaatcccgcagctcagcccgcgctcgtcgtgcccccgcaccgcccccttcccctggagccgctgctgcgcccctctccccctcccctccgcaccgagtactccacggcggcggcggctgcggcggcggctcccttccccgcttccttccttcccggcaggctcagcgctgtggcttctgcggcacacacacacccccaccccgactccttcccgcgggccgttcgccccctccccccgccagagctctccggagctccccggagcccctccacggggtttagccccagtgggacccctccgggcccagtcgccccactcctcaactcacgcccccagtccgggcccccgcgtgtctcgctccactctcggtggctcccgctcccatccccatcccgcttcgtccgccggactctccgggctcttctgcccctatcctctttggagcgcacacctctgtccgggtttctccccgcatgccccgaagccctccttttgccggcgcccgcgcccgcttgcccacccggtaggcggcctcgagggagctcggagccgggggctcagagttaccctgggggaatgagccggccggcagcccgacttgctatcggagacgctgcgctgccggtgcccgcggaacagtagcgacggagccgcggcgtgggcaaatgcgcgccgcacccctccggagaccctagccgggccaccaatggccagctggaactttacgcccttctctaccccccgcggctgccttccctccccgtacagcaccttcgcgccctggcctgggagcgcgaaccccgctttcacctagaacgtacctggccatggggccgaaaatcttggagaagatcgcaccgagcacgtgcttcagcgagtggcccagggcggccaggccccgagtgagcagggcccggcagagggagcccaggtcccagcgtcgcctgaggacgtgcatccgcctgcggcggccccgggacagcagcgcgaaaagcggggcgcacgcggctcccgccagggaagaagacgcctttcggggcttgtccaggagcggccgggtgtggaatccgtgagacacacccctaggagggcccgcgcgaactgaggcggcgaccgacccgggccggctcgctgccaattcggcctctactctggaatgccggcggggacaggtggtgcggacgggcgctcctcgctccggttgccgcggcggctcgaactcccggactgcacacgcaggcagtgccattccccccttcaggcaactcagggtactaaggatcacgagcgagcttgaatttatataataatgcctcacgcctaagagctcgagccacttcacaagcagagaacctgggttttctcttttcttggagtacggaggtcactccgcttagcgcatcactccactttggctcgtaatttcaacctctcctaaaatagcaaaggcgcaaattggagcttttccgtctctctttgccaatttccattctccagcggaagcgggggcattttctgaaaaggtaagtcagcatgataaaaagacagcaggaccaaaaagcattacagaatgagaatctgaccttttttagagcacagactgtcttcttgctgaatcctgtgtaccaaaccctgtgcctgcaggagggcttgactcataaaaggtttgttgaatgaatggatacataactaaaaactccatcagagtgagaccgtctaatccaaggtaatgtgacacatgaggaaactgaggcccagagaggggtagggatgtgcccaaggtcacacagcagagccccagggtttgaacccaagaaacccagcaccatccacctatttcctgatactaacaccaccttctctaataaataggcacagatcttcctcaagctccagtgtccgaaaggctcttttctgctgctggaccaggaatgcagggtttaacagggaaagaatggatgttccttcaggaaaaggaccctgggaactcaggagtcagtctgtccccatctgattgatcaaaggggcttgctgtacatcaggacactggtgtttccgtgactgagtgtgcaactccctccagtcccactgctacagaaggggcaccggttggcagcagtgtttctgagcagtgctgttggcactggggccactgagtgggagaatgcagaccacgagctgagtcctggggtgggggcatgtccctcctggagacaggctctcccagtatctcccttgctgagctctgctccatccgtttcctgttctatctatgccatgaagcggcaagcctaagaatagtccagaagtcctgggaaatctgtccctgggcagcactgggataatcacttgcccctcctgagcctcagttttcttgtctgtaagataggaccaattatgtcccctgttttgaccaactgagtcaccgtggggatgaaatgtagaaacctttaggccactccaaatgtgaggctgtgtttacctgttgctctaagctcaatgtgccaactgcgtcacaggccaaataaggaacaggccgttctcaggcaattctgtggctgtgcaccctgtctttaccaccccctagaattcccagccctggctagacttctacgtgcccccaaacctactggggaccgtgagggaccctttgtccagctgcagacataagggatagtggattttttgggaatcctgaatttctagcactccaggcatctcctgtcctgaggttccaggaacactctgaaaacccaatgaacttgtgcgaagaagccagatgcagtaacttacaaggttgacctctcagcttccccaagagctcccctggtgcccaggctggtagtcctaggcctgctccccctgagggcagcttagggtgtgagccagggtagtgggaagctatgggggtggccccggagctctgcttgccagctgcccctgccttctgcttggccactcactgcagtcaacctctttagcctacccaataggtggctctcctcatggtgtcgcataaagattccctgccattacaccacctttgtatgtaatggcattcattgggtccctaggaaaatatttctgaaacaggtgggtcacaaattcaagccctcagcagctaaactacggagtttctactgtaagagggattagtggcattggaacacaagaaagtgccttgggtggagggaagggggaggtggtaaacagtacggggggaaaagtcaggttttactcatttgagttgtgaaaaggaaggtgtccacacacctgcacacacactcacagtccaaccttcagagaaagggccagtgaggttggtagttgcagagcaagagggacaaggtggggctgtaaagttcagtttctgagatataatatgtcactaggatttttgcatttagaagcccttcctccaccccctcatgctgtgaggaacaaagaaatgaatctctcatacaggaattcatatatcagggctcctggaagtataagaaaacagtctttgtggggagcagggagtcccacaaacctcagaagatccctccaggattgaagaggctttttgctgagaagcagggaatttttcctacgtgtgtcccaagagccatgttctcccgaggccaaggctgggccttggctgcatgttgaagaggcttcttgtaatctcggctggtctctgctcccaggagccagttcctctcaggcagtgaatgacaaaggctcaaatgctctagattttggccttttggggaaagactgggggtaggaggcaaaaaaaaaaaaaagggaagagaactggccgaactgtcaagtgttcggttttccatctccttaattctaacaccaactggagttgctgtgtatgcatatatttgggattcagtacctggaaggcgaggagaactctgtcatctgagcagggcttctggttgtctctatggtgtggtatgattttcattattttcccagaaccgtccttccatggtttccaatgaaaaggctgatgattctgggagcataaaggtcagcctggcttgcatgcgaagcagcacaaggccagacatgcatttggttcctgtaatctgagacaacagtgggaggtagttacaagagcactggcctgggagtccagagacctgggctcatgtcttgactctgacactaatgagactatatatatatatatatgaccctgaggaagccacttgctcacttttgggctcaacttccttatctgtgagatggcaaggttgactttgtgattcaagaggcacttccctgatctgacattccttgtcacatgtttacctttactgtcttcctcaaaggctgaaggactgccaaagactcagggccttagcccggggggaatgacttagacctggttctacctgcattctgtggcatttgcatcactggatcccaccaggccagcagcagctgcagttgttctgggcccatattacaagggtgacagcagggtaccctgttcaaattagaacagaaatagtggaaacttcatattaaagaaagcatgacattctttccagaaagcatagattatgccttcccctcatcctgagcattctcttcaaccctggctttctagctgtctctcattttgtgaaaacgttcatactctcaataataggcaattctgtcacaaagatggaaggcatgcaaactactgagttgactggtttctgttcttacgtgtctctccaaacggaatgaatagcagtacttaatgaaaacactgtccggcaattcaggctttaatattataaacaggctgggtgtgttatatgcatcactctcaatagtcatttagtttcccccacagaacactgagttttatttttctagcctaacaaaacgtggggctcaaggagttaaaaaaaaggaggtgccagggtgctgtatatgctaaatgaatatgtgctgagaaggtaggataagcactggaatggggctcatagtagacccaaccctgtgaacaagcagcccaatgaccggccctctactgatgaagggttcccaccatttcactagcagtgaaattccctttttttttttgagatggagtctcactctgtcaccctggctggagtgcagtggtatgttctcagctcactgcagcctccacctcctgggttcaagcgattctcatgcctcaacctccaagtagctgggattacagacatgcaccaccatgcctggctactttttgtatttttagtagagatggggtttggccatgttggccaggctggtctcgaacttgtgaccgcaggtgatccacccacctcggcctcccaaagtgctggaattacaggcatgggccactgtgcccagccaaaattcccacttttcactgacaacgaatggaagagtcagctcatgcagggcttttaaagctacaataagccaaggcctagcaaccataggcagcaggccagactgttcctggaatagtcatctcacttctttgggcctcagtttccactcttagaaaatatcctgggctcggtttggtggctcacacttgtagttccaacactttgggaggccaaggcaggtggatcgctggagcacagaagtttgagaccagcctgggcaacatagtgaaaccccgtgtctacaaaaaaaaaaaaaaaaaaaaaaaatacaaaaaattagctgggcgtcgtggcatgtacctgtggttccaagctactcgggaggctgaggttggaggatccattgagcctgagagattgagggtgcagtgagccatgaccatactactgcactccagcctgggtgacagagtgagaccctgtctcaaaaaaagagaaaaaaaaaaaaaagaagaagaagaaagtagcctgaccaggtacctccaaaaagctggtttaggggtatagtaaagaggaatccaatctcaaatgagtgcttttaaagagaagagagcataggtttggagagcacactgccctgtggggtttaattagggctctgtgagttcatcagaacctcaattttctcatccatgaaaatgaggttaatgatggctacctcagtgggctgtcatgcgagttaactaaaataatctactgagaacacttagtctagttcttgaaaaagcagaccttcagaaaatgcttgcttttttccgcctcttttgactcaatgtctttgatttgatatctttgttatatcttcacagtagcaacacacatatacttaatgacaggcaactggctatgggcctaattttgtcctaggctggctttgccacatcctatttttttatctgcagtcttttctcaccctccctccatgtctctctagtgctctcctggctcatgtcccatggaggaggaaagcctctgatccactgtgtcacattgagggatgggacaaatacacgtgtccccttccaagatatatcaacaagaaaagaggagatggcattgcttaaccctaatgaatggtccttcccatgggatactaggaaacacagaaaatagggcactggaggagatgcttggagagctgagatagagagctataggtaagtaaagaggagagcttacggggcgagccctactttaaactcttgacactaattttaagctccattcacttcaaaagttaatggttgatctggccggaggggtttccatttgagcaactagtcaaaccacagcagttgggattaaaaaacaaggtcaagtttgcattcatcctgcttgagccttagctgaacaagccccatcaactgagccctgggctggcagcaccagttcacagtggcagagtagaaaaagcaccaagtgggatgccaagaaaacaatgtttgagtcccagttctgcctctggctcactgtgtgaccctgggtgagtcacttgatgtctctgggatttagttgccaactttcgtaaaatgaggggctgccttagatgaccgggaaagcccctcccagcaggagccttatgtgatctgagctatgctagctaatgagaaggctggggagggacaccactctcttctggctgttgtgtcagcaaagatacactaccaaatatgaccctccagttagtcactgagtcacaaaagcggaagaaggacttaaatgaggagcaaagtttctcagatcatagggataagacagaaagttgaaaataaggcttctgggcctctactgacttggatggtaaagtcaaggctgaaagattgggaaaaagtcatgtcaagaacttacctccaaggccaggcgcagcggctcatgcctgtaattccagcaatttgggaggccgaggtggatggatcacctgaggtcaggagttcgagaacagcctggtcaacatggtgaaactttactaaaatacatctctgctaaaaatacaaaaattagctgggtgtggtcgtgtgtgcctataatcccagctacttgggagactgaggcaggataatcgcctggacctgggaggcagaggctgcagtcagccgagaacatgccactgcactccagcctgggcaacagagcaagacttcatctcaaaataaaaataaagaagtgacctccagctaacacaacagcctaaggtaggttttaataacggtaatgataaaaacaaaaatggccttgcctgacccacagtttcccatttatgtttatactctgggatctcagcaagagaggaacacacccattgcatgactggtctctgtgggagtcctagttctgaatactaaaatacaagagttgaaaattatatcttaggtcaacctggagaatttgaaggaagcaggcttcaaggccaaagttgctcccaggaaaaggatttatttgtcattcaaatgggctggaaaggaaatgccttataagcataa

SEQ ID NO: 7536 - DNA, 1340 bp, artificial
  synthetic oligonucleotide
tgaaaaattattacctgatggatgagaaatggttttggcatttaaaaacagaaaatgcttctccatatctcttctaaattatgtctgatgttgacattagcatttgtgtaattcatccaattgtgggagccatcatgtactaattcttaacagaagtaaaagctattacagtgaggaataacattccttcaaaaggcttcatttcagtcctcttcttctatgcattttgtatcaattccatggtatttaacttattttgctttaattctgttctggcaaatgctgaagaggacataagggggcacctagaattaaagccgaaatgaacgagacagtaggccttagtccaaacgtttgcattcattcaggagaggcttaatgggcaatattgaaaggtatcagatttctttttgtaacgagggccaaatcttcacttaacagaaggcaattttgataaatagacaaaatataaggcttaattttggggcaatcttaacagaaaattataatatgcctatctgtgataagaccagaggaaagcatcatcctacctcagtttccccacagtagttggtttggaaggctaaaagcaaaaagatccaaaatgtctgcaaatgaaactgagtacaggtttaggagccgtctttccacagtaaagacccgggcatcaggaccacatcccatcagctcagtctgaagacagggagtggttcatgctcattaagctgaccaacctgtgtctccaccagggagaacatggtggcagccagggttgttgctaaggtgctctgcgtactacgccaacaagggtcatcttgccaagctgaaaacaggcagatgagtattgtcggtgatgggactagtccatgcaaaagaaaggaaccatcaaagagtgcattctaaaaatagacaagtacagtgtgacatagagtaggtgaccaaaaagggtcctaaagggagtctgggaccatattttatagagcttcttatgccatactgagtttgtatttggttttggagaaaagtaagcccttgggcaaagaggagagcattctataaatggggaaagactggcaagatatccttcttcctcttctctccctggggattcatcaggacagacttagctcaaacactatcaccacagattctgtgagactctctgaccaaccccatcactctacacacacagacacactccacagataatacttcctccttgacgttcccatttcacctcgtaattgcctttatcctgcacttagagcaatctagtgtgtgaatctgtgaacatgcctgcttcctcaactagagcatgcatctgctgaagatcagggaat

SEQ ID NO: 7537 - DNA, 2874 bp, artificial
  synthetic oligonucleotide
caataaatcgtatatatcactagctcacctattaatatctacttccttttggaatagagcagaaggtcttaatgctacaaagacacatcacagtcagtcagtatagttcaacacctttatttgacatgtgaagaaacaggcccagaaagggtgaggtggcttgataaaggacctagtcaatatcagaactagaggtgagtgaggttcaagtctcttgacatcgaatctagtgcactttctctataaaattcttcctctcaaaaaatcatatggcacatgtaatctgcagcatctttcaaaaaaaatatcaattcaaagattttttttctgtttagatatgactcctctggcagcaaatcttttaccttttgaaactgaaaagtactaactgaaatttcacttggaccgattcaccagagaaatcatatttgcatctacatgttgtatatataatgtaaatagatttttatctttctgtctttggcttagtttgatgcttcagtttggctgcactcatctgcaggcaccaactagcaggaaatgctgcaccattggaaggaatacaccatgccctgcaagcaatctgaagtcatagcaacctaggtccattgagatggcacctcactgtgtaccaagaacaaagagactctaaataacattctgtttcccattcatgatcatcccggcagccatggagtagccagaggtcacccatcttttactatgtcaccaaattagacagtacttaaagactgtcttattctagaaactcctctggaggggaatatgatcaggtatcaacataggtagcttcagacaagaaaaaggaaactgctgcaaaacggacaaccctcccctatatgcatactgccaaagggccaaatgtccttccctcacacgggcagtttttatgggtaagtgaactcagggttccaatttttgtaaatagtataatattcctccaaacaaattacaaaatccatgatagaccctagctgaagtacaagcaaaaatggatcatcggttacatggacatttatgaactgatctaagtgcagcagtcctaggtatagcaatgtgtttacagaaatatgaatcctccgttgaacagcaacaagagtacaaacacctgtcctcattcccttcatttttgattccccacacctgcagttctggggaccgctactgctaggaggggaaatggaattattccccactctctgagggagctgcattcccaattcccaagggtagggttgggtgaccattttgaaggctgggtgtttgtatgtcagcaagcacatatatttatttcagctttctgaagcatttatgaacataggttagtcatatttcagccacaatatggggagataagacagccaggagttctcataggtaggttgtgaggaataaataatgaaaaagcactttgtaaaatatgaagtatgatcttaatgctcaatggcataagatacattactttaccattagcctactttatcacaagccgcctggaagggaggcaaatgctagacgtcctcagcacagcctctagttatggatgaggtcatagaaaacaaagtaactttggctggaactgtttcatctaaaataaaatccggtcattaaaatttttcagaaacattcagttcttggggtctcatgacccccatttactatttgaaataaaccttgtaataaggtattaataaaagctgatttaatccattcatttcatctggaaaaacaccactaacaatgtactgattttttttccttcataaagaaggcgacattaccaggtactcgagcctaggatagtctaataaagaggcagaacacagagttagaattgtaaatttgagccccaaacttgcaattcattttgcaatactgaagccaggaaactaacaccactttgaaacactggtatataacagagaactgagaccaaactatgtatacaaggctgacaccatggaaaaattgaataaacaaatattggcgtaggcctatagcttctgaaaaacaagcaaactttcttgcaaagctgaagatacaatgtgaataagtgctttctcttttttacggaatttataatcaaaatgagaagaaaaatatgtatgatataaagaaaggacagggccgtctataaaatactacaggcagaacctgtcatcattcttctttctgcaccgccacccatcttacacccacaaaaagagaaaacattctggccctaaacagctaccactgtaaattgcatatttaatgaaggctattcataaatgttcccatgccttcttttaaaagcaagctcccaggccaggtgcagtggcttatgcctgtaatcccagcactctgggaagcggaggcagatggatcacttgagcctaggagttcgagaccagcctggacaacatggagaaaccctgtccctacaaaaaaaaatacaaaaattagctgggcgtggtggcacacacctgtagtcccagctacttgggaggctgaagcaggagaatcacttgaaccccagaggcagaggttgcagtgagtgaggattgcttgagcccagaaggtcaaggctgtagtgagctatgttcataccactgcactccaccctgagtgacagaaggatactctgtcccccccaaaaaaaagcaagcaggctcccatacatatttacattttacataaatgaaatgttatgatgcctagattttgcttcaaaataatctcatgctgttaggaagggggagcaggtagagattacatcccattcatcatgggttgataattgttatagacagatgatgaggacataaagtttctttgtattacttttcagctttcacatttttgaacatttcc

SEQ ID NO: 7538 - DNA, 1130 bp, artificial
  synthetic oligonucleotide
tatacctttcaaatctgaatttgcatttctcaatcccaaagtgtacattaccaaagagtaataaaaataagaaaacgagacaaaaattattttctttcaagtattttggtgaaatggatgatgctttaagaagagaaccatttgttttgaaaagtttagagggagctatggcctggaggcagattaataacctctagaagggtcgttaggctcaatgactatgagaaactaacatttctaggtcagttctcctctgctgacatgagtacagactgtcatcaattatataaaatcgagtatgtgtttatcttactgaataggttaaggtcaagatatatggcagtgtggtacaggtggtgtgtgttttaattatcattttttcacaacttcatgaaaacatgtgaagagaacaaagatatactgagaaatcccgctaagttacctaagcaaatctcacggaataaaaatgaagtacccatgaggtggtgtgccaacccatgaatgcagtaagtggaaagacggagccaggtaatgactatatgagtttctaaccatttctgggtatctccaataatcccaagcaagagttttgaaaagcaaaacaacttcaactcacatttattttaaactacacttagcttagtgatcttggataagccaattcctctattagggcccattaaacaaatcgggaaatgatcatagaactctctttgaggactccattctgtgagactatacttctaagtacaaaatacttacattggatttcttaagacaggccaaataaaagatactttctccaacagttagatggtatgcactaaatctggacttgcataccaggggcacaatacaaaaaaacatgggaggatgggtagggaagggatattctaggtttggcaattgggaatagaagatattcaaaagccagcaagcatccattcattcattaaataaatatgtatggagtactagaaagcattacattaagctttaggtatagaagaatgaaaaaaccccacaaaatccatgctctcgaaaaattttaattctagcagggggatagaaaatacagtacatacacacaaaatatggagaacaccagatggtggcaactgctaaagaaa

SEQ ID NO: 7539 - DNA, 704 bp, artificial
  synthetic oligonucleotide
aggcagaaggctttggtcaattacccagcaagagaaatgcttagagctaagtgtgccaggaatcttgcagcaagtaagtggctggatgagtccattatctggagattccaatcagcacaaaacacaacattgcaggaaaattctaaagaacttgtggaacaagaggaatgcaatatatttcaagatgtaaagttagatgcagtgcttaaattaaattacttctttatatataataagcaaaaacaatttggattatcaaggcggttattttggaggtgttccgctaattaagaatgagctaattattaactcatatcaatagagtgcttactgtagatttaaaaattcataattttctgatagggagactcctacgcaagtaacatgtcctcttcttccatttgttattcgagatgttttttaatggctcatttaataatgtatgacccttatactacttttatttactccaattacagagaaaatggtataaaaatcagttgtagcacagttcacatgataaattctactcaaagcccaagtctggcattgtgaaaggcaattacgtgatattttgacaattataaggaagtctttaattgtgccttacattgcataatggcattccaagagaaggagaaggtgcattttcatgagaaattaaggaggacgacagagaggaaaggaaaacgaatatcttttat

SEQ ID NO: 7540 - DNA, 528 bp, artificial
  synthetic oligonucleotide
atgcaatagtccaaaaggattaacaacataattaattattattctaatatcaaatgccatatatagaagcaggcttggtgctgcagtacacttgtaccaatgtgacacagttttttgcctaaatgtttggtcttcagattacctagtgagagcatttttctctttgtttatttcgtttgcctggttctgggcactgtcctaccttattggatgcttggactgtgcattcccttcattgcctagaataagactgagtaaataaaacattataagggactttagggatcatccattggaacgctctaattttacatcataggaaacctgggaaggtaaagggttggccccaaggtcacctggctgcttagtaaagacatccagcacaggggccacagtacatggtaggcagtcaaatatcttattacccaataaagaaataactacttaggtaagattaacaggaattcctaccctgggtaatacattgggcacccaatgtaatccttgaatctctagaaaactacaaaa

SEQ ID NO: 7541 - DNA, 1455 bp, artificial
  synthetic oligonucleotide
catctcttccaaaatctgcattcagtgtgacaacacttgaaattggtgatggtggaattatttacaccttagaaattgacaaatgccacatatcaggttttttctcttcttttggagagtcacttgttaaacaaaaagcataccactttttgtagtctctagactttccttgtgaacacataaaattataatttgaggttacttttaaagaaaatgaaatttgagcaaattaatctttgtgtgtatagcacgttttcatgaagtattaagaaaaatatgtttttctccataaaagatctataaacccaaatagccttgccctaaaatttctgctataatttaatctctctcctgtacccatataaacaagcatgaaaacatgagtgtggagagaggaagtcacaccaagaatttatagaacgtgaaaatttcaaggccaggtatggtggctcacacttgtaatcccagaactttgtgagactaaggtgagaggattgcttgaggccagaagttccagacaagcctgggcaacatagggacatcccatttcaacaaaaaaagtaaaaaatcagttgggcatggtggtagtgcctctagtcctagctactcagggggctgaggcatgaggactgcttgagcccaggagttcaagactgcagtgaaccatgatcatgccactgcactccagcctgggtgacagagtgagaccctgtctcaaaattttttctttcaattagtagccattgacagagtagaccccagatgagttaaagcagcagtccccaaccttgttggtaccagggatcagttttgtggaagacaaattttccacagaccgggggtggagggatggtttcgggataaaattggatccacctcaggatcataagacattagattctcataaggagtgtgcaacctagatcccttgcatgtgcagtttacaatagggttcatgctcctatgaaaatctaataccgctgctgagctgacaggaggtggagctcaggtggtaatgtttgctcgcccggctgcttacctctcactgtgtggcccggttcctaacaggccaccgcccagtaccagtccacggcccggagtttggaaacccctgagttaaagggcaaaggactggacctcttaggaatcaagaagccaggtcccactttaagttctgaatagggtcactttcacctttcctaggtttctacctcttgggcttatctgcccaaacagagattaacccttttggattcctctaccttgtgacttactttttaaatgccaatacttagagaaactaccaaagaagagacccaagatgactgtgaagagcagtgggtagaacaagtgtgtgcaaaaggagaaggtgtcacagttatagttaggattcactctttttttcatctagcaaacgagctaaggtcactatcagaccacttgatgaaggaactt

SEQ ID NO: 7542 - DNA, 318 bp, artificial
  synthetic oligonucleotide
tgcccacttaacgatcgaaaacaaaatgggccccgccacaggggcaggcttcttttattgccagtgtatggctccaccctcaaagatcctgattggttgtgactgaaacaattgaccaggatactgtctactcccaccttctctataacaggaaagtccgtccacaccccgggcctttgctccttattggtgggaaggattattgcttggaggtgttgcgcgtgcagtggcaggaactgtggggaatggaaggaaaaaactatcacaaagtaactcccacgagactttctgcgtggttcccgcaatgaattcaaataa

SEQ ID NO: 7543 - DNA, 1254 bp, artificial
  synthetic oligonucleotide
gcatgaactcttggaggaaagcaacacagatccagttccctatggcataaatgtaaaggatccaagcagaggaacccagtaaaatgtgggggttgtgaagatgaatgagagtcaagctcacttaggaccacagtcccaaacagctaaggtttgtttcaaatcacgtcttctatacacaactgagtgaataataactggaacctgtaaacatcaggggccgaacccaagagagaatagactaccctgtaacaatatatactaattaaattcaacttggtgaggtttagttctaatatgacttaattcatattgtgtcttgttattgatttgtggccgaagtgaagcaaagctctctttacagctagcacattttgaagtgccacccacaaacaggaaaacatgcaaatgcgatgtcttctaaagtgctgcagttccactatagccattaaagatgacaagtatgtggactttgttgatctatgggaatgtgtatgcacaacaatgttaagtgaaacagtgtgtgcacattgattacagccctgcaggaacccagtctgtacatcagccaagatcataagtgaacatggagcaacacaaatagaattgaatatgcatgacattctgagtcctctttttttccagtagagttgtttaagctcacaataaaaataaatgctactcaggaggctgaggtgggtagatctcttgagcccaggagttcgaggttacagtgagctatgatcaatgccactgcattccagcctgggcaacagagagacgctgtttcaaaaaaaaaatagatatataaattgaaggggtgaaaaatattgctgcgcttctaaacctgtgtagtagtgaagcatgtactgaaatccaagtccatccactccagaaagagagtaaacagtggaaagatgacatagtgacacagcaaacaaagggacctgcttagaaacacaatactgaggcagtgatgggctaaagcagaattttaatgatactgtagattagctggatgttttcaagcagtatgcattctgtttgaacagtactcccttcccaacaattaagggagactatttacttttcatacacctgcactttgaatcatgtatgtaattatcagtttttcaaatggacctgaggaagcattgcaattgctagagaagtgttaggccaaaattttaaggccttagtttgtctctagagcagggaatagaggccctcttagacagccatgagaccagagagacc

SEQ ID NO: 7544 - DNA, 3026 bp, artificial
  synthetic oligonucleotide
tactccaaaaggttttacagaggaaaatctaataaagggactatttgcaataatatgcacagggttaagggaaccaacaagggatgctgcagcaccctggggcaagcaacagcaagtctctaccacccctagcccaaagaggcaagcagcaggaatggtttcgggaaagcatggcaagaattgaagctggtagagaggggctgcctcccagaagctatggcaatgggtagaagaatgaagccactactaaaacacagcctgcaaggcagggagccaacggaataaatatgccagtctcttgtacctcccaacttctcacttcctgtgaaactttcatttcctgccattcctcccaaatgtggaatcctacctgaagccagagggcagaagagccttggtgattgagtccacagaggtcagcctcttagggcagagcagggcaaagaatgagttacagtagggttatgggggacaccaacagggaccaaccagcacactctacaacctgattatagagtccgtgagaacagagactgtattgttatcattattattattattattattttgagatagggtctcactctgttgcccaggctgcagtgtggtagtgtcattatggctcactgcagcaggtgatcctcccatctcagcctcccaaggggctgggaccacaggcatgtgccaccatgcttggctaaatttttgaattgtagagatgaggtcttgctatgttgcccaggctggtcttgaacccttggccccaagcaatcttcctgcctcagtctcccaaggtcaggattacagatgttagccactgcacctggcccagacaatgtatcttgttcatttttatgccaccagcctttaggggcaatgactcaataactatttattgaattaatacatgattaaatggagtgagctattatcattttcacctacatgctaatgaaagtaataactgagtagctatgaatgaggacatgcacaaatatacacaatatcaactatgacatgggaaaattagcatgaatggattattcttagagaaaagcaatagaaaaaggagtattaaaataatataaaatcaggcacctggctctgatcaattcactagagaatttttctaaggaacaatccttctattaaacaatctgttaaaaaatatagaaaagggtgtcttaccaaacttgttttatgagacaaatatgttttttaaaatatatataaggaaacaacaatataaagaaagaaaagtacaggttagtcttgtgaatatgaatacagaacttctaaaaaatactgtagcaaaaagaatgcagtactgctgtgacccggtggaaggcttacaaaaaaattataatgttacgaacactgttttttgtattttattttgttttcgagacaggttctcactgtcacccaggcaggagtgcagtggcgtgatcatggcttactgcagctttgaccttctgggctcaagcaaccctcacacctcagcctcccaagtagctgggactacaggtgtgcactaccatgcctggctaatttttgtatttttttgtagagatgggatttcaccatgttgcccaggctggtgtcaagctcctgggctcaagggatccacccacttttgcctcccaaagtactgggattataggcataagccaccgcacccagccttgaaacactgttaacataagatatcatattaatggacaaaatataaaaatcctatccacgtatgccttcaacaaatatgtattgagagcctagtatttatcaagtactgttctagacactggggatacaacagtgaacaagacaggcaatgagcctggctctcttgaagcctctagtctcatggtggagatagataacaagccagtagctaactagaatagtttcacagggtgacaagtgctttgaagaaaataagacaggatgacacgatagagtgactgcaggtgggggatgggggtcatattagataaccttaccaaagatgttttgagctgatgcttgatatttcaaaagttggtgagaccgggtacgggggctcacgcctgtaatcccaacactttgggaggccgaagtgggagaattgcttgaactcacgagttcaagaccagctggggctacatagtgagacccatctctacaaaaattttttaaaaatcagccaggtgtggtagtacaggcctgtggtcccagctactgaggaggctgaagtgggaagatcgcttgaacctgggaagttgagactgcagtgagctgtgatcatgccactgcactcgagactctgtctcaaaagaaaaaaagaaaaaaagagaatgctggcgagaagacatttcttaaagttcaaagcttccactgattaaacaaaataaaaaggcatgggaagttttctttcttaggaggaacattctgcaagcctaaattcaagagccagaggcaccggagactctaataaaaacgtaagtataacaaggatgtctctttcatcagtcttaattaactttttaataaaatgagactgaagaaaaagaataagttataaatatgtgaaagaaaaataaaaatgtcactcgctcaaatgacaggactctataaggaagatgtccatggcatcaacacaaaattcattaaaaataataaagatgttcagcaaagaagcataagattaataacaaaagttagtcacattcctaataagagtgacacaaagctagacaatatgaaaaaggggattcagaataatgacaaaatgttaaatacttggttattcccttaatttgagagaataaagatatattaaaatcacagaatactgatgggagaaggaaaggaaggcatgaataaatgatactatttaccaagataaattaatactggagagaccaagtatcgcaaaggtaactaggtttacatataaatttaatgcactacaaatgaaaaccactgagagaaattttatagaatgtgacaagttgttgggaaaattctcctgaaagaagacgatg

SEQ ID NO: 7545 - DNA, 3498 bp, artificial
  synthetic oligonucleotide
tgtgcattgattgccggctaggagccttcagccatcctgtcttagttcgttttctgctcctataacagactgggtaatttataaagaaaaatagatttatttggcttatggttctggagcctgagaagtccaaagccatggtgccagcatatgcttggcacctagtgaagaccttcctgctgtgtcctaacatggcagaatggcaagcaagcattcaagacagaggaacagggttgaaattatccttctatcaagagtctattcctattataacagcattaatccattgatgagggcacagcccttatggcctaatcacctcttaaaggccctacctctttttttttaagattgatggtgtttattgttctgaaaatagaattctgccgtttgcttggggctctggacactgcaaaactgaacaaatggaaaactcaagagtcttgctatgcatcagtgggggtgccatccaaatccaaggcaaataaacggcattcggtactcactgtgcacaaaaggagagcattttattttcatggatgtggatgaagtacaatttcttcagtaaactcaggaaaaactgttaaggggcaacaatgaactctgcatttaaagaaaaatagaaaatgaaaacacaaaatcctaaaaagtaaataaagattctgtgtcagcacactggtatcaaaacacacatcaacagcacgtcttaatcatacgggaaacaatccttgcttatcagaggtgcatatctaaattctatagcttaccaatatcttcttgggagtaggcaaaaaagaaacagaaaacctcacattaaaaaaaaaaaaaaagtttcttttccctaaatgttttcctgaagctgaatcttaaggcgagaggacgtcagtcatcctcgtcattctcactgaggtcgtcatcgttgttgtcctcctcctcttcctcctcgactgctggggtctccaccctggagccactgtactgagatccaccggagcttgtggccagcatcccaatcgcaatgttggtcaggtcactggcagaaagccacgtgccattagacctggaacctgccgtcgtgaacacacctccaaaagttccctgagccatttctgtcacgtacggctccagagcctttgggaccaaatttctggccattttaaggtcttcggcagagcagctcccggactctagcccaaaagtcatgcccatccacatcagcacttctgtgtcatcgtggatttcaaaggagctgttaaacttaaacagatattctgatttgtcgtcggagatgctgcagttgatgacggtcttcttgctactgctgatgatgatgaagggcacgtggatgactgagttgggcagcggccgctggctgacctgctcctccacatactggtttctcagcaccaggttcttgaaagcaatttgctgtagaataagttgttgaagttcagactgtttctgctttattctttcaagtctcttctgtctttccacccgtaagttctgacagttctgagccgagttggtggtcagaccaatccacttgatcttctttttctccctggagatgatattcatggccatcagcacgtttaaggcatcgtaggtgcgccgttttatgtttttcacgtcataagctgactcgtttggtgaggcgtggttgctggcagctctgaacttggcgaccagctcgcccaccacttcctggcaggaagtggtccctttcctctgcaccgtctcccagaccttcatggaaagacggcacaggcccatgccattcttctctcctttcctgttgtgctgcccggcccaaggaggtgaggagtaggaatgctggttctgagaggcaaagtgagtgctgggtgggtttgggcttcctaccacagggatgtttgatgctgctggtctctgaggcataccaattaccacttgctggtcaatgttgacactggactgtccaaaggttttcggcaagagctgcttcccgagcgggttcacggtggaggtgtgaacggccacggggcggctggtctggttctcgtccattaagaccttgagttcttcgttagcttcagtgagactgacatattttgccatgttaacagatttgggaaataaatgctataaatgttcacctttccagagaagaaaaacaattcttccaggccgagtgtagggctgccgtgaggtgcgtggcgtaacgtgcgtggcgtaacgtgcgtggcgtaacgtgcgtggcgtaacgtgcgtggcgtaacgtgcgtggcgtaacgtgcgtggcgtaacgtgcgtggcataatgtgtgtggcgtgtggtacgtggtgtgtggtacgtggcgtgtggtacgtggtgtgcagtacgtggcgtgtggtacctggcgtaacatgcgccacgtgaggtgcgcagcagcaggggggcggtccgtgcagtgcgcctgcgtgccttttcacgccttcagcctttcctcctctggccctacctcttaatactgttacaatggtaattaagtttccaacacatgaacttttggaggacacatttaaaccatagcacatcctaaagggactgatgaaaatcagacgtgtaggcctctgcaggcccgtctatcatttcttctcagccattgtctcacaagaagctggatctgggctcttgcaaggattatttcttcacctgctggtcaagaagcttattgtggaagaatccagtttttgtctctctacccaaacagctacactaagccttcctgagtagatagagatgggaaaaaggagttaacaatatacagtatcatttatttgttgggctgtggtacaatcaatagactaagtccacagcctacacctcactttggaagctacacacattgccaatgagaaagaaatctaaagagagaacaagacaaagcccagcagaagcagaggcctgtggcagtctctttctcccaccgttggtctcaactctgccttactcaccaaaagtcctaataaccatgccacacaggctctgtgtcttcaggcctgcttctctagtccacaccaacttcctctagcacctcgactctggaaataatgcatgtgattgcacacaagcatacacctcagcctcagatacacagaggtgctgtctcactcacctcgggctgccgtaacaaaacaccatagactgggtggctgaaacaatagacatttattttctcacagttctggaggctagaagtccaagatcaagtttccagcagggttggtttctggtgagggctcacttcctggctttcagatgtctgccttctcactgtgtcctcacatggcagcagggcttggagagatctcttttgacaaggacacatcctatcctatttgggacccacccttatgacctcatttaaccttaattacctcctaaagaccctatctccagatacagtcaaattgggggttagggcatcaacatatgagttttagtgggtagggggacaaaattcagtctatagca

SEQ ID NO: 7546 - DNA, 2507 bp, artificial
  synthetic oligonucleotide
ctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaattttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacgaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgagggcatcctttctctggatattctccaggagcctgggcttgtctctctgaaaattggagttgcagtagatctgaaacaaaatgaaacatgttagttgttctgggataaattattcctttcccacctctcaaaattatgattttgttttgcaatggagaaaagaatgctttaagtggcagcaagtgtggttatgctctacagcatgacctgactaaagataaacaattcatagatcaaggcagtaatatataaatagcatggattttgatattaaactgcaaccccgtagaggtaatatgcaggtctgcaaaatatgatgcttacattatctctaagggggttgtagtttaatatcaaaatccatactttttaagttctatacttttcatctttcaataaacaatatttcacattttcaaatgctatccttgacacttaagctcttacagtatattattcaaattggtgtcctatgaagatatgtttgagaaagagagaaaagggattacagaaatgctttctactttaccatcattttcttgtttcctggagagttgcttgggcgtgttttgcagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgcct

SEQ ID NO: 7547 - DNA, 2470 bp, artificial
  synthetic oligonucleotide
tgctgcttgttgtcgtactacataaagcaattgtataaattacctctcatccaagtcacaaaatatgtttgccaaaatgatttcttctaaaattgtaaaagtgaaaatagagtacacagagagaaattgagtttgctccaaggggctatgaattcaccattaagaaagcctcgaaaagagattagcaatccatctggtgtgtttgcacatcgtttagtgccattttggggcatttctgaaaatgtcagtcacggtggggaggaagagaaggaggttccattggccattaagatgatataccaagaggctgtggttatcagggcatgcagtggggcagcgcttcaccagctctgacctcagctcagtgagaattgcaaaagctccaaagtttaataaaaatcagtggctagattccagtgccagggggtttgataaagcattgtcataagcttcaggccatgttctttgaacaaaacaactctctatattcttgaatatcccccccaacacacacacacacacacagacacacacagtcttcttcaccaaagaaaactgacaaatggacaaactcatattttccaagccaatctgggaaagatctaagctaaatatgggacatcttagttaagtattttgccgaaaagtctcactctttagcagtcttaaaattaagacagactgggcacagtggctcatgcctgtaatcccagcaatttaggagactgaggcaggaggatcacttgaggccaggagttccataccagcttgggcaacatagtgagactccatctctataaaaaaaattaaaaatgatctgtgcatggtggcacatacctgtaatcctagctacttatgaagccagggtgggagggtcacttgagcccaggagttcaaggctacagtgaaccatgactacaccattgcactccagcctgggcgacagagtgagaccctgtctctaaaacaagtaaacaacaacaacagcaacaaaaacaaagatataaatataatcagaacattgtacacaaatcatgttgtgacatagttacattttatataaaataattcttctttagcaggctgtgtatcttctatgaccttctcttttactgttattagaaaattatactcccagcattacatttatatgtagtaagacagactacactttcttccacctcattacatctatttgtagtaagacagactacacttttttccacctcttggtgaaaggaattttgtctactccctatgcttaccttgtcccaaaagctgaaagtctggattctggggctattttccaaaatgacagaggatatcaaagatcatgcagaatagatcaaagtaagtgttcataatgtaaatgcctatttcctggaagaggcacactctgaatgagacaaggagataaagccctagagatctgccacgccactgagaaatgtcaaatgtgctcgtctatttcctttttctttttcccctggggaaagtgtgaatgaaagtcctactatcacaaattatgcagtcaagtttttcacatttggggaaattgcaggggtcaacacatctgagtgcaatggataaggctggccatggaaaaaccaccttcgtgatcatggtatttccactgccaggtaagtgtctcagatgattcttaatccagagttcattaccttattttctgtttcgatcggaattggaaagccatcatcaggtttgagagaaactctacaacagtataatgtaaagtcagtgagggaagggagttttgtctgttttgttcaccagtgtatctccttagtatagctaagtgtattagtccattctcatgctgctaactgggtaatttgtaaaggaaagagatttaatggacttacagtttagcgtgactggaaaggcctcaggaaacttataatcgtggtggaaagggggaagcagacatacccttcttcacatggcagcaggaagagaggtgacaagcaaaagggggaaaagccccttataaaaccatcagatctcgtgagaactcactatcatgagaatagcatggaggtaactgcccccatgattcagttacctcccaccaggttcctcccatgacaggtggggattatgagaattacaattcaagataagatttgggtggggaaacagccaaaccatatcactaagtatctagcaaatagtaagaactcaataaatattttctaatcttgttgttgaaactgtaaaacaaactgagtttaaaatctaggcagccactgtaaccatacagtcacctgttcctaaagtcaatagaaaaaagaacagaccttctccaactctatcctgtgtcccctggccttggccccgtttattcctctacctctgctacaaatccaggttgtgttcatgtgggttgtgaataagagctccatatcccagtcctgagctggccaccatgacagggtggcatggaggggaa

SEQ ID NO: 7548 - DNA, 3345 bp, artificial
  synthetic oligonucleotide
gtgaatgatgctcccccgaaagatgcccacatcctagtccccggaacctgttactttacatgacaaaagggactttgcagatgtgatgaggttaaggagcctgacttggggagagtagcctgcatgatccaggtggacccaatgtcatcacagaggtgtttataagagggaagaaagaggatcagagtcagagaaggagatgtgaccatggaggcagaagtcagagacagagtgagatttaaagatgctgccctgctggctttgaagggggaggacggatctgtccaccgaggcaggcaggcagcctctagaagctggaaaatggaaggaaacattctctgtgcagcttccagaagtgttgcagtcctgctgacatcttgattttaggacttctaacctctagaattgtacgatcataaatctgtgttgttttaggccactaacgttgtggtaaattctcacagcaacaataggaaactagggtaggaatgccatctaacagttcttcatttatttctaaaaagaaataagttaatcgatcatttccatgattttacctctccaaattggaattgcagaggtggtggcctggaagcacatgttgtagttgataggaaatatctgatgtttcttattcagtttggaactcaggaccatctttcagcatttcaaatgaagttgcttttctcctatactctcctgtacttaatcttaaaaagcataacacatcacatcattctctcattgttctcttcaaaatccttggatggtcttgtattggctacaggataaaaagcaaactcttcagcattccattcaaacacgtggccctagttgcgtttcttttcttctctttctctctctctttctctctctccctctctctctctctcttgtcttgctctgtcacctgggctggagtgcagtggtgcaatctcggttcgctgcagcctccacctcccagattcaagcgattctccttcctcagcctcctgagtagctgggactataggcctggctaattttttttaattttttttagagacagggatcccactatgttgcccaagctgatcttgaactcctagcctcaagtgatctgcccaccttggcctcccaaaatgctgggattgcaggcataagccactgtgcccagcctccttgttggttttctagattcaacttttaccatttcaagcctcctcacaccttatgttccaatccatgtggcttcatgctcctcccaattgtattagtccattttcacagtgctgatactgacatactggctgggtgtggtggttcacgcctgtaatcccagcactttgggtggctgaggtggttggatcacctgaggtcaggagatcgagaccagcctaaccaacatggtgaaaccctgtctctactaaaaatacaaaaattagctgggtgtggtggtgggcgcctttaatcccagctacttgggaggctgagacaggagaatcacttgaacccaggaggcagaggttgcagtgagctgagatagtgtcatcgcactccagcttgggcaacaagagcaaactccgtctcaaaaaaaaaaaaaaaaaatatcgagactgggtaatttataaagaaaaagaggtttagtggactcacagttccacgtggctggggaggccgcactaacatggcagaaggcaaaagacacacctttcatggcagcagataagagagaatgagaactatgctaaaggggagagtccttataaaaccatcagatctcatgagacttattcactaccacgagaacagcatggggaaaaccacccacatgattcaattgtctcccactgggtccctcccacaacacatgggaattatgggagctacagttcaaaatgagatttgggtggagacacagccaaaccatgtcagtgatcatgctgtatgtagtcccatgcaccctccccggtgcttggttaggctgttcccaaggggaaggtttacttcccttcctccccttcctgcaataaactgaggtactagatcccccagctgattcccaaaacctcccttgagccctttttacattcctcctcattacatgtttatgcatttctctatcaccctagaacatacacacgaggccaggaaaaatataaatttcttgatgatctcacctctcacttctcaccactactgtttcccctacacacatacacacacacacacacacacacacacacagccatacacatagtagtcactcaataagtgctgaaataattaatgtgtattagggtcaaacatgatagcacagcaaggagaccagtgctctttccattctgctaaggagaaaagatgacaagagtcaggattcggacttggagatgtctgggttcaaatatgtgctctggcatacactagctgtgaattttaggccaggtactgaacatctctgtgctgtagtttcctcatttgtcaaatgagaataataataccttcctttatgactatagttagtgtaatgacatgatatgttcaaagcctttagcacagtaactggtactaagtaagcactatatgtgtctgctattattgtttttcttttctttctcactctgttgcccaggctagcacacaatagcatgatctcagctcactgcagccttgatctaccaggctcaagtgatcctcttacctctgcctctcaagtagttgggactacaggagcaggtcaccatgcctggctaatttttttgtatttgtagagacagggttttgctatgttgcccaggctggtctcaaacccctgggatcaagcaatcctcccgcctcaaccacccaaagtgctgggattataggcatgagccaccatacccagccagctattatgattaacattatttttggctgcgagtggtggctcatgcctataatcccagggctttgggaggcccaggcaggagaatcacttgaggccaggagtttgagaccagcctgggcaacatagcaagaccccatgtttaccaaaaattaataaattagccaggcatgttggcatgtgcctatagttctagctactcaggaggctcaggcaggaggatcactggagcccaggagttcaaggctgcactgagctatgactgcaccactgcactccagcctgggcaacagagcaagacactgaatctaataagtaggtaaataaataaataaataatttaaaaagcattatttttactatataatccttgttggcacaggctagtcccttctcctcctattggccttgtttttcccatttcactgtaataatggttcaaacctctcaggataatctccaggattacactttattttaaa

SEQ ID NO: 7549 - DNA, 1562 bp, artificial
  synthetic oligonucleotide
gggagtgggggtgagcttgccagctgcttagaagccaagagttatccagtcagacctgaatggaaaaatctatgatttgtttatttcatagttgaagttcaaaagcaagagacaatttaaataataaaagagtaacaggaaaaaatgcaaagaaagaaaacaaatcagtaagagttcagaagaaccttcaagaatacttaatttggaaaatgttattggtttagagaatttgactggaagaaaacagctgggcagagttcaaggttttaaattaaaaacaatctaacaaggtctatggggataactctctgagccatattttggagaccagattcatttctaccaagtaaaagtaatagcagtctaagctaaaaaggaaattcctcacaactgaggtagttactaagtatcagcacattttccaagttctcacaaggccccttagctatttacaatctattttcccttatatataaatggagtgccttttcaattttatgtcttctgatttgttttaaaaaaaaaaccacttatacacaccagccagaatatgcctattttattaacatcatgctttaataaataactggctacttctaataaaattaagcctctgtttacaacagcccccaatattccattttgaccactctgcagaatttggtgtaaaaagttgaatgaaatgtagaccctgagctatcaagtaattatgtttcaatataaaaatagagaattactcttacaactgaagattgaacaataacacaaacaacctctttgtgggttttaggttcggtaaaattagttgggatcttaatggctgtctaaagcaggaagagacagaattttagtctttctgaagacttctgggaactcctttgaaagtgatttgttacattatcagagttttatgagctatcatttggtaaggacacaaggaagggattcccaaggcagttgttagtctttggcctgggacaacagatatggccatggcctttgccacttcacccacgtggctaaaggtcaccactaagatgtagtattctcagctctacctactcccaccccaccccatcccccaagaaaaacaacacatacaaaaatctggacacctagttctcccctaagtgggctccttggctgatatcttggatcgtagcacattgctgtgaaccatggcaagtcctttgttttactgataagagggggctaggtaagaaaaagactcaaatgagacaccttatactctcttaaaacaaaaactgggatcccaaaacaaatggagatacacatgcacagacaaaaactttgcccgagtgttgacagctattccctgagcccaggctgtaccccagttctggctagctctcagacagctccctgtacataattgggtttgaaatctcgaccactctaacaaaggatattaattcaaatagggtcagtgtgaacatgaaaactagcacagggtgggctagctaacctgcctggttttaaaaaaaaacacccctaaacccaagtgtgaacatgtgataactgggacatcctgaatgctttct

SEQ ID NO: 7550 - DNA, 1801 bp, artificial
  synthetic oligonucleotide
aataagagagacaaactgttccttaagggtaaggaccgcagtgaggaacatttgagaagaacagactggaaagcactatgaaaactgcaaacataagagactatgattttgcattggcctttctagaagagtgcctcacttgagttatgaagaaaacttagctctttacaaggggtttttttaaggagtgaatttaaaaggttccaaatatttaaaactacttggttcttttattctgcagagataacagcagcagtctagggataattaagttttatctagaagtcaggaatatgggtttgaagcccagctctacatgattgggaagcttttggtaaagactcttgggaaagtcagttatccactggaaccttaaaacgaaaaaagccctttgaaaacaaggaggcattatgtaaatgtaagacagtacaattgcaaaacaaagaaagaaatgaacatctcttatgctctgataagctactgaagtttcgtgttaagaaccatttctgacaacttgtactaggtgagggaggggcgccagaaaagcagcaccttgttaagttcagcctaaagctgcctccttacacatttaaagtttggtttaaaggtttccccgtacacagtgaactgtaacctaaactgggtgtgtaaacagactgtaacttgctcttgcaccaatcacaggtggccaacggttcaaaccatgttcaaataaggaaatcactgagctgtaaccaactcagctgtttctgtacctcacttccgtttcctgtacatcacttttccttttctgtccataaatcctctccaactacatggcagtactggaatccctctgaacatattctggttgtggggaggggtgatcaatttgcaaatcattctttgctcagttaaattctgttaaaattaatttgtctgttaccagtagagggtcttgactgcaagttgtccaggttcttggtgttttgaacaaataattggacaaaatgcacagcaaagcaaggaaagaatgaaacaacaaaagcagagatttacagaaaattaaagtacactccacagggtgggagccaaccaagcagtggctcatgggccccagttacagaatcttctggggtccaaataccccctagaggtttctattggccacttggtgtttaccccatgcaaatgaagtagtggcctgcaatcagaggctaaaatgaagttacaaagttacactcctatgcaaatgtctgattgggaaagcaaccaatcagaggtactttcaattttcctcctgccatgcagaaaaagggggaaggcggggcggggcatggtgttgcaaaggaagtagcctctggtccttttgtcacttaagcgtggaaagttggggttttcctttcaatttagttataggaagtcagcatgaatcagcctcaggttccctgcctccagaccctattctcctgcctcatgtccaaagtttttcttttaacaaacttttcttttctagctagttcagaaagatgtggaaatagggcacatcaaggagctgaacggcatgcatatgtgatggtgaactgatggtgaccaagccatcaaccaagggattcaaagggccatcaaaagcgaagccacaggagcttaaggagacatgatgaggaaatataatgtgatatcctggatgggatcctggaacagaataagtacattgtggggaaaaaaactaaggaaatcaaacaaaaaggtgtatgcaaatgttcatagcagcattattcataatagccaaatttccatcagcaaatgaatggataaacaa

SEQ ID NO: 7551 - DNA, 560 bp, artificial
  synthetic oligonucleotide
gaggacaagagcagaacctacctcagagagttgttagaagcattaaaattatacagtatacctcaatcaatagcagctattattatgaacactgatatcagaagatgctatatatttctcagaaaggggattctttctatgtttcagagttcagctatgtttaaccaatgggggagtgtttgttttcttgttgtttctattgttatcattactattatttttagtctttggaaatatttatttctaaaaattacagaccaaatggaaatttagctttatttagcagaaagacaaaacagtcccttgataaaaattcaggctacaacctgcaatactgctctaggattatgagctacagaatcttttctttagcttttgaaatggttctgttatgagctttgagagattaaagaaaaacaaaatattaaaggttgattcttatgagagtgccattattttaggccaaataggtcaaatatcagcaatttcacatagtctgactgaatattttggggaatcaacttagcaacaatatccaaaggtttctacagataaatatg

SEQ ID NO: 7552 - DNA, 1221 bp, artificial
  synthetic oligonucleotide
taggagactgaagccaccctctggaacatagcctttattttgtacacaaatactccagttgcacatttaaccaactctactgtctgatttctagacattcagttctgcactgggttaaaaagggtcaaagagtgaacccaaatcaatgacagcagaagtgacagctgaaaaggaaggcagaagcaactgcagcagaacagtctggggccatttagcttaggggcaaatagttcctcatacttcaaagagccctaaggacattgctgcattagagcatcatttattaaatgattctcataatggtgaccctgagtgttttttaactgattacggtttttatccttctgtttaataagttaggagaataaatactttagaaatattttcattgaaatatttaaaacatgtttaaaagacagtttgataggtaagggaaaaatctcttactcataacattttcttttcatatgaagtaagataactaagacattattttaaagctataagcaaaaggtcaacagttggtataggctgcaacttaacagcttcacaaaagttctagatgttagagaaaacagacctaagaggtgatttattaaggaaaactggtttgtttgatatacatttataacctttgaaatattccaaaaaagaacattcatttttcttctacctgagtgtgatgtccttgctggtgatacgctaccagaaaactgacccatgcagcaaggctgttactttcaaagggcatcaaatagctggttcatattactaaaaatatcaatcccagaagatatagaagaaaagagctaagtaaacatgaaaatagggtttatatcttagaatgggcttatttatttcttgaaacacagtttgccatttgggaagagagattctgctaaatacacttcacaccattcttgagttctctcaagacaacttggactcaatggaggaaatagatccaaaacactcaagaaaaaaaaaaaaacaagatgattaagtagcgccaactctcaaaccacatgccttagaacaagctgctgcatacaccagaaaagcaccattgctggtctttgccattaaatgtgtaaagtgctccagggaaatgaaatgatacaaaacctgggtaaccctgaaggctgaaataataaattttctagaacacaaaactgcataaattgtatcgttcattttcctgtaaattagagtgcccgaaag

SEQ ID NO: 7553 - DNA, 784 bp, artificial
  synthetic oligonucleotide
ctgtatatgtatccttaggggctccttacaaaacagaaatatgtgtagtagggagagtactggagagacagtcatgccagctctgaaaagagaagccctttcaaagtccctcctttttcttatcaattccttttctactcacccaccaccatcttttagaaaggtccatctgccttgatagttgaaagtagaatgaaatgacaattctccactccccaccctatgattcagaggttaaactcaactaatacctcataattgctgaactggaattttgcgaagccctttgataaggtctctggtacaaattaggagcattttaggcttctgcttaagagcatgcacgtgtcttacaaagtgctgcacttcctgcttatcacactttttgaaagttgctaggatattttagatagttagctttgaaagttcaaagtaattttcaatattctgctccttagtgtgtggcttttaaagtcctattgttggacagcatgaaagccaaatgaccctacaggtttcacttttgagtttttgctgataccagagggatgtgaacatatgctgtgccttgaaatgctctgaattccttgagtatctccattaacactttattgacaccttctcaacttctatatcaggcccactgttatggcaattggaggggtctgagatggaatctctttacttccacatatttttggactgacaataggagtgtactggattgcaagtaaaagcactccctaccagatgttcatcctcagatgaagaagaaaggaattaa

SEQ ID NO: 7554 - DNA, 632 bp, artificial
  synthetic oligonucleotide
catctcttcaactggaaaacatttatcctatgataaaccataatctctggaggtcttatgacagtatgacaactctcagtgccaggtacaaagtcctgagagcagagttgatcagggcaaggagaaaagaggggctgaagaagaagagaagatgctgtccagctcaccccaattatttcacttccaagttctaaagtggcttcagtacacaggttcttgcttccccagtgtgcaactttttccaggtttctggccactggaggtggctgtatttattattgtcatcatggtgttggtagctactcatcaggagaaccctgactcagagactaagagatatgaactcatacacaagaaagaagcagttaccactaaagacaggaagagtttgattctttagtctaaagacccaagacaacaccatggacctaaaatcctgactttctcacctgttgttttggttgatcttctattggaagatcagtagaagaaacagccatgtgaaattatgttgacaacactgattattaagctgtttagtgtcatttacgtaacagcctccataatacattctttctagattgagcaacaacaagaaaataccttgcctgaagagctctcatgtttctttt

SEQ ID NO: 7555 - DNA, 2019 bp, artificial
  synthetic oligonucleotide
tctcaaacaacattttgtgatgaatctcattggaaaatttagaataatagaatctcagagatggaagggacctaggccaggcatgctggctcacgcctgtaatcccagcactttgggaggccgaggcgggcggatcacgaggtcaggagttcgagaccagcctggccaacatggtgaaaccctgtctctactaaaaatataaaaaattagccaggagtggtggtgtgctcctgtaattccagctactcaggaggctgaagcaggagaatcacttgaacccaggaggcggaggttgcagtgagtggagatcatgccattgcacccagccttggcaacagagcaagacttcgtctcaaaaaaaaaaaaaaaaaaaaaagaaaattaaaaaaaactaccatgggccaggcacagtggctcacgcctgtaataccaatactttgggaggccaaggtgggtggatcacttgaggccaggagttcaagaccagcctggccaacatggtgaatccccatctctactaaacatacaaaaaaccagccgggtgtggcagcacacacctgtagtcccagctactcgggaagctgaggcagaaggatcgcttgaacccaggaagtggaggctgtagtaagttgagatcacgccattgcacgccagcctgggtgacaagagcaagactccatctcaaaaaaaaaaaatacacacacacacacacacattcatccatccatccatccatccatcatggcctagtccttcctgaaaaaagtattatttcattggtatggggtggtacccaggcattagtatattttaaaagctcctcaggtgccaggtggttcaatttcaccccatttttcaaagagggaagaacctcaccaaaggtatttgacaacaaatttgccagagttaggctagaactactcatcctaacaagccatgtcttctccatgtaaactactccatctacaacagtggagtctcttccctccctcactctccctctctgtccaactatccccacctatctcaaagtaaatatattttctgaatattctttgccttagaatcccattgcataatttttaaaaacctaaatgatgtatgtctgcttccctgtatcctcatgcttttttttccacacaaagaatcccgagagatcaatcaggcatggtttacccttaaagaagccatattgcttctccctagataggttggactcaacccacccttttcaccattattatcacacatgccatctttcaaatcccttgcaagattcaacttcaattctctgtcagcccacttaatttctagtttgtacctgggccttgtgaaacctagtggacttccctcttctggcttaaactctttgtattttgtgaaagatgcctttttccctgaagcagcctcttttactctgccagttagtcatgccgggttctttttttcttcccccgagcagttggtctttttgatgtctggcacacatttatctgggcttccaataagatgtttttacatagtttccaggcttcctggaggttattgacttttttaactctcccattcagttttttcccctaatttctaacatttgttagagtttctttctcaaaagttgaatacctggctgatgcagctctttgatttttctctcccaccagattgctgaattaaatgcatcagaacttaaacataatatttcaaattacctccaggatggaatcgcttcatgcattttctgcactttcatgttctctatagtaagcaacagatgtttaaccaagtagatttgaaaatgctagtttttacctgtttgtattttagtatgtctgtttatttatataaaatattctgatacccttcaaagcttgtgttcttcttggtaaagacaataaacttgagtttttttatgttaaaaggtaactgatgcacactgaacagttgcatgtggtaaatttgctctaaattgcctaatcacaacagtctcaactgttcattctttaaagaagtgtatct

SEQ ID NO: 7556 - DNA, 3034 bp, artificial
  synthetic oligonucleotide
tttgagccattcagtcatgcatttttgttattgttgaaagtggtgcgaaattgcactgcatgagctaaagtccttggtggtcttccaaggattccagctaaaaaggcacttcctttgttcctcaggagaatgcagtccagtaggtcattcaaaaggggaaataaaagcagcagcccagggagggagatgaaggacaagacaaaaagaataaaatgttttgggtgtgagcacattagcttccatttcctgctgctggtcactaataactcccctatctttggcatgggggaatgtccagatagacatatacgcaaaatatccctcaggtgatttctggggatgatgacaatcaaagggaacacctagcacagagtctctgagcacccttcaagcttcctttttcctgagatgctggctggggaagatgccctgccacagcgaaagactgcacagagcaaagttggggaaactggggagggcagtttcacaaccccactcgctgaatgcctgcagtcaatatcaaaggcacatattgtttgcatgagcagaagatgaaaccttgtcacattcccattaagtgcagagctgcatctaccccttcaaaatgtgggaatgacaactgtaaccttcacgccaatcatctccgctgtgcccaggcctaaactgtgcagggcacaaagaccccaggtttgacctgcagagtccccaagcttcagcggctggtggttcacttcattttttttctggcggggcaggaggaagggaaagaaagagggcttttcagggctctacaaccaataaaatcgtgccgctttgaggacatacttgagctccccaaaagacaggcagctgaagggcaaacagtgtctaatcagtagtgagcatgttatttggtaactgccaaggtgcagtgggcgcctgggctgctccaacaatttcttcgcttctatttctagacagacgccagttacactccaaaagtgcccagcaacttccctcaattacctttgtaattaatatgtaattgatgactgcacttaatctccaaggttattaatagcccttccaaaaaatgacccccaaatcttcctaagcctttggaagcgcctggttgaaattacagtatttcctttgctggctgccggccccctgcccgccccacccggagaccagcacggcaaggcaaaggcgcgctccactcacttccatgaaaggttcggagtggaggctcagccccccccccgggctcgaatctctcactcctccgttagattacgctggccaccagccagctagattcgtggtgctttctgagcccccagggcgaacgggctacctgcgcggccggcggggctgcgcgcaacagttggccgctgctaagaagacagtgcgacccggaggggacccggccggacaccgccgccagcttcgctgggagggacgcagggcacccgccgaacgctgcctccccagcgctccgagaggggctttcacaaatacccccatacaccccccatcccaccccaccggcgccaaaatccggtgaactttctcacaggctaagccgtctctatttgcataaccatctccaaactgagattcaggtttcctgtaatcagtcctttcaaaggtctgtaattgaaagtgcaattaacccttaaaatgaggtaagaaaaaagaaagaggggaaaaatactcctctggtctgataccttccggaaagtaggagagttcccaaaagtcagggtttggaggggtggagagtgggggtagtcgtttgctttttaaaggcgacttctgaagcggttgcggctactaaaactcctaatccttgtcagcggtgcaagagaggcggggagagagttttaaaagaacatcaatgaaacatcaattcaagttccacgttttgcgacccccagaatctagcaagctccgggacgtttccctccaccacaccccactggcgacccccacccccacccggcctctcctcacccatacaacaaagcggggcgtcctataaggagttcaacccggaaaaggagaagtagccggtgacacgcactttgagggccacagtcctcaggggcttcccgggacggcgaataatgcaggggggagaggaggagcggaggcggggagcggagcgcgacagtcgcactgggcaacccggcggcgcccctccgctcgcagtgctgggaaggggggagcgctgcgcccgcggggaacgtcctgcgcccgggctgcctggctctctcgctcgctcgctcctgccctctcgactgcccatttctccctctagtgtacctgcgtccggcgcagggggcggcggggcgggggaagggagttgcagcctcccttcccgaagtgtcggtctctgcgcccacctcccgggtgtgcccacctaccgttgatctcgtggaggggggcatcgttcttgttgaagcctttggacacgtaaagacgtcgcacttccgagcaacttttcgacttgagctcggcagccagcagcgcggcgctgagcactgccagggtgcagagaagcgcgggcaagccgaaccgtgccatggtgcgggccggggcggacgcgttcccacctttgggaccggacgggaagcggcgctacggcagcgggccgagggctggcggagtcggggactagcgagtggagctggagggagaaggagttggagttggtggaagaggcgagcaggcggaggagacgcggggcgaaaagtagagctgggcctcgcgtcaggcaacggtccccggtgccaggcgccgggccaggggagaaggagggcgtggaggcggcgcgcggcccagggaagcagaggcgcgggctggtgacctcggggtttcgcggggcagcgaacccggcaagctgactggccggcgaggcggggacgcggggaaggagggaagggtggcaggcgccgcggggaccgcagagggtgtgggcggcggcgggcgttcgctgcgcgctgcttgggctgccctgcgctggtccgctcgtccggctggactcggctcg

SEQ ID NO: 7557 - DNA, 970 bp, artificial
  synthetic oligonucleotide
taggttgcctagggctgggggtgataggagaaaatgggagtgacagctaatgggtgtaggattttgtttggtttggtctgcgtggtgatgaaaatctaaaattcatgtgggaatggttgcacaacataatgaatatacaaaaacgccaatgggtgcactacaatatgcaaattctatctccaataaggctgttaacaaatgaagaggtaacgaagaatatgctgggatgtctgtggtctgtattacctgtgcgatttccttccttctggaagggtttgctgagccctgctctagtctgattctctcagtctacacagacagatactgtgatccagagaaggcagagtggagagccggctgattgcactcggctatgtgagtcattctctcacctgctccttgttaacacacagttgaaccccaaagagaggcatttgtctcccctagaggctttggagatgaaacccaaaaccctgtggccaaaggtttcccaatctgaagtggcaaactcttggttagcctggaagaagtgagcaactttcccttcccatcagatatttccagtggtgcctgcaagctccatgctccttgggatttaaaaacacaatttattttcttcgttaaagcctattcttctaacaccctgcaacatttacaaattacttcagtagaagaaatatttagaaagtgcactaagtaagactctgtatcctttttcataaaagatttaaagtaatttttaagcatggctttggaacacagagtgaaaggtgtttcatcttgctccttcaaggattaaaggtgcgcatgagcctcttgccataaaaatagccccagagtaatgctttgctttattctaggaaatggtggtgagtaggccttcatgcctgcccctccattcctagtcttatgttagatgcttttggaattgcacttctcccccagattggactgtgatctctctctgggg

SEQ ID NO: 7558 - DNA, 198 bp, artificial
  synthetic oligonucleotide
gtgggggcatcttatgtgttgcttgggacttgatgagtctgtgaggagagaagggagtgccttgcttgctatagaaagtgcagaccttagacacatgtcagccttcaggtttttctaagacagaaccccttgtataacaatcagactcttcggaatccctgaaactgggaaggaagggcacttggacttggttaaaaa

SEQ ID NO: 7559 - DNA, 1836 bp, artificial
  synthetic oligonucleotide
aaagtgagtagtttctactccatctgccagggctttggacactcaaattgatgttccttccataaacatcttctgtggtgtgaccaagtgtaagaggtggagctgagcactgtgggggatgccaggctaaatggtcccattgactgcaagcctaaggcagacactcttatttggaattccctatcctctagaagtttctcctgtcacagttatggatggtgtctggaaagctctgaggacaggatacacctcttcagattttccagaagggcaaaacattgttactactggcaatgtattgtaatggtaaaaataaatgtaattagccatggtaattgtgaaacacaagtcatgcttctatttattctgtgatagtaaacaaattcaaaaccggctgggcatggcggctcaggcctgtaatttcagcactttgggaggccaaggcaggaggattgcttgaggccaggagtttgagaccagcctgggcaacataatgagaccccacctctacaaaaaataaaaaattagccaggtgtggtggcatgtgcctatagttccagctgcttgggaggctgaggtgggaggatccctgagcctgggaagtcaaagctgcagtgagtcgtgatcgcaccactgcactccagccagggcaacacagtgagatcctgtctctaaaaaaacaaaaaatttgcatcaagatagcacagaaagtgcactgcaattaaatccaagaaatccatgccctgctctctcctcatactttttcttttgctatgcctttgctcattcagggtaaaggaaaatctacaggttcttgattgtggaaacctgtaagcaaccagtctctaggatccatgcaaaaagctccttttcatttcaaaataggctgcatttagtgccctggctaacacaaaaatgtgggcaacaaattcatcccaagtaccaaagattattgtgggacggggagtattttcagagacagaacatttcctacctcctcaattagtgaattcagtctattctgtggtcgtgttcatgaacatttaggtgtgggggctgggtggggaggagtggcctctcagccttccctgagagaacagcacagaaggggttacctaattccactgtgggagttttatctgcctcctggatggttcagtgtaggtctacgtctagactgattacaaaagcaccaacaaaacaaaataaatacctaacatcttacagaaaaggcatgaaacaaaacagtatgagtggggagaacaatgcctctgttgtgacaggaagtcttcgtgaggatgatggaattcctgcaccccaggttttaatttgtaaaagcaacattaaacgtctcaaagcaggccctggcttgaacacattaattttgaaggcaatgtgtttggttagataagggatttttttttttcactgccactaggtcaaaatgaagatcagtataactaactccgtctgcatgggcacagatttcagaaaacagcctttactctcattcaccaatataaccatttgttaattctgctccttccaagtgacaaggtgtgtgcaatgtgattgaaaaggctctggttggctcagtcctgacttgcactcactgtgctgtgtgaccttaaacaaatctcttaacctttctgagcctcaatttctacatatgtaaaatgagggggttggggttgctaatgtatctttgtgaggtgaagactctaacaaagcaaaataaatgtaacaatcccattgcctaatggtgctgacgaccggaccggggactttcacccaaaaagaaagctgtaacatcatatccaaagtagtttttaaata

SEQ ID NO: 7560 - DNA, 3843 bp, artificial
  synthetic oligonucleotide
catttcttatggctcattccagcttgcaaacatctttagttacaacaataggatgttgaaagaatataatgaatttttcccattagctgaggcatggcctctcttattgtaggcctctgtttctcaatctggagtatgtgtatcttcagattacactgcagtgggttgtaggtacatgaagccatcacatgcttcttcctagggaattgggggaaagcacacttttttatactaaaatatgcaaggctaatgatggagcagaaatgtattagttgcaagctcactgaagtcatcagacatttcctgtttagcaggttatgtctcaaatcctcaggagtagggattcactcacccttctctgacgtagtggggggatttaggtagaaaaatcttaaaaacactgttagaggttgggtacggtggcttacaccttgtaatcccaggattctggtaggccaagggggatgggtcacttcagcccaggagtttgaaaccagccttggcaacatggtgaaaccttgtttctacaaaaaacagaaaagttagctgggcatggtggcgtgtgcttgtagttccagctacttgggaggctgacgtgggatgattgcttgagttcaggaggttgaggctgcagtgagctgtgattgtgccactgcactacaccctgggtgatagagtaagaccctgttacaaacaaacaaacaaaaaacaatcccagcactgttaggcaacttgggtcacctgggctttgtcaactaccacgctggaccttctgactcacaaattcctgatgagtgacttaatgtagtcttttctatggcaacttccttgttacgagggaaacatcacagtgattgtccttaactagggctcagactgcttcctttttctaacacaaatgtttccaggggttttcaaccaccagctatgcttcactattatgtgtagccattaagaaagaaataaaaaagtcatatgggccaccacttacttacatacttactatttatagagatggggtctcactctgtttcccagtgcagtggcatagtcatggctcacagcagccttgaatacctggactcaagcaatcctgccacctcagcctcccaagtagctgggaccacaggtgtgtgccaccacgtctggctaatttttttatttttattttttgtagagacagggtcttgctctgttgcccaggctggtcttaaactcctggcctcaaattatcctccttcctcagcctccaaagtgctaggattacaggcgtgagccactgtgcccggcctaccatagttatttaggcacatcatgagtcaaaccatattcccaggaacagaacaaccccatcctggaagcactgacagtatgtgtgggtaatgtgggtggtggctctcctccaccagccccagcattctcaccaccttccccagcagtgtcatgaccactcctctgatgtctacaggtccttcttgcctgaggctgcctaacagctccacagagatcgaagctcatcagagcctttacttcccacaggaaaggttatctcattcccatgggaaatgatgggcctaacagtcagtagaagaagaggagctgaggacagagacactgtacagcaagggccagggaagaagatcaagataactgatctagagaagacaagggatgggaaacactttaaagaggggtgggttaacacggtcaaatgttgtgtaggggtcaagaaaagtaaagactgaaaagaagccactgtagatgttaaatagaaggttatgggtgatttttggaagatgtttcagtaggattgttgggtaagaaaccagatgtggccatggtgcctgcctgtagtcccagctacttgggttgctgaggtgggaggccaggagttcaagactgtagtgcactatgattacacctatgaatagccactgtattccagtctgggcaacacagcaagacccatctgttaaaaaaagacagtgattagtgagttaaggagagagggggagctaatgtggattctctgagaagtctgagagtgagtgaaatgaggcatttgccaccctgactgtgcctggggtgcatggcagtgctgttagtgccacaacacctcaccagtctgtacaaccaagttttgttagacggtgcctctagaattccaaagcaaaatggccttttaaaatactatattcttgctgtcattgatgcataaacaacctgtaaccagatactcaaacagatacttgtatgccaatgttcattgcattgtattcctaatagctgaaaggtggaaagaacctaagtgtccatcaacagatgaatggagacacaaaatgtggtacgtccattcaatggactattagccaaaaaaaaaaaggaatgatgtactgataaatggcaccacatgaatgaaccttgagcgagactctgtctcataaataaacaaacaagcaaacaaacggggatgtcaatttctaaaggttgacaaacactgataggactttaactacttctaatatgttggtggccctaaattctccacaaggtagtcatttctctaacttatctcctcttgctgttagtttttagttgcaccacacacatattgaaattagcctgcattctagaataacacagaaacttatgctggaattcttcagcttgtccaattttcagcccttacaagttctgagacattaaggttattattacttaaatgttcctcactttcttttgtgtcattccaggtcagccaaaagaattattttccataatgatatgtatacacctcttctacctagctaaagaacaacttaatatacacattaagaaggatgtggaatagccaagattaaaaaaaaaaaacttaaaaaaaaaccattatagtaagtgaaagaagccagtcacaaaatgccatatagtatataattccatttatatgaaatgtccagcataaacaaatagagagagagagaaagtagattagtgattgccagtggctgggggtaggggaagggtgagttacagcttaaaagttacagagtttctttttgggatgatgaaatattttggaaatagtggtgatggttgcacaacattgtaaatgaaattaacaccactgaattgtatactttaaaatggttcaaatgtgaagaaaggggaacccttgtacactgttggtagagatgtaaacaaccactatggagaacagtttggaggttcctcaaaaaacaaaaaataaaacaaccatatgatccagcaatcctactgctaggtatatactcaaaagaaagggaatcagtatatcgaagagatatctgtacttccaggtttgttgtagtactattcacaatagcccagctttggaattaacctaagtgtgcatcaatagatgaatggataaagaaaatgtggtatgtatacacagtggagtactattcagctataaaaaagaatgagatcctatcatttgcaacaacgtggatggaattggaggccattatgttgagtgaaataagccaggcacagaaagacaaaaattgcatgttctcactcatatgtgggagctaaaaaatagatctcatgaaggtagattggtggttaccagaggctgggaaggggagaagcaggagggatgaaggagaaaaaaagaatacaaatgtatttattaccactgaactgcacactcaaaattaataaagatagcaaagtatatatgtatattttacctcaataaaaaataaaaattggttaaaatagcaaagtttacattctatatattttgccataatttaaagaaaaaaaaacttacactagaaaccaagagataacagcatc

SEQ ID NO: 7561 - DNA, 1158 bp, artificial
  synthetic oligonucleotide
ttccagatgacttcttgaagaaataaaatattctgtacatacttgaaaagcaaaaccccaaggtaacattttgtaacttttttgatggcgaaaagaatccccctactttcttgccttctctctgtacctgccactacattttctccctgaaattcatatcttttccatgtgcaaaatatattcaccctgtccacacagctctaaactgaggataaagaggaacagagttttttacttatttatgcaataaatagttatcagccacttattctataccaggcattgttcaaagagctgaagatacggtggtgagtgggacaggcaaggttagcctaaccgagacatccgctctgtcttctcagcatctgctctgaccagcaagggcacaggggtgctaaggtggagagaagaggcactgtcgagtacaaggcagagcgtcttggtgaaatgtcaggtcagctccttgtcagcacatgcttgagtaaaatgaacaagcgaggtcttatatataacatgtgtaaagttcttggagactgttctagtgaaacagcaccagctataaggagctgccataattagaaagacataggagttgataacaaacaggaaaatgtgttctgagaaggtatggagaaggcgaacagtcactgcttccctctggggcccccactcttctttgtgaggctgtcacgaaacacagtagtctctccaacacatctaagcacccacagtggcagctgaagaaaaacactataatctctctcgatctttctcacagttttggtaatttttgagacttcagtgaatggatggcactcaacattcaacagccaaggagctacatttaattggaattctgactaaaaaaaagtgtgtaacaaattgattaaaagtaatagttaacacattcatcagggaatctaaatacctcattgtgagaacttctactaaaggttcaataagggacaaatctctgcaggtactagaaatttcttttcattttctactgtgggacctggagaagctactggtctactgtgggagggccgcaccctactaccttctgcggagacccaaaccactgcctgctccagcctctcctatgtcctggctaatggccaaaagatgattaagtcaactttagggacaaagcggttc

SEQ ID NO: 7562 - DNA, 995 bp, artificial
  synthetic oligonucleotide
aaatgggacttctggatcatgtggtaaaatctctaagctgtactccaagggcagcctgcctatttatagagcctctacttcagggcagagttcaaacttgggaaaatctgaagaacttgatttaaacacacccacacacccacccacacacacacacacacacacacacacacacatataaaaaatcgtcttcattttccattcagtcactttgagccaaactaatctttaaatagttcaaaaatctgttgaaggttggctagatatatttttccaagaatctttagaatttagattattatatttagaatttttaaatcatttaaacaacactccaaactggaaacgttgtagtctctccatttcagaaattgataaactgaggcacagagactcaagtcacttaaaaggtcactcttgacttgcccttatgctaactcttcatattgtaataatatgaagaaaaacagtatctagaatgtattgagtgcctaccacatatattatccctaatatttgtcttaacttttcaagatagatgatagtatacccatttcacagattaggaagcatgagtataggaaagttaagtaatttgccctaaagccaagttactacaaaatgacaaatctgagaattaaaaatagatctatttggctctaaagcctttgttctttcccccaaactaaataatccagtgttttggctctcagatgtctcactgagactctcagtcacataccagtgatgctttacaactaaaacaggtagtattggtgtaacaaaaactcatgtggagcagtgaacatcacaatcccaaaacagtcctttttaacctttaaacagggtggagagtatttttcttttttctttttttcttttttttttgagacagagtctcgctctgtcgcccaggctggagtgcagtggcgcgatctcggctcactgcaagcggtggagagtacttttctagtcacttccatgtctctccctct

SEQ ID NO: 7563 - DNA, 2642 bp, artificial
  synthetic oligonucleotide
gcaatcttcccactagcctaatcataccacccaaaaccgatgagcagcactcctcttcagactctgcatcacaggctgccctttatctttatttaaccacttcttatgcttatgcttcctccctcaaggaggctgtgaggacagaggactagacttcctttgaatccccaaagtccctggcacctggctgagtacatagtaggtaatccttaaggtctgttgacacaagggacctgttgacaatattcctcatttagaattagggacacagtgatggaaactgagattttggcctcaccagtgttggggtctaaccagttgaacatagccacctagacacattttggtttgagataatttgtaccactgtccccaagtgaagcatatcatgccctcaactcagcagtaagtgttttacatcgtttgtgctctgatcccctcagagatgcattttgaaatcatcacactatatctagcaaggcttgatagaacttagtgaagttgtactttcacacacaaaaatggctcagttaggtagacactgccattaccatgtgctcagcagcactaacagctatttattaagtgctcactgagtacagagcaccttatcaggcaccagaggagtttatacccaagcatgttgtcaatactttcacaatgccaattgcagtgaaaaatatactactcttagaaagcccttctaagtattttctaggacccacaaaaatttcactgctaaaatccatattttaaaaactcataccaatgtctttgtattaaaacctctgttcttgcataaggatttcagtttcattaagttcttcctaaactacaaatagaagtcagtgatgccacagtcctcccacccatggatcatggggcaggaacactgtcactctggtatatgcctttttggtggcatttttattgtggccacaaagcaatcataagcagatggtacaactaacttctatttgtgtcttgttactaaacttcttatgagaggaaaaactatgtgtacaggtcaagggaatctgtgggtgtctctgtgcatggcagtgagtcagaagctggcaaggatgcagtgaaattggacctctcctgtcttgctggtggcagtgaaaactgatacattctcattgaaaagcaaatttggacacatgcattttaattgctcatatcctttgacccaataactttagcatgttaagaaaataagctaagatcaggataaagcactatgtatgaggaggtacctttatttatgatggcaaaaaatttgaagcaacctgtatatccagcaaaagcatgctgattaattatgatgaatactcaacagaatattatgcagccatgacaaataattaatataaagatttgtggggaccaggcatggtggctcacacctgtagtcctagcactttgcggggctgatgcaggaggattgcttgagcccaggagtttgagaccagcctgggcaacatagtgagacctcatctctacaaaaaaattaaacattagccaggtatggtggtgcatgcctatagtaccagctactcgggaggctgagacacgagaatatcttgagcccaggaggtcaagactgcagtaagccatgactgtgccactgacctccagcctgggcaacagagcaagaccatgtctcaaaacaatacaaaacaaaacaacaataacaaaaagatttgtgacaacatggaaaagaaaagtgtttccaagatagtgttaattttcagaactacaaatcacttgtggatttctaattatggaaaaagtctgtgtgagtgtgcctttctggacaaatattagaagagaacatgtaaaaatgaaaacagttgggataaaatagtgggattgtgagaaatatttttccctctattttccaagctacccctcaaattgcaatattgtctttataatttaaaagtggggtgaaaaataaggccagaagtcctttctagcagacagactatttgaagaaataatagcgtctttcctaaaagcccaagaatatagtttgaacagtggaagctggctatatctctctttctctctctctctctctctctctctctctctctctctctctctctctctctctctctctctctctcccccccccctctctctccccctctctctctccccctcctcctctctctcggttatttctactttttattattattattttttatattccacatacctggttaatgtgcttcagtttgtcaataatttgactgaccactggctcagggcccttcattttcagctcatggagattgaactggtttttcattccattccttgctgccttttggctgtatctgtaaaggtgaaggtaaagaaaaggtttgtcaaagaaagtcccaaacaaaggaaaagctgactgtatttggcatcaacagtcagactgaccacaagctcatgagacgacctcatggtgcaaaagtagaccactccacatagtgtctatttacagtaaaaaaaaattcgttcaacaatcaacaaatatatacaacatgctttttttcccctagatgttgggaatacaacaatgaacaagacagacaaggtctgtgtgcccttattgtgctctcagtccagtggggagtcta

SEQ ID NO: 7564 - DNA, 2463 bp, artificial
  synthetic oligonucleotide
acactggctggtcttgtctgcagagagtagaactgctctttctatagtcttcctaaactcatgtccagagatctaggaccaaggctgcagcaagaaccctgaagcagcagaaagaaacacactcagcaagtctttgcctggtggaagtgcatggccatggtgggcatgggcagagacactggcacaggggaaagagcctacctttgccagtgtccatatgcaggacagctctgcactcgacaggcccaagccttaccctgccactctcaagttgccagcaataacataacatgaaagaataacaaagggggagaaaaggtgagctgaagtgtaaactacacccactccaactgccctggtagctgcaggtgccctccactgctcaactctttgcacctgctctcctgctggaacaagtggcctattgtgtgaggctgtacacatggaggtgctaagcaaacaagaaatgactcttctgatcataaagtagatgggattccaggaaaactttactaagccaaataaaagtgattgtaaagcacttggtaaaatataaactgctgcataaatacttaataaaagctcacagccatgcacacaaggacaactaggtcaaaatttacccaagccctctagcctggagggtcttggaaagggtggaaattgtctctctccctctggttttcttagccactttgtattcctttgctcttaacctgcccttcagcccttggcactcccccaatgtctctctcctgtcacttatatatctctgtggttagagggcttctaattttcattctggacagttgtgtcaaatattattgggagcaacagacattgaattccattttctttttcctgctcagaagccccattggagttatgcagtgctatgggggaaacattttctttaaggtttaattatgtgagttgtaccccaaactctccaacattagaaatcgagaacaactctgacatctcaaacagccaacctacctgctcccctgtagctccaataatacctggaggagtaaaatgaagagctcactgctgtcgtcaggagaatgattataccctggggttcctttcgaatcactttcactttggtctacttgggaaggcatcaaattcaaagtcattaaggtagctttatggtgttccctttcctttcatattccctcccccatcaaatatctttgttataggatctcatagcctgttataggtggaaagtgctttagaggtgattttgtcaaattcctttattttataagtaaaagaaaaaacagaagtgcagtgacttgtccaaggtcatgcaacaagttcacagtagagctaggactcaggctggagtctcagcctagggcaaaggttttttgtttgtttgtttgcatggactccaaagcgccacaggggatgcacaggcaatggctttattatcagaggcatgtgagtagaggagattaaatggagagctagcctcagaggcaggtgagtgccattttctagcaaggggctgaaatatctctaagaactccttcttccaggggatggcgccttatagacttgagaggacatgagagcagagaagcatggtatgagaggcaggaaatgtacttctactctcaaggagcaagactgggcagggaacaaggaaaggacagggtatagcagtacagaccagagaaaagctgcacagaacactcattccaggtctgctggatgacagattaaagcaagctgacgtcaggatttccaccaagaataggaagaaggtgagaaggctttaaaccttgcaggagagaagtcaggcatttgacaggcaggacagtactgtgggtaagggatggattggatgggtttgaagcccatcttgctgtggcctttggtaatttactcaatgtcatcagtagaatcagtaaaatgtaggtaataatactgtctgcttcaaaaggctgttgttgagaattagtcaatgcatacaaactgcctagcatattgtgtggcacttgggaagctccatagaatggttagttattactattattagccactttactgtctcagtcctgctttctgaagtcccactgtacccttagaatttgagagagcaaagggaagagggcaatgatcaaaatgcatcagggaggaaaaggtaagaggagttaaaaagtgaaggcagagaaaccaacagaatgggtgagctgcagctctcccagctctcctccaccccttcaatgtaaacccccacgactgcatcttttccctatatttagtagctgtaagagtcataggtaccaataggtaaccaaccactccagtttgctgggactgaggggtttcctaggacttgggaccttctgtgctaaacctggaaagtcctaggcaacctggaaaaagttgatcactgtaggggccagagggtatttgctgttcgagattactatttgttataaccag

SEQ ID NO: 7565 - DNA, 1512 bp, artificial
  synthetic oligonucleotide
taggcattgattttggactaggggagctgaggtcagcttttgttcttttctttctagatcatttactagtgtcacctgatccgttgccgctttagaccaagtcagaggggaaggagaggagggggagcacaggaaggagaaggctggaatatgtagatataatttcacaagggtggagggaactgtgtgactttctcacaagttagcagttgggccagaagcttggtatctgtagatgcaagatggactattcaaccatagattcggcatttgaacaatggaaaaatattgttcatgtactcaaccaaacagtatattgtggcaaggtaaacagtatcataagggaagcagtgaagtagacattcggaagggcaaagaagggagaagctggcaactgagatgtgccaaaaatatgaaagctagaaggggcagtgaagatctgatttcttctattctgattgtactagttgtgcatcttgttctccactcactgttttaaatctatgacagatattttcaatacttatcccttaaaggaacactgagtcccacacatagaccaccagttgagtatcaaatcgccttgaaattgaactaagctatttctaagattagctgtgtgttgcaaactacccagttgggggcagacaaaacaaacagatgacttctgaatactaccaaaggaattcattgtgtgttgttattttaataaggcaaagggcttttcaactcatgatcagattcagacagcttgctcacaacctccacagactgaatactacaatagggttcctttgcaattatcatatttttaaccacagaggacggagcttgggcatgggcatgaggagtgctagaggcacatatatttttctggacagtgtgaaatgctgtgcagaacatactgagagatttatagaggtactaacactgcaaaaacaaaccctcttaataacatcagattgcagggggcagtgcatttagcaagagattatcttaattcccacttctcctctctccctaaaaggggttacaatgcctatttgagggagttaaataaaatcagatactctcctgttgtttcgttttcttcttctgccagagaattcacaaagaaaggctccatctcagattctaatgcttcagtttcaaaaaaagtgagtaacatcattgggcagtctcgatctcctaacaccaaagaagctctgcctgaccatcatttactcaactctacaggctttgtcagtttttcttactatcctttcttttccttggaggatgaatctaggccacgtgtggtggctcacgagaatggctttaacctgggaggcataggtcacagtgagctgagatcgcgccactgcactcccccctcaaggtcaataggaacaactcatgtctagctattcttgagccagtggcagggctggctacatgtgcagtcttttcaggtagggcacttcttctagaattgtattgggcttttgatccaatttctacccctttattgta

SEQ ID NO: 7566 - DNA, 3853 bp, artificial
  synthetic oligonucleotide
gtaagagtgaattagtaaccatacgaaagcactgcatgtcaaattctatggaaaaggaggctcccaagtaggtctagcttgccacttgctgcctgcaggatgtcccttgaccctggctccagaattcagattattgggttggctacaaaatcttcggtaattcctacatttaaaaaaattctgatgtctaaccatctgatctttggcaaagttgactccctattcaataaatggtgctaggataaatggctagccatatgcaaaagattgaaactggactcctatcttttaccatatacaaaaattaactcaagatggatagattaaagacttaaatattagacttcgaactataaaaatcctacaagaaaactaaggaaatacacttcttgatatcacccttggcaaagcatttatggctaaatcctcaaaagcaattgcaacaaaaacaaaaattgacaagtggaacctaattaaactaaagagcttctgcacagcaagagaaactattaagggagtaaacagacaacctacagaatgggagacaatatttgcaaactatgcatctgacaaaagcctaatacccagaagctataaggaacttaaataaatcaacaagcaaaaaacaaatagccccattaaaaagtgggcaaaggacatgaacagacacttcttaaaagaagacatacaagtggccaataaagatatgaaaaaatgcttatcatcactaatcatcagagaaatgcaaatcaaaatcacaatgagatatcatctcacagaatttagaatggcttttgttaaatagtctaaaaacaacagatgctggtgaggatgcagagagaggggaacatttacacactgctggtgggagtgtaaattagtccagccactgcagaggggagtttggagattcctcaaagaactaagaggtgaactaccatttgattcaacaataccattactgggtatatagctaaaggaaaacaaatcattctaccaaaaagacacctgcacccatatgttcatcacagcactatacacaatagcaaagacatgctatcaactcaggtgctcatcaatggtggactggataaagaaaatgttgtacatatacaccatggaatactactcagccataaacaagcatgaaatattgccccttgcagcaacatggatgcagctggaggctattttcctaagcaaagtaatgccgggacagaaaatcaaatactgcatgttctcacttattagtgggagctaaatgttgaatacactaatgaacataaagatgggaatcacagacactgggaactacaagagggcagaaggaggaaaaggggcatgggctaaaaaactatctattgggtactatgctcactacctgggtgatgggaccatccataccccaaacctcagcatcacacaatatacccatatgacaaacctgcacatgtactccctgaatcccaaaaaaagttatttgaaactgtgatgtttttatgtttctgaaacatatatttaatattttgtaggagaatcctgtccttatgtaacaccagtgtaattaaaacatccaaagggagaaaacccagatcaatattctgggtttaacaacgatgagagattcaacaagatgaggacctagtatgtactgtgtttagtaaatttagatgattgataatgatgacatgagtcacttcagcagagaagttctgaaaataagaatcataagatgtagaatatatggagagtaagcaaatagatggaaagcataggcagttattttacataaaggttatgtcatgtatcttattaagtataattaatataattaatagtgtgttaattatccgagataattttttaatgggggggcagagtttatgctgcagtacattacctcttttggttgctgtactctttttttaattaaatgttttgagacccaatatacataaaatgcatccctaaattgtagtttgatgagatttgtaaatgtatacacatgtgtaaacactacctcataatgtagaaaatattgtcataattttatagtgactgacattttaatcactacagatgagatctgtcttttttaggattagattgataacagaaagaaagaatagaaatatagaaaataaatatggatagattcggtatttatgtctttgtttctgcttttttgctcaggataattttttctttgaggaactctatgttggtggtttaccagtacttttttcttttaattgctgaataaatataccaaatatgtttacacatttgggtagtttccacatttttgcttttgtgaataaagctgcactgtttactcaaatcttgccatttcattttcaaatatatgttttgtaaatactccttcccattatctggtttttcacttttcttagtgatgccttttgcacagaacactttttaaaattttttgatgcacctgattttatatatttttgcagctttatgattgatgctgttttccatccaaagaagcctttccatatggcaatgtcacagacatattttcttcagaacctttatcatttgtacatttatgatgaggtatttaacccattttgtgttaatttttgtatattgtgtgatgtaaagattgctgttttcatggcctaggcgatgggatcactgggacccgaagcctcagcgtcgtacaatatacccatgtaacaaatctgcaagtgtaccctctaatctgtaataaaagctgaaactatttaaaaaagaaataaaagaaatctatcttaaataaaatttgtacatggctagatattacttgttgatttccctttcactgacatttctacttcatttcacagtgcttaaatcatatgacctgttggatttctactttcacaaagttaatgacatttttaggcctaatgcttttcctttaaatatttttctctggtatttaaaaataatgtgtatgctctgtttatctgtcatgaatgctatccatttgtttatctgattaacttgtcaaactttccaagttatttaacactcaagaaataatgattatgtttttccaaatatttatcagattgtttcagtacaatttgttaagatcatttctcatttagttacttcaattttttatttctttaaacttaattggccatgtttgtggatctatttctgaactctattctgtttatttaaatgtttgtgcttatgcaaatatatcattctcttaattgaagtgttattataatgtctcgaattcagctaataaaagttcatccaacttagaaaaaaaagtgcttttctgagaaatgttgccaaataccatttaaatttagtcttggatcattgatggattcatcaggaccctaaagaattaaaactaaaacttcctttgggagttatgcaatttaattatcaactctgatctagttgtctactttggatgagtattacctgtggcattcgctttgtggtaccttggggctgaaggtggagttgggtgggaatttcagtttttcagttaaaataaaatgatgaatttcagttcattctcttgaatcatctatcataccactatacaatttcatttaattaaatcttaaaagtttaaaaacaatatatacattgaaattatgtgatatacaacataaactttttaatagtagcaaccgtgcccatttaacaattctacaggtataataaaaatgctaatatatgttaatgtttagactgtggttaatgttttgtcttgttaatttccccagggcttttattactgatttaaatctgccacactactcaactgattgcactgcttccacaaactgcatggaggtagctcaaatga

SEQ ID NO: 7567 - DNA, 1603 bp, artificial
  synthetic oligonucleotide
taaggaggaggctctatttttctttatgctgaagaataatgaagactttgcttgaaatgtatcttaggagccccagtttgaaatttaaaagccactaatcattctttctgggacaccgaatttgggatgtgaataacaaagtctacagtgctagcctgctactgagattgcatgccattggtaaggtcccttctcttctctgggtctcagttcccccaattatagaatgaaagggattgaattaaatatcactctcaactctggaatcttataattctattgatctaagagcaggactagtgaaaggaatgggaagtaatttccctttgaaaatagaggatgcctccttttcctatcaccctgccattttgttcctgaagaatttgcagtagccataataaaggtaatacttggacaagagctttgctctttgtgccacaatcttttaacagtcttcataattgagcatagtaataagataaacgaaaaataaagaaatagctgtttggaggtcatgcatggggctcctgataggtattatcaggtcagaaaggctgcagtctgttaggacaacacattacctcaggcagttggggtccagaacagatttgagggtcagtaaagcaacagagagtcttccattgatttcagatgcccttttatgatgcccagaatattgttaatataaataatctcagttctgctactgattcaatgtggacaaatcacataacacaagagaattctcaaagcaagttgattctaagaaggaaaggtgcttttggcaaaaattctggccaggcacagtggctcatgcctataatcccagcactttggggaggccaagataggaggatcgcttgagcccacgagttcgagacccgtctgggcaacacagggagaccctgtctctattattataaaaaaagaaaaaaatcctgttgtaacatcagattcttcccatgtgggtattgcctgaacaatatcagtgattcctattacaaaatattagtagacacaattatgctgtttccacagtttgcatggcagctgcacaattccatttggactagggacacctgaaacacattgttccacctgaagaaaatcaaattacttcatcttggagttgacttacagggagtgagagaagagcctcaaagacataggtctagaggagggcaagtgtgataaaaaatgagttattgtgaatatgaccaaacaagggaggaaaagcaacacttggctacacataacttgtgttaataattcttccagctcttccaaggaatcggcccccagcctattatcaagaggaagagagacaaaatgagattctcaccctttacaactagggcgcaggtactactgttggtaacactgccatggagaacaggcagctcagacactagaagtccaatagagtcactgggaaaagacaagatgatgattagcttcttttgtgttggctttcctttagcaacttttgatgaactgacaaatcagcaggcctcttgctagcatcatgaaatcacatatatctagattcaaagaaggggagtgagactagatacataaacgctctatctcctaggttttatta

SEQ ID NO: 7568 - DNA, 1227 bp, artificial
  synthetic oligonucleotide
gaaataaaccttgtgtaagtaaagttgcttaccattgttctagaggctgacctgcagacactaattaggtagtgagccatttacttctttttatcactttcaaatcacttggtactgaaaacagcttgtatgaattcagacaaggtatctctatctgagactgaaaaatgaaagtccaaagtgatagcatgaggagaaaaacactgacattctgacacctgagaaataacctcagccttcaacagtggagaggaaggtaaggctaatcttggaaattctgacgagttacagtcactcacactgacagcaaaatataagagtttgatggagttaattattattgaggatcaacagagaatcttccccagagcttcctggcacacaaaaataaatactgacctcagaaatcctagcaaaggaaatggatgtatttggatacgttaggttctcagtaggcaatgttactattattaaataccaaggacactccgtactggagatctgatgttcttctactgtccggaatcaaaggcagatgcattaaaaactatgtgttggtccaatcggcagatttccaactttgcaagtggaagagaacctctttctcaccaccggcactgctcacatagattctaggccaagtcatctgactgtgtgactggaccttccatcacctgcacaaacattccttcttttccatgaaactacactgttcctttaagtgttaggaagatgtaaatctcatgccttttagtacttcattgggaaatactagagcaaaagtctccaaggagggagaatgaattcagaaactgattgtgcagctggaaaaacagtagggagtaatacaggatattaaataatataataaaaacctacttagtctgtgtttggggaaaaaagattctgctgaagagaatggaactgcttgagagagcaatatagagtaatggttaagagcatgagcttttgagtcagacaggttcagctttaaatactagttctgccacctactagccaagtgaccgctgagggcaacacaacagagtcatgtgcatctttccagctactccctctgatccccagtggctatcatagtgcttccattattagatgctcaataaatgcttcctgcaacgaatcgtatttcagatagtgctaaaatgaatatcacaacgaaaaaagaaagggagaagtaatggtggtagaaaaggttgcaattctaca

SEQ ID NO: 7569 - DNA, 1370 bp, artificial
  synthetic oligonucleotide
ctacagcagttgttagggacttcagcaactatctgaagagcctaaaagcctagtgcaaagtcgaagaaatgaattagagaaacatcttttttattcaaagcttaactggatttgtttttaaaagggacattatatataaaggacatacaaataacagttctgtatacgaaatgccagataccctgcatgtaagagcatacatgcagggtgcctggcttaagaaatctttctgcataaagcagtgactcagccacaagagctgcctgtattgtactataaaacaatcacagttgggtgcagtgccgcaggccagtaatcccagcactttgggaggccaaggcaggaggatcacttgagcccaggagtttgagaccagtctctggacaacatagtgagactctgtctctacaaaacatcaaaaaattagccagggttggtggcgcatgcctggggtcccagctacacaggaggctgaggcagggggactgcttgagcccaggaggtcgaggctgcagtgagccatgttcccaccattgcactcagcctaggtgacagaggaagaccctgtcaaaaaaaaaaatcgcatgtgaggttcatgattaaggaccagatgacctaatgaaattggaccttctgaacattcttgaacacttgattattttaacagaatgtggaaaccagtttaataagaagttataaaaatggagagccagcaatgaaagtaatcctagaattaacctggaagaagagagggtatggtcagaaagacaagcaaccactcccacaagtataaatgcttgattcagcttctctattttgtgttgtccgagcacctctggcaaggttcatatgcaatattagaatctcctagaaagtcccaagttctgagctagaaacagaaagcaagccacccactgctacctcagtgacttgcaggatcagagatggggccatttgtccatttgctaccatttgtccccaagctcctaacaaactacaggtctttatttgcacaagaccaaaacctattatttcagaactctctttagcaaacctctggcagcccttgtcactacctcccaattgctattccagataaaaagggaagagcaagcacagaatccacctcgtagcaggattgttcttctattttcttctaggagtttcaccctcaatatctcacaataagtttctttcctcgtaactcccccatctctcacccccatttaaatctgggaggggatggggggaaggagtgaatcagaggaagataactccattcggacagatggacaagggacagtatacactatgagggctcaatccatctgtggaaaaggaaatccagctgttggccaggcctgccccat

SEQ ID NO: 7570 - DNA, 833 bp, artificial
  synthetic oligonucleotide
gagaaatgtactgacaagttagaccctggctacagtaacactaagaaaggaggaactgggagaagacaaatggctttcagttaaagcacagtaattagaaattgggtataccttatctgagactcaaaacagaaactacttaaaaggcagccttctctaagtctggaacattctctgctcccatagattagctctgtgcttatttagatgaggtttctctagcaccctctgcctcaattacttggggactcaccactcaaataaggattttagaggacacattggtccaaactaaccaacagcttaagtggtgcaatttataaagtgtcagaaataaccttttctttttttagtctcctagaaatcatagaactttttagctttgcctttacagttaaactaactcaacttcactgccactattttcttgaatgactacagatgaggcctacttattactccccatagtaccccagccctacctaggctcatggtaatctcctaacctaaggaagctcctaggatacacagtgctcagcatcaagtcacccctcaacatcaagtcttctagtcctgctctgacattttacccagttgcaataactgggcctttggaattccttgtgatttacatactttagtcaattccagcagttctgcctctgtcttgatactgtatctcgcctgagtccctgtcttggtttcttggccagaaccctggctcctgtggactgccttgctgctgctgttacagtcctacccccaaaccttggattaggaatccaggctcttaaccacagtccggtggtctcagccgcaatcagattgtactg

SEQ ID NO: 7571 - DNA, 1661 bp, artificial
  synthetic oligonucleotide
tatctttcacatgagagaccatataataaatatcaggataaaatttgtctgggggaaaagaatacatatttttctgctgcaacaataaaaacatgcaagccaatatattttcctgtttacttttgctgctaggaaacagacttggattgacttatctagatacttcatggcatccacgctttttggttccttagttggtatccttgatttttaaaatgtaaaggccctatattttacagtgtttaattttgtacagtacctctgatccttttgaatgtgtaaggaatgaaagaatcttaaataaatttggtcacttaaataaagagcttaaataaataaaagctgttttgtaacaattggcccacatgctactaaaaattggcttgatggttgtcagtatctgcgttgggagctgtgagatttgatattcatagctgatagttttgattttggtataattaaatagtctccatatgagtagtgccttgaaatgtgccattctaatttgttttcacagcagacaaatgtacacagacagtgccaataatatagcatctcatgatgtctgaacttctaaaataatctataacccccatattcaatgaagagaaccatgagccatcctttttctgcacagaaagcaataaacaatggaatgaactaatcccaaaattgcataaaaactatcttctctcttgtctaccactgacctggagagggatgacttacagggaaaattacttaaaacccttcactggctctctacttccttcaggatacagtacaattgctatagtaagatgcgcatgctattttgataagtaaaaggggcaaattacagaacaatatgactccaattttattacacacacaaaatagtctaaaatatgcactgaaattggtaataagattagaaattacttttaaaatctgtaatttcttatttttctaaaataaacgtgttacttctattatcaggaaaaaaaatcatcctttcaaaatgttcaaatattcacacattccagaatttagagaccaccagaggcatgtcagagctagcagaacactaaaagatcatctggcttctctcttctttaggtctgagtacacctaggctagagaagtagtgatatccacaaagtctcacagcccatcagtggcggagcctagtacagatccagagctttgcccagtccagctacctctctgagaggaacaatgatcctctgacaagaagttacagcaaggacttagccctgggggccaggctggcctgcagagctctaaggttccttgcaactttaagagtccatgaaatacaatctgacaatacagccttttctcatgttgaacttcctagaatccggcaagaaaacaaaaggatttttaaggcaaaactttgaagacagtaatttttggattttcatgacagcacagctctataattcaatattttttgttaatttcagattgtacagcttgctgatttaaagataatatttctacctatgtgaagaaaatgtggcagataaacagagatcttttggctggcttcatggcccctttgcccagaagcttattgaaggctatgtcaggagacccatttttcttcagggactgggagttggcctgagcttccaaattccacatctttccttcca

SEQ ID NO: 7572 - DNA, 1924 bp, artificial
  synthetic oligonucleotide
taatccgctgattacaaactttccagggtcttcctctctcacagttttaatgagatccttgtaaattcactgttccatgttacaaataaaatattaagagacactttttcattgaccaatcctccatccaggtgttagatttggggtaccttgataatgctcccaaattcaaaacttggagtgaatggagatttgtataaatctctatccaaaattcttgagatgatggtgggaaagaagtacatagatgcaagtctgcctaggctataattttgattaagggaattcagacttaggaaaggattactgtgcataccatagctagagtgaaatgaacaaaatgttgcccagcaaggatgtttgcctcacatgcaaataactgtttgaaattagtataccaggcactacctctaaagtgtttgaaaagtttgctcttttaagcagtttaaaagctccctcaggcaatcttgtttacaaattaacagaatactgaattaatgaggttcaacttctttctttttaaataacctcaaatacaaactaaccctgacacatatggaaataatcctcttcccactccaatgatacactggacctcgaaaacataacttttcttttgggagctgctgaagacttcttgccagtttcattttctaatggcatccttctgaagtgaatgacaaatactctaatatttacctcctttatacatgacatagctaatgaaagtacatattagtattccccactactctttccatatttctctccaaagacctgaagaaatagtttggtttcacagtcatcataaatttattatactgaacttttgaactagtctggatgagaaccagaacgatatccaacatgaaaaggcagaactcactcagttctgtaaaactgccttccttctgaaatcctaaaaaaaagtagttccttttattttctttacattgtgctttctaactgccaccagaatagcttatatttgtagtttaatcagtactaataaatgcatactatattgtctttgtgcctgttagttatagatgaagaattctaagatttgctaccacaagctttgatatagttgtatcaattgaaacttcatcacctaaaccagctttgctcatagaattcactctgaatcttccattacctgaacttctccttataagaacagataacagatttttttcctaagttttttccactgataccttaaatgttctttattttgaaatctcaaatatgtgacccctccagccacatggcaaagaaaaagccaagagtagttaatttaggtggatttatccaatcaaattatatgtatacatacatataactgagtatatgcatatgagacaagataaagacaacagacatccagcaaggcaaactcataaaatgtttcaagacaaaatgatataattacatgtgataccacatacagggcatttgtctacagtttgccatctgtagtaaggagtatttttgtttctctcgccaaaaggtacattttacgctctcttacttcataatgggcacagatatctttttaaaaaaaaatgcttaaaaagctgattcctgcttgaaggtttgtttccctactgcaattttcattattcaggaagaatatcttatcatacgaattgcggatttcacatgctctcaatttcaggtcccactgcgcatgcacttgctgaaagcagacatccgactgcctatataacagttttataaatggagcaagttgacttaaattggaacaattttaggagacttttccattgccttttttccatgacagctctccagctcagggctttcagatttgaaagaaagatcttttacaacagtgagcacacacacgtatctacaaacaggaaatttttcataagtcatgctcaaacatatgaattaa

SEQ ID NO: 7573 - DNA, 1541 bp, artificial
  synthetic oligonucleotide
ttccaacttccttctgctgtctttgaataaaacaccatgaaaaccattttacttctggagcagagctttcaaaaaaccaaaactatcgacaaacccttcattgtacattctactttcctcttggtgacctcttcgtttcaaatgctgtaatgagctcagttttgctccttcactactcctttctggtatgctgctcccgtgggcacctcctaagtggttcaaggaaaagacccatcattgctcagcagtcagggcaagttacagccacaagtcaaataccttcctgagacctttaaccttgctgaatggggtgggagagtgatgaaagccattctgcataccaggaaggtctaatgtcacagcttacaacctgtccaaacaggatgcttggacttttttgttttttgtttttttttaactaaatagtgatcagggtggctctaaaacagtattcctatggtgacaccctcaagtcactccacaccaaaagggaaagaaggtcaagctggaaggggggtagatatacttcggaagttcctgtgaggaactttacataccttggagaggactaaaggaaggtgaacaggcagtgtccacacaaccggctagtcaggaaaacctttgcaatcagggtgcaggttaggttaagtaaaagccacaatcataagacactaattagaagaaaccagagatttatatgcatcttgaattactttattagatatccaaatatctctgagtctcagtctttcggagagtcatcgcacctttttaagctctcagtcgggctgggcacagtggctcatgtctgtaatcccagaactttgggaggccaaggcgggcggatcatctgaggtcaggagttcaagaccagcctggccaacatggtgaaaccctgtctctactaaaaataccaaatattagccagacgtagtggcgggcacctgtaatcctggctacttaggaggctgagacaggagaatcacttgaacccaggaggcagaggttgcagtgagccgaggtcgcaccattgcactccagcctgggcaacaagagcaaaactccgtttcaaaaaagagaaagctctcagtaaggttatattgttgaagtgtctgtcatttctcaatggtttctaaagccattgcgctgtgaggtatttggggaaagagattcaattttcccattagatttagcctatttcatcctttgacagcatcttcactctatttttattttttattttttaatttttgtcttttatttattctttattatcgttagaatttaacttacataattatatttatgatttactaatatttaattctgtttttaataaggccacattcaaagtgtttcatttaaaaaaataataatggtagagtcaaccaataaagtgatgatatgcaggtttccagctcctaggtagtagcattcttacagggaagatgtttcactgcacaaacgaactaaccctcaggaagcttgaggatcctgtgaaggacacacaccgtctaatcatgtcagacgatgtaagtgtg

SEQ ID NO: 7574 - DNA, 2274 bp, artificial
  synthetic oligonucleotide
aaacatggcatttgaggcaaacagaaacttagtaaagtaaaagtgctgattcacataagcctaaagacaataaaaaccttggcacacatgttcttttctatcaaatccattcagataccatgcacacacaaaagttgtttaggaaaacaaaatcgggcaacattgaataactagattcaatcaacaaaatactcctgtaaaccacttgtgaactcctctttggttagtcaccaaataattcccacactatacaaagagcattccatgaaaaaaaggttcatgtacaaacatgcctcatggaccagttttccccatcagaatgagaatgtgagccaactcagaaaaattaaagagaactagatttagagctagaaggccagttttcaaactgtgacttgccaacacaagacttcatgccagtggttctcaatggaagatgaatttgagctccccccaactgccccaggcccagggacatttgacaacatttttggttgtcacaactggagagaggtactcctgcgtctagtgggtagaggccagggatgctgctaaacattctacaatgcacaggacaacctccatgacaaagaattaccttgtcccaaatgttcaaatgttcataatgccaatattgaaaaaccctgctttagacaaatcacttctcatctctctatccttggttttcctacttggaaaatagggactatgtgtctcatggaagcagaaatgttttaaagtatttagtttaatgtaagtgtgggattatctgatcttaccattattttttagtacttcaagtctataagaaatgcctgagaactgatcattttcagcttcaaactttaatgtggagttttacaaatacaattttattttttttcttttttgagacggagtctcactctgtcaccaggctggagtgcagtggtgcgatcttggctcactgcaacctctgcctcatgggttcaagcgattctcctgcctcagcctcctgagtagctgggactacaggcgcgtgtcaccacgcctggctaatttttgtgtatttttagtagagacggggtttcactatgttggccaggatggtctcaatctcctgacctcatgatccacccgcctcagcctcccaaagtgctgggattacaggcatgagccaccgtgcccggccacaaattattttttaaagtaatttagaaatgagccatagacatcttcctggtgaaaatagtacttgaggcaacagatagtatcgagcagagactgagagaccaggcactcaaataagagtgtctggagttcaagtcatggcaaggtactgaacatctgtaaaacatggtactaacagtatctactttatagggttgctgtgaggattcaatgtgttaatgtatataatgagcttctaacgatactcggtacatagtacatactcattaaatatttgctattgttatttttaatgaagcacactagagatatacaaggtattatgagacacaaaggagggtaacctaatccagtggagggggtagtcagggaaggtgtcctggagaacgtggtacttcagttacatcttaaaacctgacagatgttaaaggaaaggtataaaacttgaggcagggaggctggttagaaagcgattaaatcctcaggatagagctgagggctgaaaccagggcagtgataaccaacaggacttggtgaccactggctatggggaaagaaggacccaggaaggagggggcagaagataggacatgaacaagttgcttaccctctctgagcttccatttccctcatacatcaaatgaagacaatgctacctatttaacaggattactgcagggattaaataaatgtattaaaaccctctagcatagtggcacatagtagacaataaatggaaactctcactattattcctgattattattaacaacaattacaatagccctggaaggactaaggactaagccctaaatgacagctagcccacaaggctcagcatcaggaaaagacatgcctggtgttacactattggcttcatagcagagccatgaatataaactctatattccacctcctactctgtggtatgttttttttgttttgttttgttttcctcccactgtactgttctaaatggttggaggaggctcccctccaaaagatcaaggtgagcttacccatattgtcagcagtcttctcccagtgtcagcaatgaataggattctaaaacacactggaggactgcttccttctgctcaaggt

SEQ ID NO: 7575 - DNA, 5704 bp, artificial
  synthetic oligonucleotide
tttctcctatagagtttgtgaaatagtagaggaaaatgaaaaatctttattacaagtccctcttctctataagtgtatggccatccctaggcctcaagggagggaaggagcccaggccaaatctcatacacacagcgtgtgggccctcccaatacttttatacagatgctgcaaagaggcaggcagccagagagctgggggagagcaagggagggcgagtgcctgcaggagtgtgtgtgtagaggggggttgctaaatgactatctgtgctttcttctggcctttttcttcttttgggcaccacctttacctcctggcttcgaatcagccaaatgtggccccaaccccaaccctggacccattcatcttgtgggtgctcagcctgtgaggaccaatttttacattaccaacaaaagcatgttctctagccttaacaatctaattaccatggcacttccaggggagagagattggccagttgtttcagttctgtggaactgattcataggttgccccttacagctcctgcacatgcccacgtggtacattattaacacttaacaggggatgaggtagttcgaccctcccttagagcgaaatcctgcaaagcaatatttaacatatgcgcaaatgcatttcagtcaccaaaaagggtgaccaattacctttgcaactaaacagcaggctcactcggctcttttcatcaacctaaagaaaaggctgagggcgcgctggctgcctaggtaacctcctaccagtgaaccctggctggcagcgcccacggggtgcgcatccgcattcacaacttggtccaaccatcgggcccgcctccatgacttgttgagagccaccagccaagttttggctagggctgctccccgatccctcggaagcgcgggacgcgcgcctcactggatgcctgagttgagaagagaccctggaggccacaaacgtctcacggttacggaatacaactggccgtttcttctcagtgcacccctgacaaattaacctgtttgaaaccgactcttcttgtccgcattgtcagtgtagcaatttggtctaattggattctaaggcgggcgttaggagcccaaccgctggacagtcaatcacgcagggccattaatattcatctgttgacagcggcagccctcggctgatgttaaaatacgtcgttacggcacgatctgattgtgcagaacaaaaggcaggcgttcagaaactttcctccacctgaaatcatctcccctttaggatccagcctgtcaagaaggcagatgaatttgggagggggaggagttaaatatctttggactcctgctccctgggccagcagcaccggttttaaagcgatttcgctaacctatataagggatgctgttttgaaggaaaaggttcagtctcctcattttggggaccctcttactcaaaagtttgcctcagtgtgtcttcacccgccactgcagactcagaaatctgtcctcaactttgcttgcacttgggcccgtgagcttaggaaacccaggctgggtaaaggcggcggggggtgggggtacgttggggaagggatggctggagctgtggtccagctaaggctgaaattctgacacgtatgtgcgagcaaggatggcaaattcatgaggcaccagctcggctgtggggcgccagttcgcagagacccgggaaaatagctcccaccttctcgcccttccaaaaaacgggcgctcacgagaaggcgatccccacggttcctcccgctcacaccttccctgacagcagcgtgagactgggggatgtgggctccgtccacacacaccctctctccctccctcagtagacccagccaggccccaggcacaccgaccactcccaagtgcccagctgcagggcgcacgactacagcccggcggggctagcgcgctcagggtacagccaccacgcgcgccttgctccccgctgggcgctaggcacgctcaagggacccctcctcacctggcacgggagtttctggcacccacttgagtccgggctgcagtctctggaagaaggagcggacttggtgacaggtggcgtccggcggcggcggcgggggctgcgcctgtcccgggaagtccaagctgagcagcatcgccaccaccaagcacgcggtgcgcacggtcccggccatcctgcttcgcagggagctaggagagcgcgggagagtggcagccggagcgagagcagtcccaggactcggcaagcctggcagtggccctgaggagcaagagacgtgctgctacccagccgctgcaaaagtttcctcgcagctacctgggcgctgggcgagggcgggaaccgcttggcggcgcggggcagggcggggctgactggggtggggcggggcgaggagggacggggcggggcgaggcgagccgcgcggccagggggcggtggcggttgtgcggccggtagccggcggggtgcgggggcgcggcgtggagcgcggcgggggccactggggcaccgcggcgcggggaccgggcgaaggcagtgcgagaggagggtgcggagcccgcgcggtggctcccggcagccgagcccagctgcccgctcgcagccgctctacacagggcgctctggcataactactgcagaggggctgcaggctcgagcgcgctgattggcttcccagcagccgtccgctctgactggctctgggagaagttccccagcctcactcctccttcccgccgctcattggcctacagcctggagggcttttccctttaggatttttgtctccttttcatccttcctgggggcaggtgggggtccctgacttaggtccccctccgcttcgccacaggccttctttcagcttgtgccagctctttcctggccaccagagccacacaaggtgttccttcacacaaaatccacctcctcattctactctctgaggagcttcccgggaaccgttttcctaacgcagctctgaccgggttctcaaagccaacctgcaaatagtcgcgttcagggacagccagggaccgctgggcttttcacagcctgcctcacctttgaatattgtatcttaaaagtctgaaagcctctgtggcttgctagatttgattcagtagagccacacaaagtcagagaaagcacctgattctggggcgttaaaagaaaatctactgcacgacagtcccaggtggcccttcaagaggcaaagcctaactggttacaacgaaataaccaggggcttaaagccagcctaactcattagaaaatcattacacagcaaatttactgagccaaagctagcctatttcatagatggagtagaaggctatttgaaaggtatcctacacccaaatcccacctctcctgcttagatttcaccattagaaatccagttctttaggccaggcacggtggctcacgcctgtaatcccagcactttgggaagccgaggcgggtggatcatgaggtcaggagttcaagaccagcctggccaagatggtgaaaccccgtctctaccaaaaatacaaaaaattagctgggcgcggtggcaggcgcctgtaatcccagctactcgggaggctgaggcaggagaatcacttgaactcagagggcagaggttgcagtgagctgagatcgcactactgcactccagcttgggcgacagagtgagactccgtctcaaaaaaaaaaaaaaaaagaaaaaagaaaaaaagaaatccagttctttgagaatgaaatatctctccaaggaaaaatgcatttagtcattacctatatgctgctaagtagggatctttagcgtggattattttcatgatcctccacaccctagtccagtagagaactcaataagtatttgtatgatgaaattacttaacacctcagcatgaattagtttgtcatctgatggttttgtttccgacctaggtgaaagtaggttttgagggagaacctcagcaccaggaaattgtctggggtgtgcaaggtccggagagaggaggttgtgttccaggacccatgggctgagaagggagacaaagagagaggaaggtcacgggggaagttcattcatccatttattcattcggtaacaaatatttgaactcctactgtgttccaggcactgtagattacaaacagacaatgaggatacaaagattaaccaacccgtggtacctgacctcaaagaactgcaaactaatggggaaaacaaccaagttaacccactgtgtgaatgctaagatgaagttctaaggggtgaagggggggggggatcggagaaagcatgccagaggagatgatgtcctaaactcagaccagtaggagtttaggtgagacaagcagatggggagaagggtgctgaggcaaagaaagcagtgtaaacaaagacactgaggggagagggcttggcatggcccagttggaaggtgggaggtgcaagtaatgatttcaggttgcggagttggaagagctaaggtgacagaggtaagcaagggccagattatgcagtcttgaagccatatggaggagcctggggaaccacttaaggaagttttcagcacaggggggtgccatgatcatatttgcctgattaaaagatctctccagcagcactgtggagaatggcttgaagaaggaaaaagactggaagcaaggagaccagttaagaggctgtgaaaataatccagacaagaaatgttaaagtcctgtagcagagaagatttggaaatggaaataattactggagatatttagcatatagagttaaaagggcatagtgacctagtcgatatgggggatgggagagaaggagtcaaggacggagggctcattcactcttttttcaacaaacatttgagtgccgccgatgtatctggcattcttctcctacttcataattttgcctggggctaggcctgcgcctgcattgaacatttgacaaatgacatatccactttaaaagaaacaccaattaagagtcataatttggctggtgagtttgatatgttccacctgtggagccctgtgaccaaagggcagattggaaggcaagcattgattgaatttcatgaccttgcagaggaagacatgacctcccataaattcatgatcttccagagctcatgcaactaactacaaaggcaacagttgttttcaactactgggtattgagtacctggaaaaggggaaatgtgacttatttttaatatatgcttttatatttaatatactttgtatgagctaggtcagtgcttcccaaagggaagcgtgtgaatccctgggttcactgaagtggaccaatgaagtttttgcttttcattttaataaatatttattttaatggtggattagaaaaaatatatgtaactagtacatccaacccatgattttgttaggacaaaactaagtagctggtgccatgatacatttatttcaataaaaatgtgaactggtttgaagaaaaatatttaatagtaatgggaatatgaagatataacaaaatgtgtagggcgatatgtgaataactaggatttgggctgtcataggcaagctggccctgaggttttggaaaatatttctttggcctaaaagcttctgctgtccctccaagcagctacttcagagcttttagccaacctaaggtaggagttaataaaacttgctaggtttaaggagtggttccatttttataagtgcc

SEQ ID NO: 7576 - DNA, 1788 bp, artificial
  synthetic oligonucleotide
acgtgtgttgctaggatagtacaagtattttcaagatgaattttctgccaaaagttcttgccactgagtcatcaccatcttcatatttttaaaaaacatgagcaagtctcagcagcacttcattcacattagtaaacattacctagggaaagaaagaacaggcctcaagaacatgacatcatcattaaaaaataaatgtttactgagtccctattcagtgtgtggccctgtgttagccctagaaatataaaaatgtgcctgcttttaggctcacatgcacacacatatactcccatgtgttaaatctagagaagtggtgcagactagaaggattatcggaattccaaggagggagcaattctgctccaagggctggggtggtcacaaaaggtagggctccaggccccaaagaaagggtagagagcttgagggaattaatgtgaacaaagaccaggaaatagtaatgaaaatagtttgggggaaaataattagtagaccatttgatgggagcagacagattgtgtggactggaagatgactaggagataataatggaatggtagaccatagtctgcttgtagagggccttgaattctaggctaattagtgtagtcttagcctataagcaataaggagcaccactctcacagataaaagagagcagaccactccagcttcagagtaccttcaatcaaaagaagcacggacattgattacaagaagttttgtgaaatgtctcaagtgtgtataactatttcccatatttgtaactttgttatctccatggtatcagtgttatttgggaggacagcaagaagaagatagctggcaagattacgtcctactggagatgaaaaggaccctaagaaatggtaagtggcagtggttttaaagtagaaagatagatatgaacaatctctggggctcacagaagggagagaaaaacaatctctggggctcacagaagggcttgtcatatgttcacagcatgcagctccacactggcatattgggggccagcgtaggactgcaaaatgcctttgagggcttaactgaaaggagtctagatagttcctgccagccccttaacctgctgaatttctccaatagcatatctcatgccagtttaaaggaagagacttaaatggacattgttaactgaatgcaccattttgtgaactccagagagccctgagaatattctgtaaataccaccttattgaactaagtgggattgactgggtaccaggtaacatttagttgagtttgttcagtcttctaatttgaagttgctgcttagacgatagtggttccccacctctgcacccaaatttgaggcaaaagtgaaaaagcaaaaaaaaaaaaattttcaggcaagagttgattgtgattgtggcctgttaaaataaacagttgatgtggataatcaggagctactttctgctctcctccaaattaaaaaatggcttcagtattggtgaataaacagttgtccatccaggatcagttggaaagggcttctgcctccattgatcttctcttctagctgagttgttctcttccagtcctaaatttacccctatcctcctttgcaagtaaaggggttgttaacatttagctgatggggcacaaagtcatcagaaaagaccttgttgcctcctttcatcaactctgcccattagccaagcaaaaaagaaacattggtttcttaattgactttcataatccctttcataatcattttgtacgtggtacatactaggtactcaataattatttgctgaacaa

SEQ ID NO: 7577 - DNA, 1618 bp, artificial
  synthetic oligonucleotide
agaatggacgctgactttcttgcttggtgctcaacggctttgttttccttacactgactctcttttgtcatcacgaaagtcattattaggctaatgtaaaattaaattagcttacattcaacaagtacaggaagcacaaatactcatcagtgggatggcttagaaggatcctagaaacgaaatcagtatctcaaagagatattagcacacccatgttcatgcagcattatacacaacagtgaaaacgtgaaaacaacctaaacatgcattgaaggataaatggataaagaaaatttcacacacacacacacacacacacacacacacacacacacacatatatatatatacacacaatgaaatattattcagccttaaaaaaggagatcctgccatttgccatggcatggatgaacctggaggacattatgtcaagtgaaataagccagacacaggaagaaaaatactgtatgatggcatttgtatgtggaatctaaaacagttgaactcatggaagcagagagtagaacaatgattgccagaggttggggggttggggaaatggggagatgttgttcaaagggtacaaaccttcagttataaaatgaataagttctggggatctaatgtacagcgtggtaactatagttaataatacactggattgtttacttgaaatttggtaaaagggcagattttaagtgtcctcaccccacctctccacacagaatggcaattacaggtggtgatggatgtgttaatttaacttcagtaatcagtacacaatgtaaatatatatcaaatcctcatgttgtacaccttgaatacatacattttttatttgtcaattaagtttttttccaaaactttttttaaaaaggaagtatcctagaagatgctctggccagtcactgtcttggaaacatcccttggttgcaatacctgttatgtgctacttttgaatactttccaagatcatcaagctataagccacatggtaaagaaaatatagctatgatctatttgagggacatgtggaaagagaatatttaaatgataatctagtttttcaaatcagacaaagagcccttcagctgtaaaggcctgtagaagcccatcacaccgagggttccagtttgtgtggaatggttagtttctaaggaagatatcaagctaggttcagaaactataaaaggtctttggcttcatagatagatagatagattgatagttgcatttgctttcttcatcacaggaattgtgacttgctgttgagaaaacattttgagagacccaggaataaaaatagaaacagagatgctgctctggttttcattctcatcaatagaaagggaatgtcaaggctgtggtaatatgaacttccctggctcgcagtaggtaagaaatgcgactgagggtctgaggcagtttggtgctaggaggaagttattctgaactgggctttgcagcccaaatactttctcatccctcacctcccagcatgcacctcttgaaataagctttcaaagcttatcaggcagtttataaaaacaaagggattcctcttccaagaagtttctggtctgagatgacacaggtagtacagaaatgttccgtt

SEQ ID NO: 7578 - DNA, 1713 bp, artificial
  synthetic oligonucleotide
gagcaagactggctgggttcaaatctcagctttaacacttttagtagctgtgtaactttgagcaagttaacctccctgtacttgagttttctcagctataaaacggagtaattacaatgcctaccttccagggttattgttttttttttgtttgtttttttctttacagcgtctcactctgtcacccaggctggagtgcagcgactcactctcggctcactgcaacctctgcctaccaggttcaagcgattctcctgccttagcctcccacgtagctgggattacaagcacccaccactatgcctggctaatttttgtattttcagtagagtcaggtttcaccatgttggccaggctggtctcgaactcctgacctcaagtggtccacccaccttggcctgccaaagtgctgggattacaggtctgagccaccgcgtcctgccaatattaccttttagtagtagtattctctctttaactttatctcttgcctctctctctctccgtccccccgttttttagccacatcattttttttatttctacagcatgccatattctcttatttaactgtaaaattcaatgtcttttagtatatttacagaattgtacattcatcaccacaatcaattttagaacattttcattaccccaaaaagaagcctcacaccccttagccttaggcaaccactaatctactttctgtctccaaggatttgcctattctggacttttcatatacatggaatcatacaatatgtggtcttttgtgtctgacttccttcacttggcataatattttcaaggtttatccatgttgtagcatggatcagtgcttcatcctttttatggccgcactatgttctctttcattgcccagcctttgtacagggaatccttctgtcagtaatccattccttttctccaccccccactcacatgattaagtctcattcaaacttgagccctgtagtttagatagaatcaaaagacttcctcctggaagcctttgatgatcaccctctcccatccccaccccgcttagaacggcttaagtaagcttcctaggtgctccccccaatatcctgtacttcccctattgcttgtttatttatctgtctttctcttcgactgctggctgaacaacaactgcagccatgtttgtatactgctcatatccagtacttagcagaggatgtggcaaccactaggcactcaattactttgctgaattatgaaacaggaacaggaggagcagggccagaacagaaaagaggaggctcaattggtagcaggccaatggaggttttctgctgcgctaccagactaaactttctaaaacactgctttcttcaagacatgtcttcaagctagatactgggcctgtttctcctctaaaaaatgtagggtccacctgaataatccctataatcccttttcagccccaacactgattgcttacaagtatatgtttaattagtcccataattatgaaggagagccaagaggatgccaagtgcattaaaatacatttctctcaaattaatgcataataacactgtacaaaataggactttttttccccttaaagtattagcaatatggactaactggggtcaaataaaaaaatatgatgtcttacatgataatagttaaggaatacagcttccatccactagaagcttttgaatcctcttttaatcagttctatct

SEQ ID NO: 7579 - DNA, 473 bp, artificial
  synthetic oligonucleotide
acttattctgcaaatctggatgttagtgctttcttgatcttaccagaatgtcccagaggatatttggattaagtttactcatgtgcacatgacgactacatcatgaatgcagcaaggctgacagtgattgtaagactcatcccaatttcaaagatgtaaggaaaatatgcattttgagaatcaatgaaatatggaagtttaagtagtttaaaattctttatatatgatgtatgaaagaaagcagttactcctctccagattatcttacccagagtaagtaccctgaaaacattgctctggttatatgactcttcagctcaacaactgtcaatagctcctctttgctcctagagtaaaggccaacctcttgaagcctgcatttaaagccctccataatctaaccacaacctatcttacctgtcttattttccactagtcattccttgaacatataaataggagactggttaaaa

SEQ ID NO: 7580 - DNA, 2136 bp, artificial
  synthetic oligonucleotide
tcttatgccactaaatgagtctttagaagtctttacaaactaaactgatttataaaacttatacatcaatctggaatcaattttctattagggaagaatggatttagtatagaaatgagaaaaataacatttttccccttaaattgggtttctacacctgtgaagatttcttttccattaaaaaaaaaatactccaaacttgactcaaaatgcatagtatttgccaacccaacctggccaaactgagccccacagccatcagacagggcgcccttctagttactaccttttgctaattagcggttcatctggcatccctcgcgcacgctgggcagtcactctccaatccccttaaattgcaaataataataataataataaggaaaagaaagaaagaagtccttccctgtacgcctttgtggctcccttttgcctcttcccgcgtctctcacacccttacctaatgctcccgttgaagtccgcgagcagcccgcgcgtccagggtgtgctccagctgctcacaccacgcgctccagtcctcgtgcagcctcagccgccgccgaaattaaagagaaagaaacaaagcatcatgggaaacggagttctccattcaaagcaccaaaaacgcgccaagcccacgcctccctccccctccattcccgggttggtgggatagaagccaagagggaggggagtcccttttttccctccacgtgcaccccctcatttcacaccctcaccaccaaagttttccaggaacctaaaggtcaacggtggagaagaaaaggggagtcgtttcccgcgcgctgcccgctacccctcaaccgcactctggtactttgcttttctcaagtcccgcccgctccgtcccctcccacccaaccagtcaactctaccggatcacagctgccccaacgaagggctcccttcttgcccagccacccgctcgggaaaccgcgcgcgggacccagctccggcccgcccctcgcaggtggagagcgcggggatcccgcacgggccgccctctccgggtgtcccctccacacgtatacccagtgtcccagcgcgcagctcgagcgctccggggccgggtgcgagcgcagtctcccgcggagccagaaggggaagagaagtgagaaaaagcgtccactaaatggatcaaggccgcgagcgcacatctcaccccaaagcgcccctgtccagagcgacgcggggccacgagcctccctgccaccacttgaggagcgctccgtccccttggccctctgtccgtagctatatccctgggaaaagcccgcccctctgcctttaatagcccaaggaaaaaagcccgcccccgcccacccggcccgcacaggaattaggaaacggaacccccaccccgccaaagcgaaaaccccaccgagccccagttacccacgggcggaccgcagtcggcattttcccttctctcttcccccaagctggagtccttaattaaaggcgcgcctgggacagcggcccaggcagaggccgtggccggagccggtgcgggtgccaccggcatccgggccaggatggcgcactcactaccaccttgtcccatctcgctcccgcggcgctcgcctcagccccccaccggagacagacgacgaggcccacggagccgtgggacaggggtgtcccccacccggcgcgcgcatgcgcgccacctcgccgctagattgaaagtgttcctaaggcccgaggagggaagaaatagaaacacgacttactctctgcacatgtgaaagttttaacccctagcaccttgtgctactgttgggaggctttcgcccttgccaggcgccctcttcacccactaaatcagggtttcttggcaggtatcgttaacggtagcagccaccgaatacacgcgcaaatgtgcggaagatacggtgcaattatcttgctttctcctctcattccaccgctaatgagaaccaattgagggcgggctgcttcaaggccaaagcccgacagcgctctgtagaataaaatgatgtcttagtttaagacgcacaatcaaaatggaattaagcataccagactttgaacaccgggcaaaatgagagacaaccgggctatataccttctccgcgtccctggcggacacag

SEQ ID NO: 7581 - DNA, 3176 bp, artificial
  synthetic oligonucleotide
tgggcttctaggcctccagaactgtgaaagaataagtgtctgttgctttaagccacccagtttgtgatacttcattatggcagctgtaggaaaagaatacagcgggcaagtgtagaagcaggaggctattgcaaggtccagtcaaaagatgatgagggccagaggaggggtggtaaaggcggaaatggtgagaagctgtcagattctgctctgttgcccaggctggagaagctgtcagatattaggaaggtacggccaacagaatttgctgatgtataggatgtggggtgtgataaatgttagctattattattatctgcacaaatagtttatccacatataatatatgcttataggccaggtgcagtggctcacgtctgtaatctgagcactttgggaggctgaggcgggtggatcacctgaggtcaggagtttgagaccagcctggccaacgtggtaaaaccccgtctctactaaaaatacaaaaaattagacaggtgtggtggcacacgcttaaatcccagcttcttgagaggctgaggcaggagaaccgcttgaacccgggaggcagaagttgcagtgagttgagatcacgccactgcacttcagccttggcgacagagtgagaccccgtcgcaaaaaaaaaaaaaatatatatatatataattatatatatatataatattatatatatatatacacatacttataaatgtatatgttttcattgccccaaatagcccaggtttgaggctactgaaactaggatcattttccagggcaatcaaaagtagcctattttgctgcatgatccaagaaaaaaatcacattacttctctgagtctcagtctcccacgtggtgaaatgagaaggttgggctccattgtatgactgtataattctattaatacaatatcaagtgctttgttgccttagtattggtaaatcttccagaggatagtaaacgttttctgacttacatatttgaaaacctatctccaagtctgcagtagctttgaataacaaaactctctgtcctaatcgttgttgatcctctgccatttgataccgatggtacaaggagtgacccaccatatttaaaaagataattacggcaagaccaaggtaatctttgtgccttttattcacgaatatgggggtggtgtggagttgcttggtgagaatctgaaactctacctgaaataaaggtttggaattctgggtctcaagatttctgactccattttccagaacacaccctgaattatcaccatcagtgtgtttgtatttatattttaggaaagtgatgaatgtataaggcaatataataataagaatagcaaacagttgtataggatttattctgtgtcaagtaccgttctaagggtcttaaaaacattaactcacttgatcctcacaacactcatgagttaagtccaattagtattcccattgtacaaatgaggaaagtgaggcacggagcaattaagaaagattcctttattataagggatcttacctccagcagaaataaatgggatccttttaaaataattaaaacaaatgataggccaggtgcggtgactcatggctgtaatcccagcactttgggaggccaaggcgggcggatcacttgaggtcaggagttcaagttcagcctggccaacatggagaaaccctttctctactaaaaattaaaaaatttaaaaatgagccaggcatggtggtgcgggcctgtagtcctagctactctggaggctggggcaggagaatcacttgaaccgggaaggcagaggttgcagtgagctgagatcgcaccactgcactctagcctgggtctgcactccagactctgtctcaaaaaaaaaaaaaatacatggaagatgcacggcaatttggagactcaacgtcaaggaaagaagttctgtcagaatcccacaaattaattctgaaggagtcagtcaataataaaacacacattgacattaggactcttcctacctccaacccttgttgactttggttctctaaggaggaaaaaggtgattgagaactaggcctcagggcacctggaagaagctttgccagctctcaaacacctgttacatccggttcccaagaagttttgaagctttgaaatgtatcctggtattgttcctaagtcactcccttgctaggtccttgataaattagactggcacgtttaaaaaattcttaaacctcctttcacttgagatcccaaagccaatatttcctttcaccctaatgcttcctagaaaatactagctttcctaagaatcactcttgttactatttcagacaccccagacccacggtttcaggtcccacagcctgggtcaagtccatcgtggtgatggaagaattagtactgggcaaccaggctaatcaaaatctgagaagatatttatttatttatttatttagagatggagtctcactctgtcacccaggctggagagcagtggtgcaatctcggctcactgcaacctccgcctcccagggtcaagtgattctcatgcctcagcctcccgagtagctgtgactacagatgtgtgccaccacaccaggctaattttttggtaatttttagtagagatgaggtttcaccatgttggccaggctggtctcgaacccctgacctcaggtgatccacccacctcggcctcccaaattgctgggattacaggcatgagccaccgcgcccggcctatttatttattttttgagatggagtctcgctctgtcacccaggctggagtgcagtggcatgatctcagctcacgcctcccaggttccagcaattcacctgccttagcctcccgagtagctgggactacaggtgtgcaccaccacgccaggctaatttttgtgcttttagtagaaatgggtttcagcatgttggccaggctggtctcaaactcctgacctcaggtaatccgcccacctcggcctcccaaagtgctgggattacaggtgtgagccactgcgcctggcctaagtctaagaagatcatttattgattcaacaaaatacaatgtttaaaatctataacacagtgaaaagcatgggcttgtcacccaaccaaatcctggaagttgtgagcaaactttgaagtaggaagacagtactttggggacaaataaaaggaaacaatt

SEQ ID NO: 7582 - DNA, 1180 bp, artificial
  synthetic oligonucleotide
tgctctgaagtgagaataaattggacagttgagaaggaagcaaacctagtgatttcctttgtaacagatttttttcctattttggtggagcagtttttctaagagtccagagaacagaccatccaagaataaggggagaaagttctttatgttaagaggagccctttgtcttcaccttactgcccctaggcagtgactaaaagccatgccccttgttgagagctactaagcgactgaggataatgacaggttactcaacacgggttggagatgaccttttccaaccatcattcccagtttacaaagtttgagaggaaggacccttgtgagatgggaaagagcctttggcattcttccagaactgttttccagtccctacctactctgcctggaagaataatggaattttgcaggcagatctaaatttgtgaagagagatggtcctgaaaatttgaaaccaaattctttttttttttttttttttttttttttttttttttaggagacagagtgtcgctctgtttcccaggctggagtgcagtggcatgatcatagctcacttcagcctcaaccccctgagctcaagcaatcctcccacctgagtagttaggactacaggcatatgccaccacacctatctaattttgtttttaatttttgtagacacgcatctcactatgttgcccaggctggttttgaactcctgacatcaagttatccttccgcctctgcctcccaaagcactgggattacagatgtgagccactgtgcccgtgtaaatgggataaggcaacagaaaaaaaaaattgatttatgtcatcaaatttccctaaagcctgtgatttaaaatatgaatattttagaaaacaaataattaaatttcacatccgctttaatatgattatactctctggggccccagctgaaaaatgaaactgagatggtttgtggatttctcctttcagagtaaacagtagtgtattattttatggagctatttgagaatagatgtgcattcctctaagatttttatggaacagtgcacctataggtccattgtaaatgactgttctttgcttagctctcaacatttatgttacatcatgttatatataaattcatattcaatttattttatcagtggttctcaaattctttaggtgaatacaaaccactttca

SEQ ID NO: 7583 - DNA, 1154 bp, artificial
  synthetic oligonucleotide
tgttttaaagcctaataaaccaaatgtaattgcacactatgaggatgagatacaattgttttaagggtttaggtgtcttccctgttgggaaaatccctagactgggagtcaggacatttggcttctagtacctgctctgccagtaactagttaactttcttcccctaaaagtcctcatctataaaacaaggcaacagatctatcatcgagattctgttcagttctaatgttctgtgatttcacctcaatgattttatttgcaagtgtaactctacctgtaaggaagtaaaactcctatggcattggatgcattcaattctttttttgttttgttttgtttgagacagagtcttgctctgtagctcaggctagagtgcagtggcgcgatctcggctcactgcaacctccgccttccgggttcaagcgattctcctgccttagcctcccgagtagctgggattacgggcgcctgccactacacccggctattttttgtatttatgtatttatttatttatttatttatttagtagagacagggtttcaccatctcggccaggctggtctcgaactcctgatctcgtgatccacccatctctacctcccaaagtactggggttacaggcgtgagccaccgcacccggcctggatgcattcaattctaatactttgggggacctactttgcagactccctttgaaagaaaatataagcagggtcctttatatagtttgaacatctccaaatactatgaataataaatcaatagaggttgtttctctacctttctcttgtttcctctttattcattaaggttggggaaggcactgaatggatactgactaagctgacctggaggctgaacaagtcttgccttgcctgggaggactggcgtaaattggaagatgctaatctttggagctctgtgacttagtcctgataaacctaacccaggcactggcagcctgccttaaagggggagatgactttcaggtttttagtggtcactggcttcccaccaagggtctaggtacgaaagcaaactaggaactcgttgccctattttactttcttcttcatcacccccttataagattgcccctttgtacttgcctcataagacgctcattccctgaatgctaatgtgcagagct

SEQ ID NO: 7584 - DNA, 2097 bp, artificial
  synthetic oligonucleotide
ttcattccttctaaaacacatttttaaaatttttgacatttcctgaatttgggactcatcttcaaattgatggtatgtcatagaataattgtcagtgttttgtttttcttagtaattaatgaaataatggtgtatcttacaattgatggagttttagatttgatgaaataaggtatgtgctaggctggggatatggaaatcaaagggtttatgaataagacaagtctctgacctcaaggagcttacttatgcaattaattaaaacaatgtggtaagagctataccaccaatgctaatataaagtgctgtgggagcataaaggaggatcaattaattctgcctgtgggactgggaaacactttgtaaaggaggtgacatttgagctgggccttgaaggatatgaaggatttttccagacaaagcatgggagtaggaggcagggacatttctggaatgtgaatatggaaggtttatttggcttcaaagaggactcagcagcaatgaattagagcactggtatgttatgtgttgctgatttttttgtttgtttgttgagacggagtcttgctctgttgcccaggcttgagtgcagtggcacgataccggctcactgcaacctccacctcccaggttcaagtgatttcctgcttcatcctcccaagtagctgggattacaggcgcctgccaccacaccctgctaagttttgtatttttagtagagacagggttttgccacattggacaggctgatctcaaactcccgacctcctcaggtgatccacccgcctcggcctcccaaagcgctgggattacaggcgtgagccacctcgcccagccatgttgctgatttttaatgtctcgtttgaggttctaccctgaaaactactgtgaattccaacgtttttggtcatttgcagatagactggagaatgatgttctcatgacataaagaccaggttccagataacaaactgcagaaaaccattttgctgatgctactctacctttggatgctatcatttttgttttggaaacaaaagacctaggagatttttatcataagccaagtctgccgtgagtaggctggtttcaaggagatgtatgaaagagaaacatcacagttgctcctctctccaaagaagcatagagcatagaggttaagtgcacaaactttggttatccacttgctagctgtgtgaccttgggcaacttgtgtaattctctgtagctcagtttcctcatcttgtaagacagggtacataactagtgtttttgagaggtaagatgagatcacatacggtcaataaatgtcacccttgttattatcattattgctaatcgacaatgggaaattgaccaaatctatctgtctcctcccagctattactctcaccaagctttttatacctattgtgttccctggagagaatatgatgaactaattcgtaatatgtgtatcaatgatgtgtgtatatatttgggaaggtggaacaagttgcagagaagacatgttggttttattagtatatgaagccttaaggcaaagtaacaaatctattgtgatggctcttctggcctcaggaaggatcctgtagagggcatttcttgggttagagcctacccaccccccctccaatcaggtctgtgttcgattggcccctggctctagcaggcagagtaccagaagggggaagaaagccctgctctagtgctccagagggaaaaaaaactcatctaggaagagggaatggagacaagagaagctattatagcattttttatttccccttggcacaaggagctgtgcagctggggacccactactacagctgctcagataaaaataagtcattgtcttgtcctttgtactcatgagacactgaagctatagttatctatgtattgtaggtgtaccctcctttccatactgagtaccaaggtgatgtctcccctgtttagtggtcagagctactgttcacagagtctctctgtccctccaccccactacctctctctatgaatgacacctttgatcacactcaaccttctgatgattgctatgtttcactgggtgcaggttgtcatttcccaggagac

SEQ ID NO: 7585 - DNA, 2708 bp, artificial
  synthetic oligonucleotide
caagatttaactggtggctttactatcagtttcattcaagtaagcttctgtgtggatagacaatatttcttgatattgcatgagaatcaaatgagaccctatatataagaagctttgcaatggactgtgcacatgctttcatttccattaatatcatttcctgcccaatcatttccttctggaaaggtaatttcaagcctctgtaaagaagtcctgtgcttaaggatcttgctcaaaaatgccactttcttcctgaaggctggactttaaggaatttccccttctttcttaccaaacaagaagcttcttgattatcatagtacagatatttaataatatttgttgaatgatttagtaactgaatgaaatatttttaaaaggcaataaaaaagaggcttttcttgctaaatggaaggcttcatttgtccccattctattgaatgtgctggttctgagaagaattgagttactttaattttcactctaggctttccccaagtttggtgaaactttccatagaactgtttgttttgttatagtaccatcttctgttttatttatgttactagccttatatacgtgtggcttatatttagatattaaatattgcctaacacagagcttggcacccaataaataaatattttttcagtgaatgaatgaacaggaaggattgtgcccacttttataggagaaaaacagtgttatcagaagtgaagaactatctgcaaaattatacgaaataataaattcagaatattttattttcataatatacctatacattatgtatatgtacacaatatagctagatatacatacgtgtatacatatatagtgtctatgtatagtcaatatatttatgactttttctatttaaattttctttttaaaatttttttgagacagaatatcgctctgtcgcccaggcttgagtgcagtggtgtgatcttggctcactgcaacctctgcctccctggttcaagtgattctcctgcttcagcctcccgagtagctgggattacaggcgtgtgccaccacacctgccgaatttttgcatttttagtagagatggggtttcatcatgttggctaggctggtctcaaactcctgagctcaagtgatccacctgcctcggcctcccaaagtgctgggattacaggtgcgagccactggcccagctggctacttaaattttctatacaaagtcattgccaattaatatagtcattgatggcatagtgcttaaacaaccaaaatgcacttaaaaagcttcagtcttggacccctccctctccaaaactggataattaacaatgccctaacttgcatgtaaaaacagtgtctgaaaaaataatttccattaaactgtacagtatttaacatagaatttagtaacactcattatttattgttatttttgcagaacagtgtaacattacagaaattgttttgctttattatggaaattttcaaacataaacaaaagtaggcagaataagacggtgaacctctatgtacacatcacatagcttcaataattacctacacaggctgggcacggtggctcatgcctgtgatcccagcactttgggaggccgaggtaagcggatcacttgaagtcaggagtttgagaccagcctggtgaacatggcaaaacctgtctctactgaaaattcaaaaattagctgggcgtggtggcgcacgcctgtagtctcagctacttgggaggctgaggcacaagaattgcttgaatcctggaggcagatgttgcagtgagcctgggcgacagagggagactctgtctcaaaaaaaaaaatcaccaatacattgctcaaacttctcaaacttgtttcactgatatttccccaattcttctaaaccccatcccatcctgtccacctcctgctaaacgatttttttttgagacagaaccccaacccatcctgtccacctcctgctgaacgattttttttttttttttttgagacagaatctcactctgtcaaccaggctggagtgcagtggtgctatctcagctcactgcaacctccacctcccgggctcaagtgattctcctgcctcaccttccccattaactgggattacaggcactccccaccacatctggctaatttttgtatttgtagtagagacggggtttcaccatgttggccaggctggtctcgaactcctgacctcaggtgatctgcccacctcggtctcccaaagtgcagggattacaggcatgagccaacacgcctggctgctgaacgattttagagaaaaccccagacagcatatcatttcacctatcaatacttcactttattaaaagcctttgaaagaagtattcagcatgccttactgtttactggtgtgtgtaacaatattagtccccttgaggaagacataaaatcaaatattctgaacaaggcactattggtatttagcactgcattttttaaaaagcagcttaaaagaacacacgtatttattatctcatgcttcaggggtccaggcatagcttagctgcatcctcttcttcagggtctctcagaagactgcaatcaagtgttggctggtgctggggtctcatctgagactcaaatggtgaaggatccacttccaagatctcatggttgctgtcaggactcagttccttgtggtctattagccagtctcacctcatttccttgttacatagg

SEQ ID NO: 7586 - DNA, 305 bp, artificial
  synthetic oligonucleotide
gaacaaatacacacatacaaaaagatacatataggcaggtcatcataaaactgttgaagagcaaagacaaaatcttaaaagaggccaaaagaaaaagaacaaattaccttcaataaagcaaaataagttttaaaactgacttctccattccacctttgagcattttaaaatcaactcacttaaaatcagggatacatttatgattatgcctttagttcttctcattacaacttcagcttactgtcaacacagtcactttctttcaatgctatcaacacttccatattatcaacaggttcttcaga

SEQ ID NO: 7587 - DNA, 220 bp, artificial
  synthetic oligonucleotide
tctttcagtgcctgcttcttattctctggaagatcttcttccactggctctggcttggtctcctttttgggaaggggtggtggtgaaggtgttgcaacctgttcctcctcatccatactgccccgatcgacctcaaggaggacactgagagtggtcaggatccggggatctcgtagttttgtgcccagatcagaaggcttgttttatagttgctctatca

SEQ ID NO: 7588 - DNA, 2531 bp, artificial
  synthetic oligonucleotide
cgattcgcccaaggattgaaatgcaggcagggtgactccactacaagcttctcagtcattcctggcaataaaacgaacggaggacctcaaagagatgccatgagagtacaatgaaataatggatgtgaaaaggcctcggcgaacaagtgcaagggataaggcctgtctacgtgaatcactgttgtgaactggttacccagggcccctgtccaacggtttccgtcccaatcctgccccttctccgcccagcccacagcgatatctttgaatctctttctctatctcctctgatcctgcccccaaacactcggcggagcggcggagcggagaatagaaggtccgcgcgcgaacaggaggcggggcctgccgccttcagtcgtacagggggtggtttctgcacatgcgctgtggctgtgcggcttcagctgccccctctctgcggccaatcagggcccgcggcgcgctcgggacgtatcaacgctctgtgggtcgtgtgcgtgcgaggggggcgacgtaagggcgctccgcgagcccgtctctcctcgaatgaaaggaaacaacctccggcgacagagccccgctctcaggcactgctggagaaccgagaccgacttctttctctttaccctcattggcgcttctctcctgcagtccgcctctgggccctgccggtgagtccccacggaaccctggggccccccattctctccccggcgggagaagacaaggaggatggcggtggccaggccgccgcccctgcccgttgttaaaggggactcttggtggtctcgctttattgtcagggaccccagaagcgccgctcattgtaggcgcttggcggagaggctgctgagaaagtgctttggaggtgcagaaggagaggttaggcttacgcctagacttcgggggagggggcgcaacatttgaggagggaaaaaactgggaatttttagtttttgccattgcttagaacatatttgggaaagagggagactcccagtttgggaagagtaagaggaagaattgttaggatggcaagagagagagccttacggaatgaggaaaaactccggggtggggggaattaggggtgaaactgaggtataaggggaagcttacaacgaagactgtgagagggctaactcttgggggagggggcataaagaaagtggtaggatgatattttcctagattcgggaggattggaaaaggacgattaggggaccctgactttacgacggaaaggaacctgctgaagtgttttaggggaagatagttttgtgactttagcgcttgattagagggagatcttgggagtctagtgtgtattgggggaataaataacggagaggatccggtactttatgtgtaccgtctttcattatatggatgaacaccacggtattcttttccaatttccattcgttttgatattctgcgtggaagttaaaaaatcttttgtttttagaaaatcttttattttcatcgccttactacctaatgtcaggtcttatttatactgttcaaattctttctctacccttgggtttgaaacaactggaaaattcctttagtttccttttgaataaccgcaaaaagcagtgcgaagcatgtaataatatcgtgcaaccaaattcaggtgcccttccggtacatcttattcgtttatttctgtccactgtaactttcctgttagaaatactgcttctttggggaatcacgtttgttatctgttttgatttgtatatttcagcttgctttcgcgtggaatgttttaatcttccggaactgcagtttttgttgttttgtttgtttttctgtgaaaatgctttttcagataccaggcattgatgagctctggagttggttcttgaatgctctctctgatgtttcaggttatttctaccttggtgcttcgcagcatcttggaaaatcagaaatgcattgattgcttcagcttaactaatctagcttttattttttttccaggcatttaaattatgtatttcacgctgttattgttgcctctttatttctgctttgtagtattttccataatgcgatgtttcttttaaagaaaagccttcattgttgcgtgaaagcatcaaactttgatctccgcatggcctgaaaaaccttttagactaaaattaaaatgccatatagctgtggatcattatgaaccccttagtattggtccttggaatgcccttattctgcttaagtagagaccacaaatgtgacaacattagataaaaatctgtacttttatgataaagacatttttgctaggagtcattgtttccatgatgttctccacttcatgttttacaaggagactaaaaaaattaccaagatatgcgcagatgtattatttgaattttagtggaaaaatccatttagtcattgcacattggggaaagtttttaattggtttggtgcactttttttgtggctcttcttactttacaaattaaatttaagctgattacagaaaaaatacactagaatattttttaatgcaaaataaa

SEQ ID NO: 7589 - DNA, 1456 bp, artificial
  synthetic oligonucleotide
aggtctcaactgttacaaccagttaagggtttggggaagcactgggccaagagtcaggaaaatggaagccacaggtagtgcaaggtcttgggaatgggacgtctggtccaaggattcacgcgatgactggaacccgaagagccggggcccggtttacggccgccatgaagcaacgcgcgccggtaggtttgggaatcagggagccctctgaataggagactgagttgggagggaaaggggcttcgctgggggagcctcggcttcttctgggagaaaattcccacggctacctagtgagcctgcaaactggtaggcgccggcgtaggcgcgcgggcggggccgggggcggggcctgcggggcgtggcggggcgggcagagggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtggtgagcagctcggcctgccggccctggccggttcaggcccacgcggcaggtggcggccgggccctgaggcgcgggatccgcagtgcgggctcgggcggccgggcccagggaaccccgcaggcgggggcggccagtttcccgggttcggctttacgtcacgcgagggcggcagggaggacggaatggcggggtttggggtgggtccctcctcgggggagccctgggaaaagaggactgcgtgtgggaagagaaggtggaaatggcgttttggttgacatgtgccgcctgcgagcgtgctgcggggaggggccgagggcagattcgggaatgatggcgcggggtgggggcgtgggggctttctcgggagaggcccttccctggaagtttggggtgcgatggtgaggttctcggggcacctctggaggggcctcggcacggaaagcgaccacctgggagggcgtgtggggaccaggttttgcctttagttttgcacacactgtagttcatctttatggagatgctcatggcctcattgaagccccactacagctctggtagcggtaaccatgcgtatttgacacacgaaggaactagggaaaaggcattaggtcatttcaagccgaaattcacatgtgctagaatccagattccatgctgaccgatgccccaggatatagaaaatgagaatctggtccttaccttcaagaacattcttaaccgtaatcagcctctggtatcttagctccaccctcactggttttttcttgtttgttgaaccggccaagctgctggcctccctcctcaaccgttctgatcatgcttgctaaaatagtcaaaaccccggccagttaaatatgctttagcctgctttattatgattatt

SEQ ID NO: 7590 - DNA, 6158 bp, artificial
  synthetic oligonucleotide
gctgtatcccctcggagtcaatgaagggggatcgatctgggggtacctgcgggtgaataaagactggatgactgaaggaagccccgccccaccccctggcaaggaatagggcaaaacttatgactaggccacttcactccaagttaaggtacttcttataacttcaccatttgatttccaggagctgcaggtggagccgaaagtgtggctctcaattttttcccctgaggatgaatcttggaacaacgtagtgggtgaaaagcagagcgatgggggatacgaattagtgtggaagagaatctaattacttctgaaggtagacgaataaggttaagtagaggcaattggacatctggatcattcttgccagtttcaaagtcttggtgaaacttcttcctgctgcatattacaagtctcattcattgtccccattaaaaaaaaacaaaaaacgaaacaaaaaaacaacctttattggaaatggactcagatgactgaaagaaaataaccaaaacctcaccggtagcttcagctgattcttacactatcgttgcgacatatacatctatctttaaaagcattagatgtcctaactcactgctagtgtttttattcttaaacaccccagctgagttattttaaagagctccaaacaatgacagagaactttctgtagatgaaataccagtttacatattaaactggttactcaaacttatttataatttatacctatcaatgtcatctatcaaaacataaatcaaaaagtttaaatacttgatgtcaagtcgctccttcctgtttcaagcagctccacagaaactttcatgtcctgaaatggccggcactgcgcatactccttaatgattaactcattagataccactttttcctttttaaaatggacacatattagcaacaagtcacatgcatgccctctttttgtttgaatacaatattcaattaagcattaaaaaaaaaacccactctgaaatcctcaatcacaaacctaaaagttaaaacaacaaaatcagcactaactgtaatggttttgaaagttaaatacatttcagcacaagtaatagacatttaaattatccaactgtaagtatcttgttacacttacaaattaagtcggtttttcaaaaccagtacaatgaatgttaagtgtcctatttattagttaataaaatgtgcagagtatttaataagattaagtatcgaatttataacatccagactgagatccagtggtaacaaatacactatgtcatggtaaaaaaaaaaagtcattagtaacaataaccccattccctaaattgcgacaatcaagtatctctacattccatcttgttttggcaatgatatttacaaacaacttttacactgactttgggattaatggagaaaaatgtcgttgactgcccttaaaaagaaaaaaaaaacatgtttagcaaatgtacaattatcatgtaaaactccacaactttctcccaacattttgttccacacaaatatacgagccatcatgtcagaagttaaagtcatgcctaatttaacatttccttagttgactacttagaaaaacaaaagttcattcgaaacagcatcggtgtcaaaggcgaaggtcccttccagattgctcttggaatcaaattcatttatacctttcaccctaacccctttcatctctcccagtgatagtacaacgagttacacccctaaaaagccacctcgatcccctagtttacatatttccccttagactgaaatttacttacgaaaagagattacaaaggggcgtcttgtcacttcaggagagggtcattcactgatacaatagacaaagaatcgatactttcgagttgccatagccccacccccttctgaactgcaatgtgtttggctaaatgatttaagagccaaagaatacgcctcttcctctgttcatactctacaacgttttgtcttttaattttgcatatgccttcgtcccccacaccccaaacacacgatgtaccttctctcggcgcattctagccaaacttccacaatgtcaagtccctacggggaaaactaaacaacctttaaagttttaattcgggagagacaatgtgaaattaatcacacatttctttccaagacataactaacttcttgcaaataagaggaaaagttcatttacattctgtcaaaaccagtcgctcccgaccctagcgaggctgacagtcggtcactgccccttactcagttttctctccccgcccctccatgttagttgttgttttttttttcccagtccgtttcctgagaatttcccggccgcactcatttgttaaacactttaaatgtcagatttgcccccatcccgcccgcaaaacgtgctttacaacccccccaaacgccacagcacttttttcagaattatcaccagatgtttttctgcctgccgtaacccacgttacagtcgggaaagacgccagccaccaagtccctttttaaaaaatcgcatgtcacctctggctccactcgaaaatggcgccgaaatcgaagaacttcttaaatttcattgcaagctttttgcaaaggtttctgggatttgcctgcgaagctgtttcgccgcgtccgagagcgagcgaacgtgcaagccagcgagggagacagggaggaaggaagggctggggaggcggagagacagaccgagcgagcgacacacggacagcgacggacagcgacagaagcggggcccgggacttgggagacggcgaggttgcggggcgcgaggtgctgggcacggagctacagggacggagagccgagagccggggtcgcagcgtggagggggcgctggctgctgccgaagctcggagagcggcgtggcggaggcggagcggagccgagcgaggggccagcacggaacgctcccttggaggcgagcggcgcagccggcggagaggctcccggagccgccctagaaaaagccggctcggggggcgtggccacgcgctgtggcgctccccgccccccggtggccccgctcggctccggggcccgggggcggaaggggggaggggaggagaggagctgtagggaagggggttgtgcaggcgctcgacgccgcagccttggcccgctgcgggggagggccgagaagggcactgggcgcccagagtaaccaacaccgagacgaatagcgagggctcggggagaaaaaacggaggatggcaaacggcaaagccaagggcacgaggtagcgcagcgcgcacccagaggctcctgggacggacaccaccccacgctcacgggtcctctggcggtgtcctttgagctgccgggacggcgcaaggtggctgagcgaagctttttgctcggtgcttacagggagtacctgagatggtttgggaaaggaaacagggggtctcagaccgcttgggtgcagcgctctccccatgcgtttgagtgcagatctgtcgagacgccccagccctcgccaccccaccaagctctcaggtagagaggccccgggacagggtgagccccatagtcctttggtgggcataacacagagggaggagcaattgtttacacatgtgcccagtacaagaagggaaactgatatttaagactgaagtggggaaacgggagggaaaggagcccttatcctggatgttagacgctattaaggaccatgctattttgtatttgtgagaatgatattgaaggtaaggaggtccttatccttgaagatgcatgctgaagtgtacagaagtgaaatgtcacgatgtctgcagttttcaaatgatgcagctaacatacgcacacattatgagagagagaacagaaaggaagcaagtattgcaatatgttaacagttgttgcatcctgttgggggtggggggtaaacagacgttcgttgtaccgttctttcaacttgcctaaatatttgcaaaatgccataatgaaaattttggaagagttcccttataaaatagtgcctgaatgctaagaaaatgaacgcggcttcttttcctttccctgtcccgggtgggacaaatctgcgagcaagcagggctcaaggccagcggggtctggacgggaagagcaatgggtagagccggcctgcagctgccatagccctgggcaggccaggaggggccatcggagcctcggggcagataggctgccgggcgcaaaactatgcggaggagcagccgagcgcgttggccccgggggcggtgcggggtggggacttcctggcggctctcagcaacccctggtccgaccagactcggtgggctcggctgcaccacggatgagcaaagaaaccggcgggccgcgggaactgagccgcgcgcctgcagccgtcgccacggcggcccgcggccttcccccgcattccccgagggaggccgtagttgtcgcggcctgcagacagcgcgcagggtagcccagaaccgcgtgcgggcgctgggggaaaaaaaattaggtgccgaaagaaagcagcaacgcacgcgcgcgcacacacacacgaaatcagtttacaaaaataaaaccgcggaatctgccgtgctcggcgcccgagtttgagctacttaactctcgcatgcattttactgtcatatttctgtagagctgatggaaaatctgaaatgtttttgcaagggcgatctcgcagacccaaggcgttgcaagcgttgcgcagcctttcgctggcgtctgcggctcttttccggggcgcgaggagggaaaagagtagtgtctttcagggtctgcaaagctgttttgaaaagttaaccaaaaaggttttaaatagcaagattttcttttcaggaaaagtttttaaaacggctgatactcgtccagttttggtgggcgctaaaaagtcttattactaagctacaagtttccctgttaagattttcaaaacccctcgtggacagggctgaaagtttgccgggctgtgagacgtgactgaacacgcttctaaatcctcagatagatcatttataaagctctggtgcccttgggatgaaaggcttcgctgagtttttaagacttgccttcgtgggtaaatttgcttgggttgctacacgtaagcattcatttccccacctaaattagtaaaagggcagaagattccaacgacgtaagataaaagttgggtttatggcatgttctctaaagacaaattgcaacagctttctttattaaactccttttgctacctcagcaaattggagagccagttgaatattgatgaattctttgagggtgagtaatattgctacaggccggagaaagtaagggaggacaagcttaagcatttactcaagtgaacaaccttcaaatgtttttcaactatgatgtctcaaggattttcttaggacctttgaagcaaaccctgattctgcaaatggcttcttatttggtaggcccttcccaacctgacaaaactcacaggatataaattgccctaagaagtggtgagaaacttaccctagcattggaaacaggcacagcccaccacctggggtgttaggggggcctccaactggtagtcaggcaacttctcacggggcaactaggaacctgaaatgaaaattgcacaccatctattgttttttttggtcccttctgaaatattgtttcaaggcagctgttttcaggaaaatagcacatattttcctttctctttttgttccgtgaaacgttcggaaattatattgataaggaataatcatagtccgccgagggagcaatagctttgaaggctctgaaggcacagctgagaaaaataaattagctctagactagagatactcagcaaggaagttatgcataacatggtatttggcataaattttggaaaatgttttctggaaagcaactgtgaatgaatcttgggaaatagatactggagaatcaagttgcattaaaacttatttttttgtaaattacaaagaagatttctagaactttccatttttattttaactagaaatggtgtttaagattgtgtttttaatgaaggccttgagttagggaaacaagattttccttatgttgtaaatatccagaagtctttagagagataaaatcaggatagagttacaaatttaacagaaagaaaacaactggaattgtgttatgaagcttctatt

SEQ ID NO: 7591 - DNA, 1578 bp, artificial
  synthetic oligonucleotide
ctttttctctctctccttctttccttctttctttaacatcatcccacaacctgggcctaattgccctgaatgaaaacctcctccttaagtagttctggactaggccaaggaaacaactgtttttgttcaaaccccaaaattaacacccaagtttaaggctactcttttccagagagctaagccatccatttcctccccctccctcaagcatctttcctgtactccttctcctccttccccaaagataatccaaatataattataaaatgtctagaatttctgagaaatgagactgttgtccctcaagcaatcattttagactacctcacttcccacccccacacgttcacttcttgtattatgttgcactgagtcagtctcaaaggaaggggctcaataatgtcattgagtttaggggttcatttagtacaactctccaaatttgaacacggcagaatctctttcctctgactttcataaagccaagaacagctcaccatgtgataggagaaataaacgaagatgactaggcatgtgacagcacacccttcagctcagataaagcttaaagaagaggtcactgagacccaggtttaaggttgctcatctctaaggggagagaaaggagattagggggaaagcagaatgtactttctaatgagcttgcgaatgcccagctcattggcacactttgagacttactccttcttgctgagaacagatcctcaaagcagggcagcctcccttctcctgctacctgcaattcctagggaagggtagagtagtgtgtgtgtgtgtgtgtgtgtgtgtgtgtgtgtgtgtgtgtgtgtgtttgtgtgtgtgtgtgtgtgtgttgggggacggttattattattattgttattatttgagacggagtcttgctctgttgtccaggctggagtgcagtggcacgaccttggctcactgcaacctccgcctcctgggttcaagcgattcttctgcctcagcctcccaagtagctgggactacaggcaggcacccgccaccatgccctgctaatttttgtatttttagtagagatagggtttcaccatgttggccaggctgctctcgaactcctgacctcaggtgatccgcctgccttggcctcccaaagtgctcggattacaggattacaggcgtgagccaccacgtccggcaggggggatggttataagtcattcacaacacagtgtgaattcatcagctgacttttctaacaccttgctgagatgtgctggaagaatgggatcccgaacaagggagggagaaagtgggctctagttattgggggcagagggaaaagaaggctgaggggttagagatgggaaggagatgccagaagagagggctgtgtgggggtgcccagctgaaggtatttttagccatcatgcgggccatgcacagtatcccaggagctgtgggcagaattctatttaaagtctttagaactctttagagctgacgtggagttggggactggggaagaaataaatgcaaagaagggagcactcattttgggactactgtccagcttcttggggaggcctctgtgct

SEQ ID NO: 7592 - DNA, 3827 bp, artificial
  synthetic oligonucleotide
taagtggcttctccagcacctgctctgcttacctcatatggctgttttgaggataaaatgagaacagggatgggaaggccctttggacactattattgctgctgggtcaaagcaccgactggaacttttgagctgatgtgactgcaccaattgttcctcccttttccctacatagaacttctgggtttaatagtcaaacatggtttcagggctcctcaacagtttctagcagagtacaagtgttgaacaggccaaaccctatgttttgaataaagtgacaaaggtccgactgtttttgttcccatgcccatggatggaccactgagcatggccccgggcagcaaggtagctcccagacagagctatccatatcctcaggaaagagctttggatcttcttaagaacttgcttatcagcacaggtaccattggcattgctatttattaagcacttactatgtttccagcacattatatacatcatctcacttttttttttgagacaggttctcactctgttgcccaggatggagtgcagtggtgcgatcatggctcactgtagcctcaacctcccaggctcaagcaatcctcccaccttagcttcctcagttgctgggactacaggtgtgcaccaccatgcctggctaatcttttatttttatttttattttagtagagacgtgttttcgttatgttgcctaggctggtcttgaattcctgggctccagcgatctgcccacctcagcctcccaaagggctgtgattacaggcgtgagccaccatgcccagcctcatcatctcacttataatcctcacaacaaccctgttattattcccatctgccagatgaaaactgaggctcagagagattaagtgactttcccaaggtcacagagctctctgattctaaagctgaagtcatgcaacaaagatgtctgccttataggctgtactctggggttgacaactgaggacaaggaattagaaatgttatcaaataataccttattttagtctacaacaattgccattcaactcctattagcatggttaataccctgcaaatacgacagagaaaaagtcaaagcttggcactatgtcccatgggtacctatccttcagaggcagcagaaggaagagaaccagaccatgcaattgacagagacaaagccaccttcttaaaaaattgcagttgaagctgcatactttaggactcacaaacacaattatagttccaccatttttttcacccagtttttcttcacctttttgggtgttaacccttttgagaatttgaggaaagctgtagatcctctcagaaaagtatgtaaaagcaaaaacacaattctgcacatagtttcagaaaaattcacccagcttcccatagctagtccaagagcaacagaccccatgtttaaaactcctgcattaagaaaacctaattctggctggacgcggtggctcatgcctgtaatcccagcactttgggagggcgaggtgagcagatcacgaggtcaggagttcaagaccagcctggccaacatggtgaaaccccatctccactgaaaatacaaaaattagccaggcatggtggcatgcgcctgtaatcccagctacttgggaggctgaggcaggagaagcgtttgaacctgggaggcggaggttgcagtgagctgagattgcgccactgcacttgagcctgggtgacaaagcaagactccatctcaaaaaaaaaaaaaagaaaaaagaaaagaaaaagaaaacctaattctgtgttttagaaaatgataaactagagatcaatgatttctttaaataacaagccgatctagggcacaaaaataaggatttgctttatgaaaattttgttttcaatgtctaattgcctgcatgaggtacacttacaatgaacatatctctatttccctagtgccccatgcaattagaaatgatgatggcacagacgaccatcataactgtccagaacagaaagctggaaactataggtacagtaggcagtaagttttttgtttgtttgtttgttcatttgttttgtcactggagggtggacagtgactcatcagataggaatagctttactggatggggactagactatatgactttattaaacagcaccattcagtatcatgagtcaaaggttctaagacccatgtaaacctggagaagactcagaccacaagtctgttcctgctaaacagcttatggcttcatgaaaggccagacacctgatgggacaaactaagtagatactggctgacttacttgagtctacagtcaaccttcttatagtggcccatgttatttcaaatagcaactgttagttccttgccaactagaggtcccattgttcttttacaaaaatattagataatccaaacccaagtcattccaacaccatttccccctggcctcttgtattttgagttgacaagttcttaccataatcttcaatagcattgttagtcctagcctgatatttcttcttctaagcccacttccagtgtttaagccctcatataaaaggtgcttagttgtaagtcatagatcctatgtggtggtcctatagaactttcttctttaaaaacctttttcatctgaaagtaagaggttgtgtggtacgttagaaggagcactgcatgcggagcccctagttccatcatctattgcctctccacctctccgatactcaattccctctatcagacaggtgacagtccttaccctgcctatctcacaggagcctcgaaagattcaaataagatagtgagtatacagataatgtattaagcgtagtgttagaaaatgagaactcataaccattatttcatttaagcttcaaaccaactccatgaactacgcaaatccttaccattctgtcatatattaattcactttcttgacatattcattcatatattcattgctttctttttctctctcactctcacttattcagaaaacattattactaggcactatgtgtagctaaagtatttactgaatcagaaacaggcttagaaaagtaagataacacttcaaagcttacacttcttgggtcacccttcacacccaagggaactgggacactccctccttccttctcccctctcctcttgccagaccagtttgttttccattactccacattgcctgttccagaacatttcccccattagatgaagaaatttttacttgcttatgaaaaatagatccttggccaggcgcagtggctcatgcctgtaatcccagcactttgggaggctgagtctggcggatcacttaaggtctggagttcaagaccagcctggccaacatggtgaaatcccatctctactaaaactacaaaaattagccaggtgtggtggtgcgcaactgtgatcccagctacttgagaggctgaggcaggagaatcgcttgaacccgggaggtggaggttgccgcgagccgagatcgtgccactgcactccagcccgggcaacagagcaggctctgtctcaaaaaaaaaaaaaaaaaaaaaaaaaaaaagaaaagaaaatcctcggtcttgtttgagacctcggaggcagttagtcctgttttctccttgtgagcatgagggtgaggcaggcctcttggacttgaatcctcaatgactgaactgtttgagttgtatatggctttcagaatatggctgagtatgttcactctctctttttccctgctgcccttttctattttgcaagttgtaaataaaatctgtcacccccaaatgcaccaggtgtcttccactttctaattgagcaaggcagactcttttccagccaa

SEQ ID NO: 7593 - DNA, 1313 bp, artificial
  synthetic oligonucleotide
ggggtctcaatgagcacactttccctctcgtcagatagtttttcatatttttggtcattatcactgacttgtgaacccagggacactaaggctgggctagttggacagtagctctatagaaaagggaaagtcatctattccagagcagatacaagttgttctcacaaaagttgtcctagaccacaaagagtcttggacacaagagggaggatggccctgtggaatccaacctttcaactcctggatccatacttggacatttgagcccaatggacaaatagttaacatttgccgagcacttaatatgtgtgtgctacacgttgttctaagcactttacatgcccacgtgatcttatctaatccttgcaactgtactctgcagtagtgtgattattattcgtattttacagattaggaacctgaggcacagaaaggttaattaactcactggaggtaaacagctagtaagcactctaatccaggaatgctagctcagggatctctgctccacaccattatgcttctgagtggggccagctgcatgggaggactgaggctagtactgatgattctggctcctgtgagggacagcccgccccacatgccgcatgtgcctgcatctcttgtcaggtgttggttcctgccctggttcccgtggcattctgtgccccttctacatagaaagaagcttcctcgtgcagagctgcaaagtgttgactttacaacaccggaaatgggtcatgttttccttttaaaagggaaacacagggaaagaacattatataaaattagtttccccaaactaaagaaagagttggaaaatagccacattcctctctgctgataagtgcattagatttatcaagtgtcagagtttggggagaacttgtagcttgtctagtccaagtccttcgtgttacatattaggaaactgaggctgagaaagtggtattagatacatgcagatcgagggccaggagagctcttaaaaggttgggaaatggacagaaatgacacagactaatttataattgccctttaagccaaccctacaaaggaatctgaaggacggattcatccacactggagccactttttccagtgggcttccccaaccccttgcataacagggattccataagcatgagcttcaaatgcactgagataacacccagctaccacattcagatgatcaaggtccatggctaaacggtaatgttcctataaccttccttaacagcaaacctgctttcagaatagatcccacatcaacaatcacaaaggactttggaaaaagccacttctgttgaaaa

SEQ ID NO: 7594 - DNA, 4734 bp, artificial
  synthetic oligonucleotide
acctctagacatgaaaagtacagctgtgctcataaccaattgtccacaaagtgcaaatggaggctggttaatcctattggggtctgtaggacctaccacactgcctcatggggaacctactttggttccacagtccttttgcattgtttcctcaggtcagtgttaactaaggttcccaagtcctgtctattcttctttcaaaatacatcagacatcctcccttcttctctgtcaccatcgctactgctttgggtcagggccatatttcctcatctcccagggcaacatccttctaactgatctcctcttcctgccttctcttccagatggctcctccacagatctaaccttctatcaagtcccatcccgtcctgtcccatcccatcaacacacatttcctgagtgctgaccacgtgttaaaccctttgttaggcattagggatatatgcatcaaccagatgtaagctgttcccacaaggaaatcagtttgagggaagaagtacaaggaagcagtgaattacaggaaaatgtgtaaagtgctaggataaggcccagggggttgtgggagcccagagaataccaaaaccagtgttgaggggaggctgaagagaaggctcccctgatgtggttttcatctggccactcacctcttcaaaatgctccattttgcctccacaatctgtctccaaccttctttttcaatcaaacatcccattaactccctcaaaagaaatctctattccagaaagactagtcccctcaatgttattcaacatacatctactctcctagcccttcagctttgctcttgccccatgctcttgccctacaccatgcctggttcaccctattttgggggtgtatggctcctgttggtaggcatcatttcttccccgtcttgtctccccctagcactggcattgtacctggcacacagggtctgttgactgatggcctactaagcacattttcttttcactgtggtactaataggactccaacaagcatgatcaatggttttgctgctcttagggttatcaggaaaatctgtgaatgcagatgaaggagtttggaaaattgctgatacatttcggtcagactgtccccagctttgtcctgacctcctgcaaaggtcaggttgtgaataatcaagtagagattagcagtttcaagggttccagtaggcgtatagttggatatattttccattctgatttaaatattaagcttaatttgtttttggctttattattttttgttttgttttgttttggtcctgagcctgttggtcagggctaatttgtacagctgctttttcgtttgatttcttccaagaaagcaagaggaaataaggttgccagcaaatttgcagttaccaaggttttcctaagatgaatattatttttctcttctaatactgccaaatacagtataaaaagaagcatgtgattattccacaaatttagttgtaccaggggtcaaatcctgtactccatccacatcctgatgttggaagacctataatacagatcttctgatctactacttaggaaaattgtaccatatttccaaaattgtaaattcaccctgattttgtgcttggattctcagacttgactcctagattttagcaagaagggccaaaggggctgatttgggcaaggcaggggaaagggaagtagtggagaagccaggacaggagaaagagcactggagtgggagttaggagcatcaggttctggtccatgtcctgccactgactagctgtgtgacttgagcaagtcacttcctctttctgagcatctacacagagggattggagtaggcaagctctaaggttcttgtctgtcaattattattggactctgtggctctgggttggatgtttctataaagggggaaaaaaaccccaaaggcttatgggtattaacaaggcttcttcccactggtttgcacttatgaggcatttgcccaagttcatgcttgcccattttgaagcctgagaagagctctctggaagagagtgcccatgtccttgctaaaggagtgcaagcctaactgggtagctggtactgagtctgagttatgcctggaggccacacgtttaatggctttattgagatctaaattacattccatacaattcacccatttaaatggcacaattcagtggtttttagtatgttcgtggagttctgcaaccatcaccacaatcaattttagaacattttaatcacccccaaaagaaactctgtaccattaagctgtcactcttccatccctgaatccccaccctgctcagtcctagggaaccagtaatctaatttctatttgtatggatttgcctgttttgacatttcctagaaatggaataatatgatgcagtcttttgtgatggcatctttcacttagcattatgtttgcaaagttcatccgtgttgtggcatatatcagttctctactccttttcatggttaaataatattcccttatatggatatactacattttgtttatccattcatcagttgatagacgtttgagttgtttcctcttcttggctattatgaataataccgccatgaacattcatgtacaagctattgtgtagacatatgttttcacttctctcgggtatatgtgtaggagtggaactgctgagtcatatggtaactctatgttgaattgtttgagaatttccaaacagttttgcaaagtgtctgcaccattttacagtcctgccagcagtgtctgagagctccaattcctggaggtgacgttttgatcctgtccgattggtagaggatactttctagggttggtggcttggagaagccctttccctgggatagtctgaccatgcaatcttaagttgttaagggaacaacttttataagcaagtattttttacacttgcttataaaatatataattataaaacatattgctgccaaacaagctgggaggtcatgtgaattatctgcccaagcaaaagggagtgtggtgttttttaattagaataaggatgaaggatattcagaaccttggtctgtcagagaacttggaacacccaaatgctatatttcattcacatttctctctctttctctctctggagacagggtctcactctgttgcccagactggagtgtagtggtatgatcatgactcactgcagcctcagtctcctggggtcaagcaaacctcccacctcagccgcccgagtagttgggaccacagttgtgatccactacacctggctagctaatttaaaaaaatcatacagacagggtctcactatgttgcccaggctggtcttgaactcctggacccaagcaattcccctgcctcggcctcccaaagtgtagggattacaggcatgagccacctcacccagccaagtttctctccaaacttcaccttatccgtggaagcttttctgcaaaaacttccatcccctcactgcacctcacccctcctctgaaatgcacttccctgcactttgaatctcatcaggattttgtttccactgtgtgcaatcctggctcccacagccattctgaagctgtccttcagcagatttgaaagcccgttctttatcccagtgagatagaagctcatcaactgcaaaactctgtagtctttctagctctgggtgtgatcctgtacattacatatttgctgcctaaagctaaggtgctgcctaaagctaagtttattgtacaaactggaacacttttgtgggtgaagggcacaaatgtgccttcgataatgacactaggacagcaggtgtaacacaggactatcctgagcaaaccagtacctacgttccccctacctaaaacacaaagttcctttttaacttctattgttcctaccccaaatcccaggaagtactggttgacaccaaggctgagtaggcagatataccaaaaaaccctcaactccctctaccccagaaatgatacaatgcttacagaaagtagccttgaaaagggttaaaacttacatgagcccacgacaaacccttggcatcttaacacaagtcatttgacaaagcatcctgaaagtgtttctactgaattcctataggtctcaaaggccaatgatggcttcctccaagtcaccttttcccaggatccaattgccatataacaaaatgagctataaaggctacagagtttcacatcttgataaggttctatctcacaggataaagaatgggtctcaaatctgctgaagggcagcttcaaaatggctgtgggagccaagattgtatacagttgaagccaaatgctgatgagattcaaagcgcagggaagtgcatttcggaggagggatgggatgcagtgtggggatggaagtttatgcagaaaagcttccatggataaggtgaaacttaaagagaaacttgaatgaagtatagcatttgggtgttccaagttctctgacagaccaaggtccctaatatccttcatccttactctaattaaaagatatcacgctcccttgtgcttgggcagacaattcgcatgacctcccagctcatttggcaatgcttgggagaaacctggccttgcaatcagactaaatgatgtgttaccctacacttaatctccaccatccatcaaaatccaggggccttggcctcagcccctcgacaagaggcccacagtacctgggtaggatttcattcagcgaatgaatgcaaagcccctaattctccatccatct

SEQ ID NO: 7595 - DNA, 4573 bp, artificial
  synthetic oligonucleotide
ttggaccaggccagattttgttagcatgtgcaaatagagccaaacctgtcaacttacaattgtgcaaaatctgactcctgggaatcttccagaagtgagccggggaaaactaatatctgtcctacctacctcacagggtcatggtgagaatcaaatgagataatggatatgagcacattttgaagagtagcaatgaaaagcagcttgcttcttgagcctggagtggagcagtaggagctctttggtgatttcaaggccaggtgaagggtggaggctcttctgaaattcttggactcatcatttcccagtggttgtaagacttgctttccggcaattcttgggaaattttactttattgtgagacttctccaactacatgggagtttgtccttgacttcccttttccgttttctaattacccttactcagctagttcacagtactttgaaggattctacaagataagctaactttccctccttttggtgcattgaaaagacagtattttgctggtgacttacatttagatttcgaatctctctccaacatcaggagcaagtgatacgggaaaagcacactctgagattgatgacttccacgatggtctataaatgataattagccactgaatgttattggataaataaggagtgcctctctgcttcccctggagagaccaaattccctcagaattcaagtgttagaagacacaagagaacctagaaatctagaatggaaggctagaggtgagagttagagaagatatttttgtaagaaagaaagttttggttcaaaagattccaattctgaaagtgaaggactttggggaaagccaggggagagtgagctcagcttggacagggaagaggaaagagtgccgactgtgcagggaccttggccaaacggccctggatcaagactagaccgggcttgcagaggtagccagaggtattctgaccagggaattgagcaagatttattgcctaagctggcctcaactggacagagtttggctttgggtctgttttgtgtgttgggcatgcatacgtacctccttacagttgaagctttcagatagtgagccatgtcctcagcaaaatggggccaaagggaggttgctgctggtgtcagaagtggggacagaacctgagaagcaaagctatggaaagtaccccaggcctccgaaggtagccgtgtaggcaggaaatagcagccctcttgtcccccacagctcctgggccactggctatcctatctacatttgaacagtatgcacccagcagactgggcagctggccgagaagctcattattgtgccccatcccgtggccttctgggccaccaggttccatgcatcttattccactgctctgctctacttttgcttccataatactgactctcatgagctgctgtgttgaactgagggaatgttgtggtcttctatgtgtgggcatgcatgcatctgtgtgtgtgtgtgtgtgtgtgtgtgtgtgtgtgtgtgtgttggaggggtcccgagtgtcccccagcctcagcctctctgactccaggcttcagagggtgcctgtgcctatgaactttgcttggctagcctgctggatggagagagatgagagtaaacacctgctggttccatcccacactccccgttatgataggcagtgaagcaaatcatttgggcaattgcctgaccttaatgggatagaaagggctcctctcttgcttgaaaggaacatccaagcatgtgcttagtgtttagttttcctggaaaaataatttttctggcatgctaaagagggtgaatttgccttcagaaaggattgtgtcatatccataacctttgcagcctctctatcatttccatggatgaaaactttgcattcaggggaagacgaaccaaacatctgctagaataaggtttcagttttcactgcaggaaaactgtgttgtgtaaagaaaaatagagatacacccttgggcagttttttgggggtaacctagcaacccatcgaaatcaagagatttttgaaggatactgcaaagtagaatcaggtctgactgttcagtgttatgattttaagggcactgagtacagatagcaccccacccctcacccccagcaccctgcctggaatttcagcttttaaaaattcattccttttatttgaaagaccttatgtgtcttctggagtcatgtgttgaagagtaaaatacgcctgggaggaatatcacctaaaaccctatcagctgataacagctatctcttcagtgaagatggagagcctgggatgggacaaaatgatctctgggaatagcaggaataggatgcctgagtgacaagaggggacaagggaatgaaagggaaaatggaagacatggctaacttaagataccataaacggaaggaacctcatagaccatctataccaatgccttttaaaaaaacatttaaaaaacgtggaggctgggtgctcacacctgtaatctcagcacttggggaggccgaggtgggtggatcacttgaggtcaggagttcaagaccagcctggccaacatggcgaaaccccgtctctactaaaaatacaaaaatcagcctagcatggtggcacatgtctgtagtcccagctactcaggaggctgaggcatgagaatcgcttgaacccaggaggcagaggttgcagtgagccgagattgtgccatggcactccagcccgggtgacagagcgagactccatctaaaaaaaaaaggttaaaaaataaaaaacattggaaccctctcctcaaacacagaaccccattatgtacgaaatgaatacaagtggggctgctctggttaaagtgggggcaagagccttgggacccagtttactcagactctctactgcttaagctaagagaaaagtgaggcaggaccacactcacccagatagtgagaatcgatggttcaacatgaattttgtgggccagtttgttaaatatagccattgttaaaagtgaaatgatctaaacttacaattaggttatattaaagacaaagcaggccgggcgcagtggctcacgtctgtaatcccagaactttgggaggccaaggtaggtggatcatgaggtcaggagtttgagaccagcctggccaacatagtgaagccccatctctactaaaaatacaaaaaattagcagggcgtggtggcgggtgcctgtaatcccagctactcaggaggttgaggcaggagaatcacttgaacctgggtggaggttgcagtgagcagagatagcgccactgcactccagcccaggtgacagtgggagactccatctcaaaaaaaaaaaaaaaaaagacaaagctaatgaatactcaaaactcatcacttcctaattattttactacacttactgttacctatgcttttgaggttatttacatctattgtatctgtatggtggaaatacgctatgatgccttgctgttgcacatgtattccggactccttgttcagtgatgtcatgtcgggagcttgaaattggccatggtgggagcatttacaccatggaaatcagcaaacactataaaccagcattcccctccctgctcaactgagggaggccagcacgccactgactatactataatgtaagtcaccacttccttggaagctatacttccagcaacctcaaccatgtggaatgaagaggaaatacatccaaatggccaaccattatcacaaaacacatccactttatactccgtgggagagaaaagccactgtaaggccctagcctaggcaaacatgtgttaaataacatggcagataagaagtgctgggcctcagaaaatggtaacccaaacgatggcgctttggcatgctgagtactttgaactaaaggagactggaaggtctcagaagccacctcagaagcaaagtctctctctgaccttctcctaccctcctgtctcccgccccggggggaatcacagaaactagaacctctctcccccaaggcaacccatacaatctagaaaggtcacttcttccttgtagaccctcatgccagagagttcctgccctataccctggaggaaggaatgctacacagaaaagccaagaagaatctaaacagacaggccttactgggtaccctctgccttcagtctattaccattagatcataccctttatccaatcacatttctaaacattctttatagaatctaagcataaaaatactcaattttccctgggtctttgggtcttcatttctgaaatttcccatgtcatgtaaaactttgattaaataaatttgttaaatgcttttctcttgttaactgtcttttgttataggagtgtcggccatgacccttatgatgggttaggaaagagatcacatctttctgctcctacagaaacaacacggtgacagcagcacggagagacagctgacactgggaagtctcggcaccacaatctggagccttttattacaagggtaaacaacccgacttattcccgagaccctcaaagacctcactgcatcacagcccagcacagtttaggaagtggaagtgttcattct

SEQ ID NO: 7596 - DNA, 1994 bp, artificial
  synthetic oligonucleotide
tcagtctgtgtcactgcataacagcgcaggtggaagtgtccctgggctagcaggctcactgaaaattcaaagcacatgcactcagcacagtcatggtaataatagtggtaaggaattggaaactgtggtgatggcttcccgattccacaatcattacagtccaggtgtgcctgtggggccatatatgagaagagtcctggcccaggcccctcatacactctccccaggccctctcctcaggcctgatggctcatctctctcattcctgaaggttctaccagtggctcaggggccatgttggcaggcctgggtcttcttgacacccttccctctcctaaccacctgctcaccctccaggcttacaacaaaaaccagacacatcactacccacccttctccatttggtttttaaccttaagtgaaaagctgcttgtcttaaaaaaattagagatcctgtctttacctctgagacactttgatttagagaagacaggggacgtcagtgcttcacactgaaatgtgaacatttcaggcagtgtgacaagccaatgcagtcctctgccattgtgggtccctaaaatgacattgggccttgctctaccttgtcccaatgcagagggtgagttagatgcagagctgggttttctaggacacctgaagagaccaatatgaggtcagcatatggcttcatgggtctgtgggcacacaaggcccctcagagctcctgctcttgtctcaggattgttcttaaaacattgtgactgggagtcctagggccgcttctagtaggagttcaattccacagaccattaaaaaagtcatttcttagaaattcaagtccatatcaggaatgataaaaggatggctgtctcccaaggtctgcaagctgtgtaggatttagctgcaaataaataaaataaataaaggaatccagtccctttttgttaattgtgccagtgctttcatttttcaggcaatttcagttcagtccagatctggtttctggaatcacatttttccaatcatccttcccatttgcaaggaggagtcttatgtccaagtatgtgatttgaatttgcccaggtgctgccagttagggagggttttcatattcaaagctgcacatgctttggaaatgtgaccccaacgattgcaagaggaggcaatcatctctggaggggaggggttgggggaggaagcttgtatgggaattagtgggctccatccttggacttcagcatttctcaggcatcttgcctgctctgtctattctcaggcctttaactagcaccattagtggagcttccatctgtcagtgcagtcctgtcgctggagccctagacctggttctccaactgcgtatggcagcactgccctagctggaaagcttgttagacaaatacccaaatgattcttacgatcaggcaagttcaggaagcctaggcaatgttttttctacccagatgttccaccatctcccaaagcacaatatgattaaaaccatactcatcctaaaagcaattcatcctaaaaactgtactgaaagaatgagacataactgtactgaaagaatgagacagatctacacgtggttatatggaacagtcagggtgtgcctgtggggttcagatgagaagagtcctagcccaggcccctcatgcacttgctgacttcacctctccccaagcccaatggctcacctctctcattcctgaaggttctaccagtggctcagaggccatgttggcagacctaggccttcttaacacctccaagaaggctcctgaagtgaaacaaaaaagcaggctgctgccattacagtggaagctcgcttagctgacgtctgtggggccaactctcacaattaaaggatgctctccatttcctgtgtaaaatgcactgattgatacccacagtattctggatgcacttggtcaccactccctagtgggtccaagcacttccacttttactgatttttaattaactaacta

SEQ ID NO: 7597 - DNA, 1568 bp, artificial
  synthetic oligonucleotide
atatcttttatatcagtatactggaaatactatataatgttctgccactggacatctcttcccaactccacattctgtgacatcaagttgtgtagcctgaagttggccatggtaggactatttatgtcagggaaactagcaaatgctacaaagcagtgcttaatctattgttgtgttgattgtcttgaccaagagttgagaactttccccacagtctgtttttgtgtagcccacaagcaaaggatgatttttacatttttaaagggttgtaaaaaaaatgactatgtggctacaaagcctgaaatgcttagccaggcgcagtggctcatgcctgtaatctcagcactttgggaagctgaagcaggtggattgctcgagcccaggagttcgagactagcctgctcaacatgataaaacctcatctctacaaaataataaaaagtatccaggcatagtggtgcacgactgtagtcccaactacttgggaggctgaggcaggagaattgcttgaacttgggaggcagagtttgcaatgagccgagatcatgccactacactccagccttggtgacagagcgagatcctgtctcaaacaaacaaacaaaaagcctaaaatatttactatctggctctttaacaaaatatgtttgacgacccctgatctaggcttaagaaagatggaggaaatgttaatagtgcagctgaaacttaaaaattgtgttgtctcagtagctgttacattgtaaacagcacaaaaaatttgaggaaatatccttccagtatttaaagatgattatctgatttagtaaagaagtcatttatgtcactatgtgaatcagagaaattttgacatgcattttgttgttttgcttttgtcttattcataaatgtaaaccaatgtatcaaccaatacttatgtcagaaccatgcttgtttgttaattgccaccttaggttggatatggatacaagagttaggtaaaaatcaactaaggcatgagtatgaatgttaattagctgtatgaaatttacaagaatgaatattgtatattttattatttttggatcacgtgccacacatttaaaataaagatatgtgtgtgtgtgtgtgcgcgcacgcgcgtgcacgtgtgcacacgtgcagattgttaagcatttaccagaacacactggtaagaaggggcataggtctgagaggattctttgagtctttgaataggttcatggttccttttcttcaggggttctgagcaaagttcctaacctgaaaacaaacacacatctgagccatcttaaggcatttgagttacggctgcaagttctaaccctcttcatttgatcatggtgatgggggaggctgtctagtccttgaggccttcagctgcctgggaaagtcttcaggaaaagataacatttcactttggtgacaaatttgttgattttacagataacatccacattttgccatcaaggagcattcaacaaggacattggtttttatgtttttctctaaacagtcattagtacaaattaataaatctttttgttgagggaacattgggctatatt

SEQ ID NO: 7598 - DNA, 1193 bp, artificial
  synthetic oligonucleotide
aacatcctttgtggggaatgcaggggctgacggggtatctctgggtggtcccaataccctagctagctgtgtgctcagaagtccatgaagcctgagttctcttgtgtacttccttgtatactctctcttgctctctcttcccttctattttgacgttaagtagtgtctctggagcatcctgtggtagctgtactaaaatcaggcaatactcagttatcttcctctttgatggtaatgttggtgctactaatctaattagctgcttggaggtacatccccactctctgaagaaaaatacccttgatcaatatgaacctcaataagaactgatgattctgatgaaacagagcaaaggattctttcataagtcataaatgttaccccaaaagggggctccatttgaaaaaaaatccacaatatactattgaacaagttaggggctgattatttactatacataagttgctgcactaacaatgccctgtaataggcaaccggctggtgggtgagaagatttcagaatggatctggtgtttttcctccttattgaatgtacttctaggcacctccataaatcctgtcatttcagagactccttcagctatatactattagaggcaaactcaagacttactgagtactttgtcaaggctcaaactccttatgtaagtcacaaaaatatggattttccccctctgtgtctgcttaaactgtaatagccattttggagaatccagtaagtgctaacaggggaaaaggtgagaaagagagaaacatctcaggcttgtgaacttgctgaaattaaactgggtgagcctctgcaggctaaagtatttttaaaatgaaagaaaaagagaaaggaaagaaggaagacaggggaggagagaaggaagaagaggaaagagggagggaggagaaggaaaggaaagaatggaggaaaggagagagggagggaaggagggagggaggaatggaggaagggaagaaggaaggaaggagggagagaaggaaggaaggagggaaggggaagggaagggaaggagggagggaggaaggaaggaagagacagaagggagagagaggggagacagggaaaagggaaatttgagtgtatttgtgtgacaggatgtgaggaagaaaatggcccatcattctgtggccatttcttttcagcctagaaactctgtcatgtg

SEQ ID NO: 7599 - DNA, 2253 bp, artificial
  synthetic oligonucleotide
gaaagaactcggcctaagctctgctttcacaaaaagaacacaggacaggagtttgggaagagaaaactcattgagaaaacactcgttctttattctcttcaattcttagctgaggctctttggacaaatgtaacctttgggacctcagttgtcctaatcatagtatgtggtgaacaagaacagtgatccatgtgaggcaggggagctcaatcagtcgtcacttaatgcatcgaactctggagtctaggatcagtgggctttgttctgagcccatagacagcctcattgtctctgaactctgctaaaggctgagttggctcataattaagaagaaaaagtaagctattacacctgggcagagcctaaacctgtcgtcaggcctcttgctccttttctgtgctagtattctagaccaggtaagtccaagacagaagttggtgagattgctttgtccccccacaggcctccccaaacatctctaaccacgtgacctggatagaaataaagtggcctggccgggcgtggtggctcacgcctgtaatcccagcatttcgggaggccgaggcgggtggatcacctgaggtcgggagttcaagaccagcctgaccaacatggagaaatcccgtctctgctaaaaatacaaaattagccgggcctggtggtgcatgcctgtaatcccagctactcgggaggctaaggcaggagaatcgcttgaatccaggaggcagagtttgtggtgagccaagtttgtgccattgcactccagcccgggcaacaagagcgaaactccatctcaaaaaaaaaaaaaaagaaagtggccttttttccctcctgccatttatgtccccaaaggatggaggcagagttagaactcatggtgtgggcaaccaatacagaaaatctgagctcttgagatccattttgaagcagagatgaagagtctgaattcccagatggaccaggtcacaacaccattgctcaaccctctgctgttctgagcgaggctagagtagccctctttccgtctccccaaaaggtagaatacgggctcgcagaggcaggagcaagaggggaggctagaacaaaggagtctttctttagcagagtgaccttccataagtcacttaacccttccatgccccttgctgtcatgtgactcaagtcataatttattggttagaaacgttcagttgctcaatgaaaagtaatggaaaaagggtgaactcgtacagtcattctactaaggaaactttgtctattcaatgttaggttacagagtggcctttattttaattaaaaagcatctggaaattgaaaagcctgtttggcccggggcctcattggagagtaactgaggcatgtcatctggctgggccatcccctggttctctcagtgggggctggcgggaataggggagtggaggctgcctgccgaggcctggtgcactttttgtgaccggagcagataagctccgccgcacatactgctccctccgctgacattatgggggcttctcttacacctccatcctcaactaggccagcagcagcaggcttcgtcgcccgtggctttgctaactgtctcctgagggaagagggtctcccactttaagcttgtattgtcccagagatgataagagatcccaataccaggatgtgttcctgcattccctgacaaccagtgctgacagcaaaaacatttctagacaacttcttgtgacttaacttttatgtaggcagcatactccccggccctgccctttacagagcacagaatgactggacagaatggaatgctcatcagatggaaagacgcaaaacctatctcatttctgattgtggctttaatcaggtccattgtctagtctgggtctcagtgtccttattggagccaattttatgtatgggtcccaaacagcactgatcacagaacttcttgtgcagagtcagcacagagtagtggttaagaggacatactgactgggtttgaattctgactctactacttcctgcctgggtggccttgggcaaagttactaaatgtccctgtgccttcgtttccttggcagtaaaactgtaatactaaaattactattaaaaggataaaatgagttaatatatgtaaaatacttagaatagtagcagtaagtgctacataagtgtttgttacaaactgaacttgttcaaaatgtagatttgtgggcccgccccaggagattttgatgcagtaggcttggaaggggccctggaaat

SEQ ID NO: 7600 - DNA, 1902 bp, artificial
  synthetic oligonucleotide
ctaactctcatcaaaacaaactgaaatgcaagcaggtgagagtgatgctattattgtaaagataaccttgaatccactctaacttacaactaaagtaaattattcagcaactctggtacattaattattatcagtaacaaattacttgtgtcacactttccaaccaatcacaatacatcaactgtggttgacaatggctacctttgtcctatcagtgacctgctctctcatgcctctgcccatgcttgccccctgttccccaaaggtcccaaaccccatatggtaagtccgcaaaaaagtttgttgatggattgaataaatgaatgaatgaagagcttccgacctcagataagcctcacattgcatttgcaacactcatacattgggatgcagccatgcaccgatgaaaaataatattctgttatgaatagtaaagtccactgtgattatgggcaattttcttaaccagaaagcattgagtagtaagatgctttgcagctgtagatttttattaaagactgtttaaataaacataaaacatatttgccgggagagggtaaaaagacagatgcaaatttcagtcacaaaataggtacattcattattttttgcatttgctttaaaatgtgcccctaaaacagcaattacccttagaagtcatatttgaccagcgatagggaccagaaacagtgacttaatttgggcaggagttcgctgggacataatatggctactgtgcctggagtctttcttggtcataaaagcagtaaggaagtatgacataatggtgtgacggtaaatcacagcctaagccattttggttggcagaatttgaaagacaaataaacattacttcaggagcagagaagacgggcctaattacctccgtgcctaggctgggatccctgcggcttgtgtcgttcctggactcaggtgtgtctacacggccagggtccacgtgtacagggtccggatggtcccgtgaagaggtgggtctgctagggatgtagggactggcagccccacctccacaacctcctctccagggaaatcaggcagctggaaccgaatgagaagggcagccttgaggggccccttgtagcctggaaggagtgggattggaggaagagaagagtctggtcccacccactctgccttggaagtggtggggagttgaagagctgattgcacttgcaaatctctgcaatttttacctcaggccagtccaaattacctcctccttcccttttgtggtctcccagccaggctatagctgtggcccaagtgggctttggggctcacctagggatggagcctactctccttgcttgttgcattttcagagctgaaaaacctccaacttttgtattttttgttttacactgacagcccaggccattctcctttccctcctctcctgcttctctctctctctatccccccatccctctccctctctctctccccttcccctgtatggaaactggctgccttctcatagcggagtagaaaatagaatccctggctttcaccagggcactaacctttcatggcttttctcacacatatacccccaatccatccaaaattgcagtaaacacacgcaacataaaatttaacgtttaccattttaaccattttaagcgtacgattcagtggcattcagtacattcacaatgttgtgccaccagcgccaccctccatctccagaattttttcatcttctcggatagaaactctgtacccatcaaacattagctccccattcccctctttcccagcccctggcaacccccattctactgtctgtttctatgaatttaaccatcctagaaacttcatgtaagtggaatcttgcagtgtttgtctttgagtgactggcttatttcacttagcataatg

SEQ ID NO: 7601 - DNA, 2294 bp, artificial
  synthetic oligonucleotide
gagacttttccagctatagtttccaaacgggactgacactcagagccaggagtatgatttcaggagtggcagaaaggtgccttctctcaatctctctttattaatccacccacctgctggctgatgcctgaaattccactgttggggttcttgtcccctgaaacaaaggcccagaaaagagcatatgagccattatgatattctttccatagagaaaggtgttttctgtttctttttctttctttctatctttttttttgttttgtttttcgagacggagtttcgctcttgttccccaggctggtgtgcaatggcttgatcttggctcactgcaacctccacctcccaggttcaagtgattctcctgccttagcctcccaagtagctgggattacaggtgtgcaccaccacacccggctaactttgtatttttagtagagacggggtttcaccatgttggccaggctggtctcgaactcctgacctcaagtgatccacttgcctcagtctcccaaagtgctgggattacagatgtgagccatcacacctggccccagagagacagttttgttgtacacatgtggacagcacatgaagatgcactctgatccaggggtgaaagcacaagcacatgaggacctgaaggctccatatgagagaaaggtgtgagcttgcacactgcaacagacaaatgttaccatttttgagagggccagcctttgtcaagagaaagtcattgctctggaagctcttcttcacagccagcattgagtttctgagaaggaaagtgttttatgtgagagtttagagcaaggtttcccaatgggagtgggtgctgaaatccctagagttgtctatttaccacagaattcattcatactcaatagctatgaataattactcaagatgaattcttttttttaagagataggggtcttgctctgtcacccaggctggagcacagtgatgccatcatagcttacagcagcctcaaaatcctgggctcaagcgatcctcccgcctcagcctcccaagtagctaggactatagttgtgcgccactatgcccagctaattttttaaaaatttttttgtaaagatggggtctcattatgttgcccaggctggtctcaaattcctgggctcaggcaatcctcctgcctcggcctcccaaagtgctgggattataagcataagccacggtgcctgtcccaaactcctctgattgtcaatactgttattgcttcctgggaaataactcctgtctgactgtaaagtaagagaaagggggcgaggaaaggatggagccgcctcttggtatggaagttgcagctgaaggaaacggcaatgggggaagtgctgttgcctgggcctggctctgtccttgatggctgtgtgacctacagcaagtctttctggcccttcctctcatctccctcagcttcacttgccttctatatgttgatggtgcccatacctgtatcatcctcctaaagctctcctctgagtgacagagctattttcccacgtgaggctgagagctcctccagagaacacttatgaaaagaaacatcccttagttttacacatttatctataagaatatgaatattcctgcagcctgacttcacaacctatgctctgtgctacattgtttttaattccagcaccactactttagagctgtgcaaccgagatgaatatgcccgagcatcagtttgtatctctataaaatggggatataattgtacctacctgtcacatgaatgcttttcactgtgcctggcacatatttaatgctcaatataaaatgctcaacttttgaaggtgaataaatgagcaatggttggatttgattcccaaattcatgtttttgtcaatagattaggttcttgctccatttttgagacatttaaatcaaataatcaaataaaagtccattcaagcattagcaacagccttctcatctagactacaagctagactaccctaggggcctgctcatgaacttgcaaaagtacttggcctagctggaacttcatgaatgctatctagcaatatcgtaggcctactactgccggggtagagcagagagattggcaccatctgactggagactcagtgtggtctatttggtgggatttctggggcattgggaagctctgcccctgttttcccaatcacacccttctgattcctgaaattcctaaagtgtcttctgataagactcagtccaaaaatatctacactatgagttcttatcccagcactatggcctccatccttgggagcttt

SEQ ID NO: 7602 - DNA, 1883 bp, artificial
  synthetic oligonucleotide
tgcaaaagcaggatccagtttttgtttgtttggttggttttttttttttttttttttttgagacagagtctggctctgttgcccaggctggatggagtgaagtggtgtgatcctggctcactgctacctctgccacccaggttcaagcaattctcctgcctcagcctcccaagtagctgggattacaggcatgcgcaccatgcccagctagtttttgtacttttagtagagacggggtttcaccatgttgtccaggctggtcttgaaactcccgacctcaagtgatccgcccacctcggcctcccaaagtgttgggattacaggcgtgagccaccgtgcttggccaggatccagtttttatataaaaaaaatcgggccgggcgtggtggctcacgcctgtaatcccagcactttgagaggccgaggcgggcggatcacctgaggtcaggagttcgataccagcctcaacatggagaaaccctgtctctactaaaaaaaatacaaaattagccgggcgtggtggtgcatgcctgtaatcccagctactcgagaggctgaggtgggagaattgcttgaaccagggaggcggaagttgctgtgagccgagattgcgccattgcactccagtctgggcaaccagagcgaaactccgtctcaaaaaaaaaaaaaaaaaaaatcatatttaaaaatctcttaattataggcaaaaatatcagcatcattagtatataaggtgtccccaaagtcttagcacaattgtaagctttaataacctcaggagtacagttgctgcaaactgactaaaaacatcaactggaagtttaattaatgacttaactatctttgacacttagttttgtgaattttgagtaacagatttctttttcagattatttgaaccacacttggcttgttgacactctatgagtggctgtgaataaagcaaatgtctcttgtgtgacgcaacaacttttttttttttgagacagagtctcgctctgtcgcccaggctggagtgcagtggtgcgatctcagctcgctgcaagctctgcctcccgggttcacgccattcttcctgcctcagcctcccgagtagctgggactacaggcgcccgccaccatgccaggctaatttttttgtatttttagtagagacgaggtttcaccgtgttagccaagatgatctcgatctcctgacctcgtgatccacctgcctcagcctcccaaagtgctgggattacaggcgtgagccactgtgcccagccacaacagctttttacgtttaagaatcaaaagttggccaggcgcagtggctcatgcctataatcccaacactttgggaggccaaggtaggtggatcacctgaggtcaggaattcaagaccaacctggagaacatggcaaaactccatatctactaaaaatacaaaaattagccgggtatggtggcacgtgcttgtaatccaagctactcaggaggctgagacagaatagcttgaacccaggaggcggaggttgcagtgagtcgagattgcactgctgcactccagcctgggcgacagagcgagactctgtctcaaaaaaataaaataaaataaaaagtttccttcatcaccaatgttgacgttcccagggctctcctagacattcacgggtctacagggtaggggagtagtgacaaggaaatagaagcctcacaatagccactgctagagatggtttaggttgtgctgctcggaggaataaatgtctggacaatgagataagacccttcgtaaatactgcaccttctctttcctttcttacttatttgcatgaacctgttttacagcatcctgcactgtcagccaaagacaataaaaaaataagtcacctcaccctgta

SEQ ID NO: 7603 - DNA, 2974 bp, artificial
  synthetic oligonucleotide
gaattctaggctcctaatttgcataacgttcagtttaatataatgtatatttaaaataaaccatcttatataacagattgtgtttggcagaattgaagtcattttaacttattggatgatggggatttcaaggcttgttggtttagcttgctatagcaatactatgcatatgcttttattgtgtctaagtatcacttcattattattataagacataagtaagtatatacttacctttagtatagaactgctgaattttctaggagaatgacatgatgaattagaatgcttttggcaaaagcagtaaaatccaattagaagagacttaaacagcctgggcgaggtgactcaggcctgtaatcccagcactttgggaggccaaggtgggcggatcacctgaggtcgggagttcaagaccaacctggccaacatggtgaaaccatgtctctcctaaaaatacaaaaattagccgggcatggtggcatgcgcctgtaatcccagctactcaggaggctgagacaggaaaatcgcttgaacccgggaagtgaagtttgcagtgagccgagatcacgccactgcactccaacctgggtgacagagtaagactctgtctcaaaaacaaaaacaaaagcaaacaaacaaacaaaaaacagagagacttaaacaataaggagcaataaggagcattattatctcaaataataagaagccccaagaaaaggaggttctaggccgggttagttcagtgggccaatgacatcatcagagacccaggttccttctatctttccaccctaccatcttcagcagccacagttaattatgtaactagtaattagacccagggttcaaaatcaatggatagcaagctcttatatatatttaaagatgtcgagaaggatatctatcaacctatctttagtagatatctctggagcatgacattataggcagaattttatttttactttatgcatttctatactagttggatgtttttcacaaagcatgagcaatacaggtgttttcatttctagtagatattatattacaaaatagaaacattattcttgaaaaaatacaaatattattgaatgatatcataaactataagtttaatggttatgtcctatactggtctatccttaaaattggtgccacaggcatctaaagtagccaaattcatagacacagaaggtagaatggtggttgctaggggctgggaggaggagggaatggggagttgttgtttaaagggtacagttttgcaagggtacaattttaaagggtttcagttttgcacgatgaaaagagttttggagattggctgcacaacagtgggaatgtacctaacactgctgaactgtatacttcaaaatggttaagatggtaagtttcacgttagtgtattttaccacaattttaaaaattggtgctgcttttcatgtatttaaatatgggtaaaacaggctgggcacagtagctcacgcctgtaatcccagcactttcagaggccgaggcaggcggattacttgagttcaggagtttgagattagcctggtcaacatagtgaaaccccgtctctactaaaaatacgaaaaattagccaggtctggtggcacgcgcctgtaatcccagttacttgggaggctgaggcaggagaatctcttgaacccggggagtgaagcttgcagtgagctgagatcccgccactgcactccagcctgggcgacagagacagactccatatgaaaaaaatatatatatacacatatatatgtatatatatatattttatattatatgtgtgtgtgtgtgtatatatatatatatatgggtgtgtgtgtgtatacatacgtatataggtaaaaccgtgttttagaaacaaatcactgtgacagagggcattgaagagccatgggtttttgtgttgaatgaacacaaaaataaagatgcgtattttccaagcattgtaaaaaaaaaaaaaaaaaaaaaaactgttccctcacaattattttgtttaattaagtgcaaatattttcttcacttctctcaggaaattacttcacccacttctgttgaacagaagcccaaagacctcttctgaccttgagactatgccttctcccaaatcgcccctttgctttatctcctaagaactctgaagttgccatgcctgttcctttctctcccaccaggaattctggcacttctgctcaagccggatgtcactgcgtcacttctccatccccaccccctcctcttccaaaggaagcaggggaaatgtctcatcttcctaagagaaaaggttgtgcttttcttgagcaattcatctgttctaattttaggcctactgacatctgtctcattaggttttgcttttcctattggcaaccacaaaccccaaatctagtgtatggcccacaaagttgcaagcatgtaatacattcctgatcctgctttatgccctgcacatctagcccatgttcagttcatgttaagtagcattataaaccatcttaaatcatttctgaaactaggcagagacatttataaacacagtgtacaaccctttgtttaggattttctgagcattttatctctagttactatagtaggaaatggcttaaaaacagcaaacctaggaaaatgaaaaataatttttaaaaatcttaatgtctttacaatatgaattttctgtgatctctcttaaatggaactaagcttggtttttcctcctatcttaatcctttcactggagataattcttagtaattagcttcacccagcaccctccctaacctcccgctacttctactcccagccaccttcacaccatgacatcattccttggtgctgatactcttggttccttccaaggacttttctttcttcctggagtgtgagaaaaaggcacagtgggaaatttacacaaaagataccagtgatgtttattacatctcagtgaagtcat

SEQ ID NO: 7604 - DNA, 1540 bp, artificial
  synthetic oligonucleotide
agggtaataacaacagcttattagctgtcttttttttttaagaaaaaaattctctcattcccctctgagcagaaaaatagctcattaaacatagcaagtattcaaaaaatagtgaaatacttaacagctagccatattttgacaatagcgaattattgtggtgaagtagttgttgctaattgtcaaataaaatttatatgtagtaaattttcagttacccacataccaattttctattgttatttttacaaccttggctgtttcttctactttctagcaaatgatttgaaaaaaaacaaactgattttaatactttaagcaacatataattagtgaggtgatatattccttaagcagcaatatgatacattttaaaacccaacaaaaattcagactatctgcttcatagaaacatttatttatccaacacatactttattttatgtatgtatttatttatttatttatttggagatggtgtcttgctctgttccccaggctggagtgcagtggcacgatctcagctcactgtaagctctgcctcccaggttcaagtgattcttctgcctcagcctcctgagtagctggggttacaggcacccgccaccatgcctggctaatttttgtatttttaggagagacagggtttcactatgttggccaggctggtctcaaactcctgacctcaagtgatccacccgcctccgcctccccctcccgaagtgctgggattacaggcatgagccaccacacatggcccaacacatactttttgaacactcatcttccctccactcactaactcactcctcttactgcctttcatggccacactccatctattggtttctactgggaaccttagcaacctctttttcaaccttctggtcatttctccaatctacctccttctcttcactctccctttttcatttagaccctcaccatctgtgacctggcctgtgaccctgcgtctagtccctcttccatccaccatcaatgtgttctgcatgatgttgctagggttacctttttaaagcagatatgatcttgtttaaacagctttgaggtttaagaactcagaggaatctatgctctgggtttcctattgtgctcaaaggctaaagtccaaaaactacaatctggttttagcctaatttccctaaatttgtttcctgttgtaccctcgcaggtactaagtttcagccaccctgaacctttctgttccctgaacattcctctctgcctgagtgtttcctctcactccttgaaatgtcctccctcctcttctctatctaatgagttgctactcctctatgaagacttcctcaagacccacacagagttctctgtcctttgaactctgtcctttgaacccaaatcgtaactctgttctgccatttggctgtgacctagtttctgctaactagacttagactttgacttgctcaaggacaggaaaatgtcttatttatctttcgatcttcagagtctagctcagtgctctctctctctctctctctctctctctctctctctc

SEQ ID NO: 7605 - DNA, 2104 bp, artificial
  synthetic oligonucleotide
agtatttatactatggtccaattttgtaaaaaatacgtaaatgtatatatatatatatatatatatatatatatatatatatatatgcatataaaaagattgaaaagaaatacatgaatatgtcaatagttggatggtggcattgtgaataattttgattttctccttttcacttgtcagtatttcagattttactattaaatttgggggccaacatggaaggaggaagtaaagccaggagccacatgaattgctaaattttaaaagtccaggccaggcgcggtggctcacgcctgtaatcccagcactttgggaggccgaggcgggtggatcacctgaggtcaggagttcaagaccagcctgaccaacatggagaaaccctgtctctactaaaaatacataattagccgggcgtggtggtgcatgtctgtaatcccagctactcaggaggctgaggaaggagaatcgcttgaacccaggaggtggaggttgtggtgagctgagatcacgccactgcactccagcctgggcaacaagagcgaaactccatcacaaaaaaagagtctggtggtgatgtggaacaatgacacagatatgagggaagtgtttttaggctgagaggaaaaaactagtgaggaggaagagcttgcccaaagggaaagaggatggcttctggggccgagtgtaggagaaagcaagagaatatagtgccaaggacacaactggaaggggtaaccttgaggaggaagtacctccttctcatgaaggtggtgtgggtggatgaacaggcatgggtgaatgtgcagagaagtgggggaaagtgaggtgaagagggggacattgaaggagttcctgcttgataacctatgtcctgtcattgaaatccaaagccaggcccagtaccaaggggtctggcacaaggatggggtaggggatatgaggagagggagaggagttggaacaattgctgagagaaatttgatatataaaaggactgccttgcagcccttggggcccagctgaggctggctggcctggctttgtagtggagccaacttcatgaccttctccagcaacagctagccgcctgggagcaggcaatggagagaatgtatggtggggctttcacagggccagggattggcagagcaggtgctgccgaaggtcacggggagagtgagtccgggagatcaacgctagcagagctaaaatggccgatggtggggctgacttggaaagaggagaggaaggcaggaggatgctgatggtctctggaaaagaagagaggaggaaggataggctggtgggtgtggggcccaaaatgtggttgagggagaccaataggaggctaagttcggaggggcttttctaaatttgagatgtggaagtggtcccttgacccttggagtaagaggaaaggagcagcaaggaaactgtgcataatgaaagggtgtagacagcattcaaacagctcttaccttttggaggccactgggcaactgctatcataattacaaatgcacacccccttctatccagcaattccattctgaggaatttttcctacagatatacttacttgcttttgtgcaagatgaatgtataaggcaaatcactgcagtattgtctgtaatggcaacaggtcggaaactgcctaaaagtccatcagtagtaatttgattagttaaataaattatgcttcataaaatggaatgctaggtagctgttaaaaaggaggaagatctttatgtactgatatggaatgatctccagaatatattgttaaatggaagaagcaaggtgcagaacactgtgagtagtttataatctctttactagcatatgcataaaacatctctggaaggatccataaaaaaactgttgctgggtgcagtggctcatgcctgtaatccaagggcactgggaggctgaggcgggaggatctcttgagcccaggagttcaaggatatggtgacctatgatcataccactgcactccagcctgaacaacagagcaagaccctgtttttaaacaaaataataaaactgttactattcattgcccctgaggagagagagctgttggcaagtgagcaggggttgg

SEQ ID NO: 7606 - DNA, 738 bp, artificial
  synthetic oligonucleotide
catgggtgggagagttcttttaatcttttttctactgaaaccagaaacaagctaaaatgtcttgaaaggaggccgaatgaccacacatgctaagcagtccttggaatttttttatgaaaatgtgaagtcagtaagtagggctttggcatgtgagtggcactgtgcctctccctcctacatcaagtacacatgctttgtgagagctattctccaacttcagaggcttttttggattccctctgggttcctgaatatgttccagatagctataactgacagaagtctgaatgcctgataagcgtgatgtttctgtatttatttcctaatctcattataatcaatattcttatttaccaagcacaccaagtgtgcctttttttttttttaagagacagggtctccctatgttgccctggttggatttgaactcctggcctcaagcaatcctcctgcctcagcctctggagtagctgggactgcaggcgtgcccccacaattgaaacatagcttttaaaaataaaatgcaaaagctaaaatgtacaatcagagaaaatatctgatttttaccctgtggatcacacctttaaaatagactataagccatttaacagtttcaagttcgggttctcatacattcaaagagaaataaaacgaatgaatgatttggttttaccagctattgaggctcgtatgctctgattctgatagaggcctttccaacttctatcaaataggagc

SEQ ID NO: 7607 - DNA, 425 bp, artificial
  synthetic oligonucleotide
attttaatccaccttagctctgcttttgctttttcccccaatagccagaatctgtggctttttgtcacaggactacagaaccaacctccttttgtctccaagcatgaagagccagtatctgagaattaaagtcctccagagagtagactttagctaataattggtagatatatagttataagtattccagctctgttgttctgtttgagacaactgtgatttgtgacctgtattgtctccagtgtccccctattggattgtgccaaagtgatcctaaatggtaccttggttgatatcaaaatattgttcggccttcttcctctccctgttgcatggtcccactccctggtcactatatttttacttggaccacttcctaatatatcactttccgatgagtcctcaatcagagtcagcttatgggg

SEQ ID NO: 7608 - DNA, 1073 bp, artificial
  synthetic oligonucleotide
atgcaggcctgtaattataaatggtggaaatgactatgtaaaagcatagtacactttaatgggctctgcacctcctcactctggctctaatcttcaagtcactccatcttcttcagtgattcccaacatggttggcacacgggcaacaccaggggtactttgtaaaaataattatgcccagattgcattttaagccaactaaatcagagtctctggggatggggcctaggtctctgctgagaagctctgtgctgaatactacatagaatatccataaacctctgtagtaaaggttgagagagtgaaaggggttgaatgagaaaggaatgtggcagtaagtagactatcattttttccctgcttcctctgtcactttccaagctcactatttcatctgtacctttgttaaaaatgaatttctttctcattttcaggctctactatccaaatgatacccagcatttactggaaaactcaaatcccacaacccactccattcattctctcccaacaattttctggcatacagcattttctgtcacacagtttttcttcctgttgttctcagaacatcctaataacattaaaataccaaatatactatacaacttagaacttacttatgtacatgttctacatgattttctaatcattttcttttgggagtcctgccatttcagtaagaaaacaggctacttttgataaaaaacaaatatgttttctcatattttctagatttcctagcacacccaatagacttctgggcataaaaattatcactaaaggaaggtttcgaagaaactaatgacaagtgcaacatggaaacaaattacctcgtccacatatttacagctcatgggcttcactgagcatggcttgatgtttaaggtgcctggctgcatgtaatactcaacttctaaccagtcaccgttataaggcaagagacctaaaacaaccatggagaaatttgagtgtcattatctattaattgaggttatgttaaatttcacgttactttgacattgtaataccctaaaatagcttttagtagatccaaggtacatttcgcacat

SEQ ID NO: 7609 - DNA, 2929 bp, artificial
  synthetic oligonucleotide
gtattgagtaaaatgcacaatttagaacttaatcgattaatatgcttgttctacataattttctaattatttcctttgggaagtcctgccttttcagtaagaaaagtggctcctttgttggcaaagaatgtatttcttcatattttctggaattcccattacacccaacagaatcctgggcacgaaaattatcacgaaaggaagggttcacagaaaccgatgatgggagcaacaggaaagaaattaccgcttccgcatgaatacaacgagtgggcttcacagagcttgccttgaagtttaagaagcctggttcagtggaatattcaacttttaaccagttgcccttataaggcacaaaatctaaaacagccatggagaaatgtgagtgtcatgatctcttaactaggtcatcttgaattgcacacgttatttgatagtgtactactttaaagtcagttctgcaacacctaaagtcatttttgcacatatttaaacagacacactgtaaatcggtaagttcaagaagaagtttataatccttaggcattgactctcctctactgatttaacaaagtcaaatggagcaaagtgtgaactgtgcatcacagccaatctgagggaacagcacaggatttactaaacaactgttcgtgttcacaactccttagtgagaggcagtcaaacatgtaggtaagagcacaagtttgaacctggccatgtgcatttgaatcttgacactgccactcactcagtttgtaaccttagccaagatgtttaatctctctgtgcctcgttttcttcatttataaaatgagaagcacgataagtagccttcaagatactgagctgctgtgacacttaatagatatcgttgatacacacagaatcatcactggtgcatagtaaccaccaaataactgttgattggtagtagtggtagcagtaccactaggaaatgttgttactttcagaatgaatcaatttcccctagtgttgtgttccgctgatgaactctttttattattattattattattattattattattattatactttaagttctagggtacatgtgcacaacgtgcaggtttgttacatatgtgtacatgtgccatgttgatgtgctgcacccattaactcgtcatttacattgggtatatctcctaatgctttccctccccactccccccaccccacaacaggcccgggtgtgtgatgttccccttactgtgtccaagtgttctcattgttcaattcccacctatgagtgagaacatgcggtgtcttaagtctgtgccttaagggttaccgttaagaccatcgaggttgaaacagaagtttacgataagttaaaagtgactcacaggataacaaatgtacgtgaaagaatctggagcaaatggaaatcccaactgcaactgagaccgtaaattgccacagtgactccagaaaactagcaatatcaacaaagtgaaatatttattcaccttaggacccagcattgtagactgatacaagacacagtgttagacttctgtctctctgtctgtctctgttaatttgcatacatttcttttgtgtgcgtttactgtatatctatgggccaataactccaaaatgtatatgcctccagctctaaccaacctcagggtcaattatccatatgcttacaccaatctaatgtgtgcaaagctgagttgttggtattcttcatattcaccaacttttgtttgcctcagtcgtctgcatcacaaactggcaactccactctcaccactgctcaaaccaaaaactttggaggtaccttggactcatctttcctccacatcaaagatctaatccattacctcctgggttcttctctaacttcaaaatatatccagagtcaactcaatcctcaggtcctccacttctccactttcattcacatctccatcatctctcaccaggaatattacaacggtttcctgaccaatttcctgactccacccttccctcatagtctcttctcgacaaagcagatagagtcaacatctgaaaacaaaattcaggtcagggtcctgtttttgcatccaaggaaacaaactagcaagctgcctggggaagtggagctaatctcccctttcatacccaagctatatgactgttgcaatggacaaaaatagcaaaaaaaaaaagtgtatctttggttataagcgaaatattagaacatatcggctgattacaaacagaattccacaacacacacacacacacacacacacacacacacacacagccacaaagcactatctccaatcctaactttgaagatttgaagtgcattcttttaaaatttggtactgtgccctgtcacagaaacttctctagtaaccaactacagaaatgatccctgcaagtatagtctttgaagggtattaaaaatagtgtctctgtgtacttgtaggattgtttccatgattagaaactaaattcttatgtgaatgaaaaatatatccaggcattactgagggcattgaacaaatgaacgcacaatagacgacagcagacattttaaaatacttcctatttgcccctatattgtacataatttcaattggaaaggtctacctgtaatattgaagagccattggctgaagccaagtacactgtaaaatttgttctaggactaaaatccactcaaaaaattaagaattacatcatatatcacaaaatgtaagtcataccttcagaaacaatgtccatagggaaataaatgatgttactaatataaacagtatcttcacttatagaagtaacacatccatttaaaactctgatttttgagtctgagggtccatcatcgttaagagggtgaggcacaacatccacctgtaagatttaggaaagagttacttcaaaaataatacaaatttaaacacaggaa

SEQ ID NO: 7610 - DNA, 951 bp, artificial
  synthetic oligonucleotide
gttactgggggaattacgcagactcggtgaggacaagaatgagagatggacaatttgctgcctttgcaaaccatggctctacctaagttcactttggtcgaaggccattaggagatacttaaagctagatggactttcagagttttttggaagtattgttagtattccttcgccatttcttttgagatctacatatattcagaaacacatgacaattggaattaaactgggaatgggttaaatgcaaagagatctataagggttcatttattaataaattcacggtccttagcctgggaccatggaattctagagcagaactgtccaatagacctttttgcagtgaagtctattaagcatttgaaatttagctaatattactgagaaactaaatttttgactaaacttaaagtgtcacatggggctgttggctaccatattggacagcaagcgcaattctagaggctttgagattttataaacttttgaaactagatgcagaaaaggatgtgtatgtgtatttttctaggaagtgagtctgaagctttcatcagattctcaaaaccaagagaaaaataaagaactactttaggtctttggtaaaaaagaagttaacaggttctttggtaaaaaagaagttgaccgaggtaagtaagccctcttgtgaccactcctgtttctcctttctcatttttttctgtccttagctgtaggtggctccctcccaccccaacgatttcagagagaaacaagtcggaatctgagaagtgaggctccagataaactgtaaactgctggaagggggcgatggctgtggccctgggttgtgcaatccaggcatccttgaatcaaggctctgtgtttcaagaatatgatactgactgtgaagttttccgtcagcgcttcaggcagttccagtacagagaagcagctgggcctcatgaagcattt

SEQ ID NO: 7611 - DNA, 1502 bp, artificial
  synthetic oligonucleotide
agaagctgaggatcactaattcagataatgtataagtttcccagtgattctcaacctctttgaattttacttataattacatacacacacacactgctacttatataaatgttctcatgtaatcatggtaacagctcaaattcccaaagcaagggaagacttctcattgtcagttaaacctgttaaaacatgaaaatattcattgagcctagttccttgttataaaatacaagaaataagacattcaggcattttccctttatgaagatgttcagtcatcctttccttgaactacaattaggaaaagtatatgtctttattccattgaagttctcgagagtgatataaatactttggggggtatctactatgtgcctaactagtcctgttctaggcttagtggaagctagtaaagaaatataattcatggatcaggctcataaagattttataatatttttagttaaacaagagttgggaaacaggtggagaataatgcaagagagtttgtaattaagtgccaattataccaattgctagacccaggatgtatctttaattcttgtcatccaggtcaacatatgatgctgctataagtctggggctcaaattgatatcccagtagcaataaacatataatataggaggagtctgaatgtagagatgaaaaatacagaatgtaatggcttctcttttctctcttgtggaattgcattcaaaccagaacagtgccttagaatggatgtgcccaactgctctgtatttatgcaatatttgaataaagcggaaatgtatgtgctcttcctgcttcacttgcactaattaattatttgaacaacttagagcttcttccctgaacagtggcaacaagcatggcaattgactctgtcctcatcccaagttggaatcgcttttctctctgcaaccatggcactgtgattatgcatcatttttagcatttaatacagtccatttttggctagtagggttagttgcaatcataatatgagttgcatcctccctctcatttatatcaaatatacttgactagatttttacaagttagagaatgtctaatattctttgttacagtgccctatatataagaataaatatttctggtattgaatcaagaaacacatgaaatagttcttggaaacagataacatatttagaacattgcatggataattatacttctatgtctaattgtacttctgagcatttcaaaaagataagggcaaaatacagtacctacctcctagctattataaaggggaaattacagtacctacctcaaaagtactatgaagattaaatgaaatatattttgctctggccctacacactgtaagctttcaataaatatccccgtattatattctcatttttgtagtttaatgataaaagcatttaaagctatagatttcttctctttatggctttggacatacttcatagcttttatatgtaatgttcttattgatgatttcaaaatggtt

SEQ ID NO: 7612 - DNA, 1218 bp, artificial
  synthetic oligonucleotide
ttcatttaccatatacttcttgaacatctcctctgcaccaggctctgttataggggcctaaggtgaaaccagaaagatctggcctaagaagggaccagaatagtaaaagacatggtcctagtcattaaaggtcttgaggatagtcactggaaaaagctgactagagaaggtggcttaggatatgggaaatgtaaagagcagtggactcttaaccagagaattggaggtgagggaggaggatgcacaggactctgagaatctggtgtgtctcaagactataactagttaagactggaccacagaaaggctttgaaacttgtaagctagattttgtacatttcttctgggatgcagagctcttaggtagaattgaagagaaataggacaaagcttgttgtctatatgcttgtttggttataattaccttttaagtgagctaaagggaggggagaataaaaggctagggagacccataagttgtagttgaaattgcctagttttgttgcttgctgcttgagagcttttggccttatggttgggattggggtgggggtagggagatggtgaagggcagggcacaggtaaggaaagggcagatattttttcttttcagtttgcctttgctttgggaagataattataatttagaacacagggttctcagtttcacagagtgaaaaaatatgatagtggttccacatctcaggaagaaatgtgttttctagagaagggtaggattgaaggaccctccttatgggagtgagaagggcagtgaagaaaggaaactacatgtttcatttaagttcttaaatgaaaaagtctttgtaaacatggcctcctcccggttgccttttaccgaaagagtgtaaatgagagacccaggcagtccctttgtaactgtgtattgggagcttggaacacattatctcctggatacaatgttggaagtggtgattatgttcccagaccttcctcccaggaacctttttaacccttcatgtcacttagccatagacctattgtgtttataattgtttctaatgggaaatgggtttaagtttccagcttgatttgttaaaaacatattctttctctcttcttcctcacaactgggtgtggactttggttccatgaggggtggggacactgtaaaggctccggcagagagggtgaggggctgaggtggcagtggaggtaggcggggctcttcacatatgc

SEQ ID NO: 7613 - DNA, 640 bp, artificial
  synthetic oligonucleotide
atcacttcctatattctgtttctccactcctctctctgataattctttctctatcttccaaagtctttcccttggggagtgtatcctgcttcattcgtggttccaaatattccgacacacactgatgcttcaccatcttcagcttctcactcaggcatctcagctgagtgcaggacatctccacacatctccactgactgtctgtcctgctgtcagctcacagtcagacctcttctgtcattattcagctttgttttttctttttgccttccatcttctctggcttatctgccatccctttgaaatttctcttacatgtgttcctttgactcaatttctgttgccatcactttaatctaggtcctcatgtttttatgctttgaccactgtaccagccttctaactggactcccaagtgcctccaaaattcctgtctccacttacatcaattgctaactttcgaaaaaagttggttttatcatatcaccctccccaccagcctgccattctgagctctctagtatctgttccacgtgtcggtaaaaacttatttcccatcatttcccacagaagccctgcactgtctcttctaccctctgagtgtatctccccattcctgatgccagcccttagaacatca

SEQ ID NO: 7614 - DNA, 2200 bp, artificial
  synthetic oligonucleotide
acttttagcatatcactttattgtaactacttcttgatccacttgttttcctttagactttgaactggctcagggcatcactgtatctctagcacctaaacacagcgcaatttcaaacagcgacccaaaactgaatttcataacgcagtgtagcacaaatcttttgcccaacgtcacacagatgtagcggtaatgcaagtttttaacaaccagtcctttagactcccagtccagtgctctttctcctgtaccacagtgcctccctgaggcaatcggtcacttaactactcagtctctgcctggacagcccaagagtgcccaagatgttgtccacttggttgtcgtgggaccatgagcaaccagagtcctcaatctcacaactgtgcctgatctgccccatgctggatctgacatcacttgtcctggattcctggagactcctattctgaaccctctcccagacacctccttccaaccttcctgcaatttcaggtgccacactctctccaaattcaaactccgaaccttccactgggaactcctgcactgattttcttagtcaccccaaactgtaaggtctcaaaggaccattaatctgacactcggtccgatggtcccttagaagtgcgcccacacaccgcccctagggttccacaccgaagcggtccccgtgccccaggcacttacgctgcgcagcggaaaaggcggcgtgggctagggcaaagagaccgatgcccaccagccccttccacagcgacggcgccatgatgccgaaggagcagcagcccagcaaaagaagcgaaggacggcggagctgtttcttcttccaccggcgggtgtccgcgcgccgcagaaagatgacgtcactgaagtcctgagcgcaaagtgtctcagtggtggaaaagccagagggctgtgagaaaacggaaacaggaatgccgggaagaagcagaaagctacacggaaaaaggtccgcgagaacccacgaacctgcgctatggaggcctctctaggagggccggagcccaacggagtcataaacgaagaggcgaaagcgggagctacggggaagcgaagaggaagggcgccggcaaatgggggcagggccagtggcgagaacagggtggggcagagggacgggggcctgcgtagagaacgtgtgggggcgaggggcggggtaggcagacgggcggggtggggaagacgcgcggggcccgcacgagggtgggtgtagccgaggggcggggccagtgggtgggtgggtgggcgtagccggggggggggggccctggtgggtgcggtcgagtggcggggcctgcggggaggatgggtggggccgaggggcggggaggaggtggggccgaggggcggggaggaggtggggccgaggggcggggaggaggtggggccgagggcggggcctacgggaggatgggtggggcgtagggggcggggcggaggggacggagagtgggtgagggccgagggggcggggaggaggtgggaccgaggggcggggaggaggtgggaccgagggggcgcggaggagtgggaccgagggggcggggaggaggtggggccgaggggcgggaggaggtggggccgaggggcggggctgggggcgttggggaaaggcggtaggtgctggatatagacccctgacagttgtgttttgtgggttggttggttttggctttttgtgaaactgtgccttttgttttctgtaggcctttcctgtgcttcagctccctggaaactggcactgcagaaggaggcaagggtgttaaaacgaggaggcagtgtcaggacaaaatcccaggatctggaaccccaaatacttggctcgcgggaagtgctcagtaaaccattttaaggtcctggagaaagattcgcgcaaaaagaggtgtagcgcggggggagtgttttgtcgtgaaaagaaccagcttacattaaggaagaaatgaaagaggaaattttaaaatgctaataacgcagccttcttgccttgtctctatctctgatccgggtaaaatgtatactcctctgcccatttttctttgtcttcatctcctgaaatgtagacatttaatagtgagcttctccccttgacctcatcactctgctgtcccctggggagctcacccattcattcccaccgcttcagccagcaaaggtattacagtgattccaaatcgacatc

SEQ ID NO: 7615 - DNA, 1907 bp, artificial
  synthetic oligonucleotide
ctttcccgtgagccctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccgaaaaaaaaaacccgaacgtgaaataggctacagaaggcttagggcatttttaatgacatcccatttattgtactatgcctctaatatctgatatggatacctgtggttgacccttccaattcaggcatacaaaagtgaggacgaggaagagttaaggtccttccagaagtatagtgtactatacgatgatcaggacagttcagacaaacagtaattacaaacaccatgcatatgcagtatgggtgacttgctgttggcatgaggttattgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgtt

SEQ ID NO: 7616 - DNA, 158 bp, artificial
  synthetic oligonucleotide
tttgtattgccttaagcttaaggcatctggagtccgaggtttaaccaatgtgattcatcaataaatattgattagatgtctatgatgtatgggatatgatgagaaatacatgtttgagccacagtatctgccctcaaagcacttatcatctaatgact

SEQ ID NO: 7617 - DNA, 1163 bp, artificial
  synthetic oligonucleotide
gttctttttggagggaaggaaaatgttctagaattagatagtggtgattgatgttcaactttgtgaatacactaaagaccactgaattgtacagtttttaaaaggataaacttttggtgtttgaattagatatcagtaaagccattactaaacaattatagtcgatcaatatagttttatagggctgggcatggtggctcaggtctgtaatcccagcagtttgggaggccgaggtggatggattacaaggtcaggagttcgaccttggtcaggagcctggccaacatggtgaaaccccatctctactaaaaatacaaaaattagccaggtgtgttggtgtgagcctataatcccagctacttgggaggctgaggcaggataattgattggacccgggaggcggaggttgcagtgagccgagatcatgccactgcactccagcctgggcaacagagcaaaatttcgtctcagaaaaaaaaaaaatttagttttacagtacctagaacattgtgcatatttgaatgtcagtaggatgatccagcaatctgtttgatgtcatagtgccagattcaggacttctattccatgttttgattttgaagcagatttttaaaattaaaatctgatcttttagaagtagaagaactcaatcaacctacaaatattattgacttttcaatttgttaaatgtgcattgtttggccagtcatgtgctttgggaataaacttgcgaagtgcattgtttaagtcttataaattgatgaatggaggtgaaaaacaaatttctttttttttttttttgagacagggtttcactttgttgcccaggctggagtgaagtggcatgatctcggctcactgcaacctctgcctcctgggttaaagcaattctcacacctcagcctcctgagtagctgggattacaggcgcccgccaccacgcccggctgattttttgtatcttagtagagttggggtttcaccaagtttcccaggctggtctcgaacttctgagctctcaggcaatccacccatctcggcctcccaaagtgctaagattacaggcatgagccaccgcgcctggccagaaaacacatttctaacacgattgcactgtcgagttgggacacattggagcatattctgtctacagatgatttgaag

SEQ ID NO: 7618 - DNA, 2257 bp, artificial
  synthetic oligonucleotide
aatcaataaacatttgagcacctattgtgtgtcaggtactgtgctagactctggggatacagagatgaattgagacatggcctttaccctcaaggaactcacagtctttttggggagactgacaggtaaataactatactctactgtgctaagtatcataataaaggactgtagaaagtgctgcagatgcacagaggagaaaatgattctgcttgaaggggtcgtagaatggttactttggaacttgaaaatcgcttaaaaaatgagggaaagcacattgcagctggagagaacagcatgagcaaaggcatgggaggcacaggagaggatggatttggggagatgagcaggcaggtatagctagaatggggcatgtagaagagaatgatgggaaatgaggatggaaaagtaggttggagtggggtggggatgctagtttgtagagagtcttgaatgccccacaaaagacttcagacttgaccctctgggttgtaagccactctcagagtcctttgtcaagggagtaacacagcgagctctatgctggcgacagctgactctcggggagagcctggcagctggaaaagcttccacgacagagcccgtgagcctcaggatgagggctgcccttgagcagttgggatggaaaggagagaagacttgagagaccgtttagaggaggaatgaacagagtttgtgagtgcccgtgtttagggaatagagaggagccagagaactttgtagtgaagcttttccctgggatacagaaagcaggaattttaaacagataaaacaagagttgtgaagaagcaaggctaatgtctatccattagcctatgaaaaacctgtaattgggccctctcttcagtcatcgtaacagaatgttgccatgagagctgcgaagtgaattgcactgtgccatccttgtttttggagctagccagtaattcttatttagcaactggggcagtgctgctctccctgattccgcttcgagtggacctatattcagagaaaaaaaatgctgtttttttctgaaactggtaagtaagattgcaggaagagaatcatgggtacaccctgcttgccttagaatccaagctgttgctaaggaaagtggcaggagccaaaaatctgcatcaacagctatagagaagcaagaaaacattaaccattccatagcttctgtgttgagaaaagtagttgcctgacaatgtatatgtgtgaatagaccattttttggcttcaaaatctcatttgctctttgtctttctcctttagggttggtgttgattcagaccaagaacacttggtaaatatgcgtttttgttgttcctggcatttctgtcaaatgtgcagtcatttggaaagaaaacaatctactataaacttcaaccttctatttagatcctgtcctctttgcctcagctttggaggaatgatatcattcctggcttttctcactgctccatagagacaaaaccaagtttgccacagtgccatagtgtgtggttatcaagggtgacagctttcatgtctctgggccatcctgcctgggcttttgtcccagaggagagcagtcttttaagcactcctgggttttcgagtgactcctctggcacggggaggctttttccactttggtttgcgcatgaaggcttgtctctgatgtaagccccactccagctgctcttcctgtgtaactttcaaatcgaatgaccagcagctgccctagagaactgcctagaagcttttgaatcttcaaccagtcttccctgcctgctcagggaaacgcactttcttaccttgcccctcagccttggccacgtttccttgcttccttccttctgttgtgtcagtttctcagttgttgctatgaacttgagcccgttggactgaatgcattgtaactcactgccctctctagactgactacccttgtctggtattttccatctgtttttcaattgcttctgagcaccattgaatatgtgtctccatatcagacgttagatgagaaatcacagaaattagatttttgaacatggaaagcatctctttcaaaacacaatttttttcttgtcagaaacaaaccacagtcagtatatttgtcttcagggtgaggttaaaaaaaacatttctcagattcatttcctaaatgctaattttgttagctgttgagtgatgagtgtgaatgtatgtatgagatatagtaagtacttgactcttgtggtcagagccttaaagtagaattcca

SEQ ID NO: 7619 - DNA, 1804 bp, artificial
  synthetic oligonucleotide
gtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaacttaacttatgggttggcaaatttttggtgcttatgtgtaagggtggatgtatttgcttatggtcacaattggactctttaggaaatatgactcaaagctgtcaaattctattacattgatttgtagcctgttagcttagtaatggataatgttataaaaatgctggtatggggaaagagaattctatatccagttaggtgggaaggcagttccaagtatatccagttaggtaggaaggcagttccaagtttggctaaaagcatgatcacacaaatacaaatagtcctccttccaagttaaagacacgtctctctgtgcatgagaagttttataggctagagtctgctgactgcaagtttgtctagtccagcaatggcaccaaccacactgtctgttgtgttttcttgtcatccactccagcttccttgtttatggcccagtgagagacattggtgggggatggtccacacacaacaggctcttttcttgaaggaacccatgttttctaattccctacacaaaaccctacattagatctgagcaggtacagttgttaacctgacccaatgcaggagtataatgagatgagagtccccgacaggacgtacgccacacagatgatgtagtgtgaggcttgaaaataaattggaaatgataataatagttctcatttttgagcccttcttgggtactggtcatgtgtatacaaggcattttaaaatctataatcatgcattgagggcacattctatcatcctcagtatacagatgaaactgaggtgcagagaagtcacacagcgagtaagtggcagagtcaggacccaagtcaagtctgactccaaagcccagatgcttactattttgctggccccaaaggcaggctctgctgattcatcctgattgtaaccagaaggatgaagggaattgcagaattgctttctagcctgctgcccccgacctgcttgtcatcaggccaggctaaggcatgaagtctcagctctgtgcctccacttgctgctgtgttcttggctgtcttgttggcgttccctggttgggagggtcctcgcattcatagcaaagggccctccagtgtcttgttgggcccatgggcgagcagcctgcctagcagcatttcttcatgctctacctcccaacattatcaccaaggggcccggattttatagcagagtttgcagtcctgaacaatggctttgcatccccacagttaagcatagtagaaaaagcccaggctctgga

SEQ ID NO: 7620 - DNA, 2690 bp, artificial
  synthetic oligonucleotide
tgagagaaagatgatggacaaagagatgtcttttttttttttttttttaagaaatgtagtgctggtcctgatacgtagaggtctttcctaaaattgcttgtgttaaaccccaattacattccttcctcggcaggaatttatttcttcacccagaaactgtaggactgatgtgctgacctaaaaaacatacattaaacgcagaacctcccctttacctacaaaggcagtccaggacaaagctggctattctatgtaacaatggagcccacagctctgctctcattacactgagctctgttctttctgacccattggtagggatgtcagtagtgcgattccaaactctgtttcataggaaaccaatgacttgattatacaaattcttccttcattccttctgtctgatctagaaagtcagaggtacatcaggcatgctgcctgcactcaaggagctcacagtctagtggtgaagatagccttgtcattagatacatggttttagagctcagcatttattagatatgtggttttagagctcagcatttctagtttgtaaatgtaatagatcaaaatggccatttttttcttgtagagaacttcatgccatcttttcattatgccctttagcaggatcaatagcttattattagatatttttggtatttctctgatttctccactgattttatgtgaacaagcagcatctgtgcatgtagtttctgtaccacgcatttggagtcacttctaaggatgaacagaagaacttacaaggtaaattaaaagcaaaagtaactggcacactgcttctatctgtgctgagccagttgccacttcctctccataaccctggtatattatagaactttttcttgttgttaggctaaggaagaaacgaaagggtagcttcaggccagtggctcacgcccgtaatcccagcactttgggaggccgaggtaggttgatcacctgaggtcaggagttcgagaccagcctggccaccatggcaaaaccccatctctactaaaaatacaaaaattagccaggcttactacagaggctgaggggggagaatcgcttgagcctaggaggtggaggttggttgcagtgagccgagattgtgccattgcactccagcctgggcaacaagagcgaaactctgtctcaaaaaaaaaaaaaaaaaaaagatagcttcagataccactctaattatacagcatctagagtctgtacttatagacaatgatccaattctatatcaaataaagcacaaaccaggtcttaaatattttaatgacatgactgaattcaaataacagtgtctagttgggtagttcaggacagaaatttccagcttgtgggcattgtagtttcttactgtaagatagtctttatatcgtgtcccttgtagtaaatgaaaacttcaatctttataaagaaaatgatgtcatcggcttgcccttttctctagtccccatcagattgaatttaaatatgataccggcaagaacaacagagtaaatgatcagtttgtgatgcatctggtccaagggggattattttgacagtctgttctaaccatacaaacaatgtttccaataaaaagttttattaggtgttgtcacagatataaatgtttcataaagatagcactccagttgtaaatcatacttgaaatcattctaaagtcacctcattagataccaagaaaaactatgtctttcacataaattctggcctcgagtgactttaaaaaaaaggagcaaagaataaaaaaacaaaactcaagccccagccatctaaggctgaactttaagagaactgacaggaataagaaaatttcctttgtctgtttttgtaatctttttaagatcatacacttcaaacatttcattatcttcctgggtccatcagattctccagaaatgatggaagtggaaaaataatctaaactcactttttagaaaaactctggctcattggccaagcgcggtggctcacatctgtaatcccagtactttgggaggcaaaggctggcaggtcacctgatgtcaggagtttggaaccagcctggcaaacatggagagacccagtttctactaaaaatacaaaaattagccgggcctggtggcgcatgcctgtaatcccagctattcgggaggctgaggtaggagaatcgcttgaacctgggaggtggaggttgcagtgagctgacatcacaccaccacactccagcctgggcgacagagtgagactctgtctcaaaacaaacaaacaaaacctctggcttattgaagtatgatttatatgccataaaatttatcctttagcatatagctctgtgagctttgaaaaacatagacggccgggtgtggtggctcacgcctgtaatcccagcactttgggaggccgaggcgggtggatcccctgaggccaggagttcgagaccagcctggccaaaatggtgaaatcctgtctctactaaaaatacaaaaaattagcctggcgtggtggcaggagcctgtaatcccaacaattcaggaggctgaggcaggagaatggcttgaacccaggaggcggaggctggagtgagctgaagtgagctgagattgcaacattgcactccagcctgggcaacaagagtgaaactccatctcaaaaaaaaaaaaaaaaaaaaagaaaaaagaaaaaca

SEQ ID NO: 7621 - DNA, 949 bp, artificial
  synthetic oligonucleotide
agaaagaagaaggtaaggagagggagaaagggagaattacaacaacagaattaaggccattgtcattttcccctttgatctgaatcgtcagctatttcccgcatgtaataataatagcggttgtctcttgttgaagcacctaatctgggccaggcacagggttaagccctttataagcatggcctcatcgaatccacagaacaactctctgagctgagtgccattgctatccctttcttgccgataaggaaggaactggggctcagagtggttcagcgaaggtccaagatcacacagctacttagcacagtgcctggcctacagtgaacaccctgtcaatggtagctgtcatggcgattattactatgattaatcataagaaatggctggtgccaccatcggctcaaagcagactgaagtctcaaggcccaaagcaggctctgaggtgcagactcccgggggcctgctcaacaggcatgaggacctcgacttccctttgtgcttcttcaagacttgggatggtggctccttgggtggtggggaaaatgatgccatacttgtgtctggctccttcttggttcccacaaatgtccttaacattttccattttctgagtggcttttgtgaaactgctctgatgtggttgacagaacttatagtgggatccaagtcaagccttcctccagaggaaagttggaagcctttaagggtcttgtcagtgctcacgtagcccacagcctcctgcctagcattggccaaggccaaggcttcccggcagtcagctctggatcacagcacactcattgattcctgcgctgtttccgggggtgggaaatcaatcccctatcggcctggcttgggcttgctgggccttttctccagggagagtttcgctggggcctctgatctgcacgtgatgctcttcatggttcaagggctgtcgtgtcca

SEQ ID NO: 7622 - DNA, 831 bp, artificial
  synthetic oligonucleotide
gcttttcagctttttagcttttttggtcatttcttacttcttttcctccccgcctttgcatccagagccactgtctcccacacgaagcgtcttaaatttttatgagctcacagttgcttcactgatttctgtgctgccagagtctgagatgcaggactcagcggggacttgctcagatctgtttgtgtatatacttcccactaaactcgatgtgcttgcatgagtgagaataatcaagtgcattactcagaagcaaggaagagtagggctggagccacaagagcaaatccctccccagttctcctggatttgcaccaccccacctcactacccagttctggatcaatcagaggtagcttgggttgagaggctcttttgttctgagttttttttttttccttcagagaccagaatttaagcttgagctgctttctcgcctggggagaggagtgggacccagtcctgatattatggggcccagtctttgtgtcttggtgcccaaaagaaagctgagacccttagaccactcatggtgcagagagaggagctggtcacaccatatatgtgtgtactacacatttcttcatgaacatatatgccttttgcacacatggtgacttggtcccactggacctttccaaggacaggaatgatgtcttctattgtttgtgcaacatcacacatagactagtgtcttggaccagaggacacatagtctgcttaattgtctacaacaatatgtaaatagcaagcaagtgggactttgaggcgtttgtttttttattttgagcttaatttctattctggtagtacttaataatcaagtaattt

SEQ ID NO: 7623 - DNA, 972 bp, artificial
  synthetic oligonucleotide
ccatgaggaagacccttccacctgtggcctcttcgttccttgacttcctctctttcagtgatcttgtccaccctgacccacctcagccactcacttccatgatcataccctagacctgaccattaccaatttttctaccaaaactttcaatgtctcattgcaaggctagataggagactaccatcttctccctgtccagctcgctcccactagtgactctaactatctttgcctgcatgagacgtccaatccatagatcttcctttgttttcactgtcccccacccacttgatgtcctctctccccaacttactgagctttccttcgatgcttagtcactgtaatcactctcttgcatacattccagctcctcaccctcctcacatctgcatactcacttgacaaaatcccgaacctgtttcgattcaactctctgcctgctctgcacctgcaactgacatgtggctgagggaaaatacaaaaccacgatggctgatgactggtctcactttaaattaatgactgctagccacaagtgagtccttagagctgcgtgcctggcaaccaaactagttccctagatattccttctccaagtctcctaaaagactgttacatctattcctctctcttcaaagtgccaacactccctctcccatcctcattctatgcagatgatctcatttcctattttattgagagaatagaagcaatcggaagattaaaaggacttctcaaagctcctacaaccaaatatgttacaatggaagaggtgtctcccatctaggggcaactcttccacttgtctactagattcccacccctctcacctactcaagattatggctataacatttctcctgtcttctaaatcattaatttttcctgctctaccagatcattttcatcagtgaacaaacgtatctcttgacccacttccctctctaagaactgccccattttttctctttc

SEQ ID NO: 7624 - DNA, 696 bp, artificial
  synthetic oligonucleotide
aagtaatgtaaaaactctttccctatcccatttatttcaggttaaaatccaattactgagtacctactatgtttccagcactgtgctaggttcttagataatccaagcaggcacctttggccttcctgtccctttccagcccttggtctgtgctggctggagtctgaagaaatcataaacatgttctgccccaagataattggttccaggatggtcagatccttgcttggctctgtaggatacttcacgaggagcttgaaaatgctggataaacaaaggggatgaatttacaaatattttggacttcatgttatcctgttaatatacttctggaaagtagcaaagtcttttgcaataataccttaatatttcacattctgcttgtgagctattatctatatattaatattcctgttgggccatatgtcattaaccaacaaccagcgaagttctgagaaactgatctttgaaccaatgtgatggaatgttctacctactttttaaaggctcaaaataaatttttcatatgtttatccaaaaagttaaaaaagcaaacatcttatttcttcatttttagtattggagtgtattacttacacttaatctgtgtttagcaatctgaaatagggccttaagagtgtttgaattcctggacctctttcacatttctggacttcaattgagtgagatgaaaac

SEQ ID NO: 7625 - DNA, 2802 bp, artificial
  synthetic oligonucleotide
aagaatattgaatctccatagtggtgcctccacagggactcttaccatcccctcctgcttatttccactatagctctaatcacaacctgaaagctgctttctttgagttcttggttatggcctggctctccctattagactgtgagctacatgagggcacgaaccgggtctccctggctcacttctatatccccagtacccagcccagaccctgacactggatcgatgacagagcctcagcttttacatttagggcaagcaccatggtcacctcttcctgagtgaaatcacttgcttttaactgtttgatctagaattacggtggcactggctgctggttccaaaggaagaagaatgaaggagaaatgatctttctattcctgttatgcatgtaaatcatggaggatttcagcacaacttttgaatggtattgtaggaatgcagaagtgcacaagcaaatgtttaggcgactggaaaactttctgtgttacttagcagctgcaatattgagaaacattttttatgccttgtgtgcactgtgaaaaggcaaatggcctctcatttttgagcattctccaaactcttagtttaaaaaacttttttcatattttaaaagtatcaatgaaaccaaaccatataacacaggctacattgactagcttagaaattccagtggttatcaggaaataacagggttaactgctacaagttggaggaaagtagtagagtccacaattttgaaggagtattgtcagaggtggagcagctgctgagagttgtggcagagtggatctggctggggatattgagaaatcaacgtgggccagagaggagggagatatgggaaccaaatcgagtctccaccttgcatcctatttctcctaatatgattcatgccttcctcccctgcatctggcttcttgccttggtagcttgtctttatgcagttaacagataggtttttattttatggatatgatatcgtgccatactaatgtaataagacctaagcttaaatgtctagggagtgtaaccactacacatggatgaattcattttgtctattatcagcctagcaattgctgagctgatggggtttattgtaaaaatcttgacttgcttatgtcctttaccagcagaacatctgcttgcaagttcaaacttcagagttccaagaggattcaggaagtgggtttgcagcctaaatatacattcagttgttttcagttagagggtaaccaacatctctttcttattttctttctttctttttttattttgagatgaggtctcactctgtcattcaggctggagtgcaggggcaccatcatggctcactgcaagctccacctcccgagcttgagcaatccgcccacgtagctgggtctacaggcattacacaggtgcatgccaccatcacctgctaatttttgtatttttttgttgagagggggtctcaccatgttgcgcaggctggtctcaaactcataggctcaaacgttccccccacctcgtcctcccaaagtgctggaattacaggtgtgaaccactgcacccggcctctctttcttattttctaatatttcaatgcagaagccccttaacactacttatagacagttgtacaacttgacatgttacttctcaggcacttagcctcttgaagtatccgtttatctaattccacctaagcctgtggtgattttgtacaaaactgtgctaaaacaccttgcatgaaaaatactcagatcatggtttttcaattatgaattggattggggcctgtttgctaaagataacgagaatggaatcttgggaacactaaacacttaggtccaaataaaacaagccctccctactatcccctccaaccacatacttgagaatctgcacatcagcattacagattttatctgtgctcctcaggaaactatcaccacgcttcccaagagatgaggcgggtccccctccctattctgtcttgtttggggaaagtggagacaagagtggcatggctattattttgttgccatataaggaagcattctttttattaataagcatcactttaggaataaaaaaaaatgcaatttagccttgtagaaacatgtcaagatttattcattcattcactcaacaaatatttgtccaacttctataggtatgaggcactgtgctagatgctggggatatagcagtgaacaaaatagacaaggtctctaagagattacattctaatgagactcttaacagaaaagggtccttgtggatcgttcagacccttattatctcgtcaggactgtaacactatccttctagttatttttctactctctcctggtcaaccttggcaacacattcagttagatttttttaataattgcataatttaaaatatgtattaatataatacatttatataatacaaaacaaataattcagaatcgaaagtcatataataaaaaaccacaggccgggcatgatggctcatgcttgtaatcccagcactttgggaggccaagatgggcggatcacctgaggtcaggagttcgagaccaacctggacaccatggtgaaaccccatctctactaaaaatacaaaattagccaggcatggtggcaggcgcctgtaatcccagctacttgggaggctgaggcaggagaatcgcttgaacccgggaggcagaggttgcagtgagctgagatcgagccattgcaccccagcctgggtgacaagagtgaaactccgtttcaaaaaaaaaaaaaaaaagaaaaacaacagtccccctacccaccctttac

SEQ ID NO: 7626 - DNA, 4273 bp, artificial
  synthetic oligonucleotide
ggtgctctgtccagagccttccatcatgggtgcctcttggctgtttcttttgggctgggctgtttctttgggctggtatggggtggggagttgtctgtggccaagctaattgttcaatgcctttccatgatggagtgggggcagattggcttcctcttctcctaggcagtgtagcgggacttctcttgccatctagaaggaccaaacttcagtgcttctgagggcttagaaggggaaaagagaaagcccaggcccctggtgctaggagcagagaagggtactttgtaagcgcttatgctgctggttctctggtaagggagaccactagccagtttgtgcgacatggggcaaataggaatcatgaggatctatttgctagatctgtgtataccacaccatccctacacccgcccctgtcatcatcatctacctccatggtcttctgtacagtgaagaatgactttcggcagatggagggccaattctccccatgaatccagcccttattccatctcacctaggcaggggacttgactcctttagtaaaccctcctgtcatgcctcaccaacccctctctactgattatccctaaactgttgaccaacaggctctcatctctcaaatcacaaagagagaagagaatctttgcttgtccctactcgctcctccagttctgctccatttttcttcccatttacattggaaagtctcaaaacagttgtctaccctatgctgtctctacttcaactccaattccctctgcaaccctgttccatcaaatccttccactttcctccactagcaccaccctaatctaaaccaccatcagctttgataggaactattgagaaagcctcctaactaatctccctatttaaatttttaatctcttctgaaccattctccatatagtagtcaaggtggtcttttaaaaatgtaaaccagatctggaatactactcagcaataaaaaagagcaagctatggaaacacccaacaacttggatgaatctcaagggactcaaaaccgagtgagaaaagccaatctcaaaatgaatattgtatgattcatttacaaaacattctcaaaatatcaaacttacagaaatggaggacggatcagtggttgccaatggtgaaagacttggggaactgaggagatagttattgctgttttataattacaatacaacaggtaagatccttgcaatgatgaaactgttttataattgaccatggtagtggaaagaggccacacgtgataaaattgtatagaacacacacataccagacgtgcacgcgcgtacacacacacacagtagaagtaaaactgaagaaatcaaaataagattggtagattgtattaatgtcaatattctagttatcttatagtgtagtcttgcattgggggaaattgggcaagggggaccccagatctctctgtattatttcttacaaatgcatgtgaatctacaatcatcccaaaagacaaaagtttagttaaaagaaatataagtcagaccgtgtcacgccttggggttaagccactcattcaatgccctcccattgattttggaatgaagtggcctgcccatggactgcacctgcccatggactagtatgcaatccacgatctggtccctgccaacctgtccagccttactttctggtactctccccagctttcctggcgccaatcatgatcaccaccttttagttccaaagcatcaagatttggtccctccttctgacttgttttctggaaagctttttcctggctctttcatatctttcagggttcagcttaaatgtcacctcctcctttcctaatcacactatttgtacttttcctgcacaggctttatccaaatttgattattttctcacttctttattgtctgtctcccccactagattacaagctcccagggcagggtgcgtactgtctgcagacaacgctgttatcaccagagcccggcactgagcttggcacatggcgagggctcagtaaactgaatgctgagtgaatgagacgccacgcgccgctttgccatcggtgctttctgagtgacgttaaaacgctctggatggtggcactgggattatggatggggcttatttagctccctccggcttgctactaaggggaggggtcgtcggtgggcctttcggcgccgctgcaagccaccgggttccgaagtcggaggccgaaacggcgtgggccccgaagcggggccgcttttcagggagtgcgcaggttagcgaggaccccggtgaggcgagacgccaccctcacttggctgtctttgttgctcccacctccccagccccagccgcctgcagtgattcgtgactcccgcaggcctctaaggaccgctgcgcgagggagggggcccgaggcgcccccggcccgccctcctcccggtcttcggatccgagccggtcctcgggaaagagcctgccaccgcgtccccgcagccaccctctccgcgtgcccggccctctccagtggcgggggcacgtgggcgcgcggggtgcgtggcaagccgcccctctccccacgcccgtccggccgtctcccgcgcgcgcgccccgcacacagcctccgtgcagtgggcagagcccggccccgcgcgcgccccgccccgcccctggctagccgcgcccgcccccgcgctcctgcttcctcccctctttccctccccgcctcccaggcgcgcacccctcccctcgcgcccctcccgcgccctacatccaccgcccggcggagggggctcagtccgcagccgccgccgccaccgccgcgcctcggcctcggtgcaggcagcggccgccgccgccgagacagctgcgcgggcgagcatccccacgcagtaagcccgctttctttccgcttgtgcgcgcgtgtgtgcctcccgcccgccggcgtcctgggtcccgggggagcggctgcccttctgccccgccgccgccgccgctcggggctggtccctgcggtcccggctgcctggccttccagggctgggtactgcggcttcggcggcctcgctgaggccgggggccaggggccgtcccgggctgcggggtgcgggacgagggactgcgagtgcgaggtcccccctggtgcgtgcctcggccttccctgggtttttggctcgatggggactaagaggcagtggggtggaggtgggggggatcgggagtgaaatgggggctctccatgttttcctgtgcgggggatggtggggagtgaggagggagtgaagggggggccctggttttgtcaccaaggatggcgggcagtggggggtggggcgaggtggggacacctcttggttctttcagccaggatagctagcaggggctgtggggagcgggtgaggatgaagcggtgggtcgactcccttggttttcccatcaaggatggcggggatcgtggaggggggagatgggagacctgccttgcttcgctcaacgaggatggcgggggtggcgacgaggagtagacgtgagggggcccgcctcggttttcttgactgggatgcttgtggggtggttggaggatgggggtggggtgcagaataaggagggagggggagggcccgctgtggttcttctgtccaagggggatggcgcgggtttggcgaatgggggtggggagggggtatttcagctccagcgtggaatctagagaagcacgaggaaggttctatcacgggggttgagccttagaaggtgggttttcaaaactgcagggcgtgacctctcccgcctcgaaaaacgtgaaatccttacaaggtgccgtctgttctaggctctgggacagaggtttctgctttcgaagtttctcttcctttcctctctgctcttagcgtccaggactaggtaaaggttaaaaaatcatcaaggctaagcgactgttgtgtcgttcgtgttgagcgctgtattattttctgcatttgggaatgtgcgagtttctcaggtttgttttgattgccttttacaataaaaaccccatactagggagatcccttaggaaaagaaaaggacaaggcttattaatgggatgccaggtttggattttgaatttcctgaagggcaggagatacatccttgtagcatttcgcttggttttgagaagagtagaagtagtagaataagcgtatgtatttgctggaagtccccttgtattcatttaaattatcccttcgggattatccgagccccctttgatttgggtttggaatagatccagttttcctaattggagcca

SEQ ID NO: 7627 - DNA, 1806 bp, artificial
  synthetic oligonucleotide
ggctctccgtggatccatatccttctatcacattcatctgccactgcatcttgcccttgtccccgtttgccagtgttaacaattaccccaccctgggctgggccagggctgtttttcagcttaggccgggcagggaagctgatctccagggcagatgtggagtgagaagagttgttgtcactctatacagaaatgtcattgacagaataggattaaacaaaatatgtacagagattacataggctatgtatacatgtaaacttgtgaacacaaaatcattccttctttacagctagggtcccagcaaatgctacagctacatgaaataatgagtatggatacctattgccgagggcttactatttgaacaagtgagagaattgtactcttgcctaggggtgtatttttaagtagtttttgctcctgttccttattattgcctgctaatggatacgtatattgtcagtaagtgaccaactctcctagcttcctgtagtacactgtatttctcttctgaaaatggattttcctctgtatttaaaccacagatttacttgtgcctcatttttgaactactatagataaaaactcacagataggaaatacctgtggactgtttgaaatgcagtgaaacctagaaaaaaaaaaacaatcaaaataataagtatctcctgtcggcattttactgcttgtagaattgatattctatttgcccacataaaatctctctggatgttattcctattgcaagacatagtagcttttcttcctgttccttattattgcctgctaatggatatgtacattgtcagtaagtgaccggctctccacagcttcctatagtacactatttctcttctgaaaatggattcctctgtatttaaactactgagatttatttgtgcctcatttttgaactactatagataaaaaaggcacagataggaaatacctgtggactgtttttgaaatgcattgaaacctagaaaaagaaaataacaatcaaaataataaatatctcttgtaagcattttactgtttctttttacccacataaaaactgtctggatgttattcctgttgcaagacattaaatgttctatagccttttttttttttttttgagacggagtttcgctcttgttgcccaggctggagtgcaatggtacaatcatggctcactacaacctctgcctccgggttcaagcgattctcctgcctcagcctcccaagtagctgggactacaggcacccaccaccatgcccagctaatttttgtatttttggtagtgacggggtttcactgtgttggtcaggctgatctcgaactcctgacatcaggtgatccgccctcctcggcctcccaaattgctgggattgcaggcgtgagctgttctgtagactttctaataacaagaatttgtaacagtcacaaggttttaaatttccttttcagtactaaggaaatgatagctgggaatgcaaaggctttattggcaagattgttttgacaaggatggcacaaaactaaatttctatacttgattaatttataagtcttgtcactcacttttagttttagagtgtggataaagctgtttgattcttgtcagatttgaaatgtatgatttatgagacattaaggattggtttttcagtgcactctgccaggtctagttttatgcgtcattctggtttgggaagctgagtgcaagtctgcctacagacataatcaatcacctgcactttcgggtggccaggtggactgaagtaacaggtttccccccaggtttctcagagactaag

SEQ ID NO: 7628 - DNA, 1897 bp, artificial
  synthetic oligonucleotide
atacaatttgaaagttgaattttgtcaccttacaaacttagttattcctgcaacttttaaaacccccctaaattttccttatgtgttcatgattatccccatagcagataatggccacatgcgtgctgatatgaaggatttgctccagggctaattgatgggagcagagctgcccagttgctgaattgtaaggaaacagttcatggagcgccaatgccaatttaggaaaagtatggggctgagtacttagtaagatgaaataaaaaaatatttatccagtgcttactctaaggagaaggcacttggctaggtttgctagatgctgtggggagccttaaaacaacagtgatctcttcaaggccgggcgtggtggctcatgcctgtaatcccagcactttgggaggccgaggcaggcggatcacttgaggtcaggagtttgagaccagcatggacaatatggtgaaaccccgtttctactaaaaatacaaacattagctgggtgtggtggcatctgcctgtggtcccagctactcaggaggctgaggcaggaggatcacttgaacctgggatatggaggtggcagtgagatgagattgtgccactccactccagcctgggcgacagagagagaccctgtctcaaaaaaaaaaaaaaaaaaaaagtactagcgatctcttcaagcaaagaacgcccattctaattggagaagctgttaaagacacatgaaggatgtggtggaaagagtattgaactgcatagggtgtggggagagagtcaggagttttgaatcctagcctgagttctgccactaagcattggaaactctgggcaaatcatctccccactctgggtctcagtttataaaaaggcaaatgaacgagatcatctctaagatattctgtagattgattcataaatgtggaagagattctggaaaacggaagcttgagcccaggagttccagaccagcctgggcaacatggtgagactctgtctctacaaaaaatacaaaacattagcctggtgaggtgatgtgtgtttgtagtccctgtttctcaggaggctgaggtgggaggatcacatgggcccaggaggctgcagtgagctatcacctgggagcttgttagaaatgcaactttcatgggccccactccagacctagggaatcagaaacgctggggatggggccccgccatctgtgtcctaacaaggtcctctctcaggagattttgaggcacaataaagtctgacaattacaggctataggaatttgggtcagtggttctcagcctctgccatacaatagattcatctgggggaactttgttgggggtggggcgctgactttgtttgtgctgctgtaacagaatatctgagactggataccttataaagaacagaaatctatttctcacggttctggagactgggaagtcccaagatcaaggtgcaaacaggttcgattgttaagggctgctctctgcttccaagatgacactttagttctccagcctccagaggggaggaacgccctgccctcatgtggcggaaggcagaagggcaagagagccaaaggctctgttgaagctttaatcccatccaccagggaggagctctcccggtttaatcaccccacctcttagaggccccacctctcaataccatcacattgtccattaagattcaacacctgaatcttggacacatgaaaaccgtagcaggcacccaggcatcactagttgctttggctctccaggtgccgccaattttgagaatcactggtttaggggaaagtggcatgaaccaagacttctgtcattctctagctgcaatgaacgtcagatgcagggagtcagccaaagccagaggcttgaatttcactcaaagaaacttggcc

SEQ ID NO: 7629 - DNA, 1164 bp, artificial
  synthetic oligonucleotide
accaacaggatcactctggttctgcagctgagttttcacaaaacagtgcctgtcctggcacaacagaagagctccttccacagaaagttattcctatttgctctctcagatacgaatcactgtgggccaccgcgctcctctgtccacctgtggttactcctgcattgaatctgaatcaagacactgctcaggcagtcaaatgttggccttcggggaaacttggcagatgggagccaagtgagctttcactttatgtactttcagtcctctggaaatctggatttcccctgctatcaaaatagacaatgctattgcctaacaaaatatagacttcctgagtgacatccaggtcacggcttgatctctttcctcctgctgtgttcatgcttccacttccgtgcaccatgttaggttcagatgatctactgaccaaaccccagagaaccactcatgagtcttttcaacctttaccttgaattctagggctatcttctatttggggtttgaaaacaccagtgcataataaagtaatgtattaattatagttttttggtaaataaagatagatcgtatgttactagccttgatgtttcacacaatgaagcagagctcatgaattattataacatccctgatcaaggcagttgatctcagttatcagcattaagaataaaggtatggatggaagcttatttgatttgttcttctttcctattatggatattaaccagctgggtaaattatagaatagggtcatggaatgtttagccctcaagcatttatcagaggcttaaaatgttcataaaaggtgggcttggtgaatgccaggacttagcatggttgaaagggtgttttgagtcatggtacatggcaatatggaaataaaacagatatgtcacaagtaggtggtagaaataaactggaagagaattttaacatctaaaatgtgacaaagatttatccttaccagcttctcagtttcctgaaacatttattttcctttgattttagattctgtatttatgttatatatctctttctaaaacattttcttgtttctgttttctttacttcttttacttttttgccacttctgttttttgaaaaatatcatcctaggcatgctctgaaagtcatttgttcggtgttttcctgatagtgatt

SEQ ID NO: 7630 - DNA, 3705 bp, artificial
  synthetic oligonucleotide
gaagcaacattaacaacagtcgttgtaaaggcaatagtctattacagatgaaaataagatgcttctccaaagttgatgtttgcaataagctgtttctattttaatcatactatatttcagaataattttcacaaaaaattacaagatcttcaaccctttctaaaagtaatctaaacatcttcgccagggctagagatcttaccattataggtgattatgtaagatactccatattttaatgttttagaatagaatgtaagaaagagcattttctcacccatactaaaaacttaataagacattaatcagagtgggttggatctccaaggtcctttccacctttaacaatctaattttatttttcctatgaaacggacgaaaatgataatatttggtgccaggtaagatggaagaaagcgattaataccaatgtttggaaccaggcaacctcatcacaactggtgggagtatagatttgtatattttccctggggagcataaaaagtacatactgtttgttccagcaattctacttctaggtttacccttaggaaaaaaaaaattacataaatatataaaaatgcatgtataaagttgctaattactgcactgtttataatactgaaacaattgaaaataccatccaaatgttccaaaggaaatgtagaccatattaaggcagtcactaagagcaataatatgaaatattttggacatagaagatggaaagcaggttatttcattttgtgaaaaaaaataaatgcaaagaaaaatatgaagttaccagtgagcacagggataatgggggattagattaaaaacatcttctacacgaaatatttattgcttaaacgattaatttttttttttttttgagatggagtctcgctctatcacccaggctggagtgcagtggcgcaatcttggctcactgcaacctccgcctcccaggttcaagcaattctcctgcctcagactcccaagtagctgggattacagacatgtgccaccacacccggaaaattttgtatttttagtagagacggggtttcaccatgttggccagtctggtcttgaactcttgacctcaagtgatccacctgcctcagcctcccaaagtgctggcattacaggcgtgagacaccgcacctggcctaattaaacatttttcaaaaggtatttggaggtggcttccttaagacctggtaaattaaactaaaaaaaaaaaaaaaaaaaaaaaaaaaaagacctggttaaatttatctgccatctcatctttaagtatgggtggcaaattttcacctaatcttaccccaaattaccaaagatagactacttatgaataaagcttttagttaaattaaatgttatcttttagtccctcacttttagtggagaaagcattttatttacatatctacatgtgcctaaacagtcacattacaccaacagtttgtgctacagaaaatatagtatgactggatttgtattagctataaacttttaagacaaaatattgagattttttggatggtggtaatagaaatatctcaccatagattggtgggaaagggagactggcagaaaataacctgacatacacataattgggcataaaaaagtcaggaattagaacaaaagaaataaggctgcagtacaagaaagtctgtgatagcatttagatgtgttttactaatcatataaatactaacagagaaaaagcaaagggagtgggatatatactggaaaggaaaaagtgaaggggaaaaaaaagaaaaaaaatcataggaacaatgcattagtcctttccattactgggtggggggggtggtcttgctatccaaaggcaagtctaatgctatatgtaaactataaatgagaaagtccacacaactctgaagatgtttcatgttaagaacaatctttaggtctctaactaaaagctgaagggtggctctatgctattcttccatattttaggtgaaaaaaggaaggtagagtaggaaactttctcccttgaaatgagtgaaggttttctatatttttaaaacccatagaactttaaaatttaacaaacaccttcaaagttagctatctcatcctacaaattacctgtctcccatataactgccctatcatgttagaagtcataaaataaatatgcaacatcaaatgctgggtaaaatcactaatatggtaactacggattcaaactattttgatgcctaaatgcaacaaattcagtgatgaagcctgctttgaaatgcaaacacttaacacctcctggctttccaccatatgcctgttacctggatcatcttttccagggctggataatgaagcagcacttctgcttctggctaatgacgcttttgttgggctgaacagacaactgattaaattattctcttgagaactgatatatgagcaacgagatatatgatgagaacaaatccaaaggattccattggaggtctcacaaatgcaaagcaagaaagagcaatgcaaactgctctcaacagcagctttcccagcaacacaaaacactgaacacagtcatctgactggactgcactgtcaaagaagagatcctcagaataaaaggagaaaggccacagcatacataccaaaataactctaaggaaagaatctaggtaacatttcaaacagagccattccccaccgtatgaaatttatggaggaactcacacttgaggaaaaaagttgcacatggcaaaacaactttgagaaagattcctacagatagacagcactgaaaatcataatggtcaagtccactgccaaaggctccaaggaagtgaataaacacttttgttaaaagtaaattttgttgtaaatatcttgctccaataaatcttcatgttcataaagatccctgtgtcaatgacatttgttctaataggatttgacctgaatcaattaggtggaaggtcttctgtaaaggaatggtttggtatgaaacaaaaagcaacaaatacacgtgaaaggaaaatgctagggaaaggtgttagaaagaaactactttatggccaggcgcggtggctcacacctgtaatcccagcactttgggaggctgagacaggcggatcatctgaggtcaggagttcaagaccagcctgaccaacatggcaaaaccccatttctactaaaaatacaaaaattagccaggcgtggtggcaggcgcctataatcccagctactcgggaagctgaggcgggagaatcgcttgaacccgggaggtggaggttgcagtgagctgagatggcgccactgccctccagcctgggcaacagagcgagactctatttcaaaaaaaaaagaaagaaagaaagaaaagaaactactttatgtaaagaagtactttagtaatcactgtgaaattctgtgaataatcagcagtgaaaatatgcacaaaggatatatgtgggtaatgctatgaagcaagggcaaagctttgaagttcgaaatgtggccgggtatttaaacttccaaatacaaattaatgaaatactggaagtgaatcaaatcctccagtacactcctatctataccaatattctgtgatttatttccccagctgcattatccaccccttgtcagatgatggcaggaattatatacttcatttaaagacagatttttctggctttagccaaataagcatggcaccaaagcacatttttt

SEQ ID NO: 7631 - DNA, 442 bp, artificial
  synthetic oligonucleotide
cccgaagctctgcttctaagtaaatacagagaccaatgctttgcatgatatccaggatggtagccattcatgattattaatacgacacacatatgattagggtgcccacaaaacacacacacatacacaaacacaagttcagctttcatgaccttatctggaactccgcaaacagaaaatttagcaaaacacatcagctttgtagtttcttgcaaaaatgttgaacccaaatctaataatgaagaaacattcagacagagatagagactgtgatatagtccacaaaataactggccccaatgcttcaaaatattagtgtcatgaaagactaacaacaaaaatcagagaagtgttccagatcacaggaggctaaagagaccacatgcaatgtatgatccttgattacaaccctaatttttaaaagaagcttgaaagggcatac

SEQ ID NO: 7632 - DNA, 2039 bp, artificial
  synthetic oligonucleotide
tgacaactataaatgacaatcaaggtactctcttatctccacctgacttgcatcactctccagccttgggagctctgggcagcttactacacagatgttgctatggttgtgtttgcctgactacctgccaatttggttaatataggcaaataaacctacgctctctgccttttgctctgagagggatttgtctggagttaattgaaatcaagagcattgaatagtctgaataaacatatattgtatacaaggggcaattaaatcaacctgaaaagtaatctaaagtgatggttaatatatattaatataagcaagagtctgtggtgttatcacatgtctgaagtgctcattggaaggccattttttggactctaaaatgacccatgtttgtaaaatcaatgggattgccatctggttgatttcattccggttagtttggccaaataccattaaccagaaaacaatccatctgactggggtcatttctaattgctctgacagaattgattcattgaggactttttcagccatagaaatagagttgtttttgtatggttttggtatttaggaatttggaagactttttcctctataaagggttcaaaatttcaattttctaaaaaaaagaaaaaagaaaaaaacccacaaatctgcctaaaggcagaaggtttataatataatatgtcacatattacttgtataatgaaaccactagacactttgaaaattatcttctccttctcaagtcctgcatcatcttgggggtgactttgatatctacatccctttccacctagaacatcctgtgactcccagcacttacaggggcctattcaaatgagggaccctgaaatctacctgaaatggagcaggtgctcttttttttggcctagcacagtacctgatgggacgcattgctggggtgaatgaaacagttaaagagagtaaaaaagtcctacccttcccaaattttctataggcacagtgccaacttctaaataatcaatgtgaacataagtgtctgagcatgcttatgtgactggaagaatgggaaatgaagcaaacagcatgcttagactggctgagactgtgaagtccagggtattagaatgagtgtttaaggctagccacactttcgtggctaccatgacccctctgaaccttgcagagggtgggcaggaggctgcacataactgcaaatagaagagaaaaggaggagggaatcagaaaatagtcagtaaatagcattagaatgaactagaaacaattgtaataactgccactcactaagtttcagcccatgtgctcagtactttcccatatgttatctgatttcctccccgtaatatgtctgtgagagagacgttgtctccattttatgctgtggaaaccagggctcaagttggtacagaacttgacaatattcccacagtagtacaaggcactcaaaccctgctttctctgtgttcagagtgataactcccttttaaccactacactattagctggaagaagagtctagaaacatacacagccacctgtgagggatcagggccaaagtagcttccaggatgcactttggtctgttcctagggaactggagagaagatttgtttacctattgggcaggagacctgtgggagcaggattagcttgggctatgactagggctagacacacagggtgggaccaggccaataatgaacacaaacagctagcaccgaggagagctccaggcttgcttctcctcaatggggcaaagctgaactttgcaaagctgctggctttctcatctgccgaaggagcctccccaagtcaagtagtctattccgcagcgtggctgggtgttatgtgctgctgctcctgctagaacctcagaagtgtgagcagtgcgtcaagatgagggaccaggcttctaagctatagcccagctaagccccccagtgccaatcccgccctcaattcttgagcagtggaaacagcagtggcagttatgaaaacaagcagcctttcttgctcatcttgacattgagttacag

SEQ ID NO: 7633 - DNA, 930 bp, artificial
  synthetic oligonucleotide
aggatttatagttgtaccttttggggaggagcagggaaaagtggctctatgccatcttgttcagttgagaagtctgcatttgcttttaacatcagttcttgggcagtaaaagctcttgagtgtgtatgcgtagacagatagggtgcaacaaaatgacagagataatatcactggcattgtaactaccttactcacttacaacattttcttttctgagaaggacaggcattaaattcaatggagataagtgtgccatttaggataaaaaaaatccctaccacatatagggaaaagagaaagattgatgaagcagaagtaaagtgaacctcactcattagaaatgataggtgcacagaaagtctgaattactgaatttaagaaaaacaaaagtatgtacagattaagacaataaggtcaccaataaacaaattaagttataaaagaaatttatattcagtatcagcctacattatacaaaatgatcttgaatgttcaagatcattttcaatgccaacccattgcaattaatttctagacttaaggtttataggaatctttaattccaatggatcctgattctaaaaagctactgattgtttgattgaattgtctttatctaggatatgaatgattattcaaggcatatatcatatcagggaatgtccataatttgggatccccactgagttttgattcctgggccagcaaagtcgccttgatgttttagtttagcattgcaatgctgtcctctaaagtttgtttcactgttttggatgattgctgtttcttgcagtgttcagcacttgcagaacttggcatttagtatctaactttgtttctccttggtaccttcagaaagagtctctttctttctttgtttctcctcagattggggtgtttccatataaattgagggcatacatttatgag

SEQ ID NO: 7634 - DNA, 1371 bp, artificial
  synthetic oligonucleotide
cacctacaccttctaatttcctatccacatccagatttaccaagaattcagttgtatctacaacttcagcaattaaatctcagtcggctgttacgaagacaacatctttattttcaactattgagtcaacatctatgtctacaacaccttgtctcaaacaaaaatccacaaatactggggcactccctatctccacagctggccaggagttcattgaatctacagctgccggaactgtaccttggtttacagtggaaaagacttcacctgcatctactcatgttgggactgcatcatcattcccacctgagcctgtgctcatctccacagctgctccagtagattctgtatttcctagaaaccagacagcatttccattggcaacaactgatatgaaaatagcatttacagtccattcattgactctcccaactaggcttattgagaccacacctgccccaaggacagctgaaacagaattgacatctacaaattttcaggatgtctctttacccagagtggaagatgccatgtctacttccatgtcgaaagagacctcctctaagaccttttctttcttaacatccttttcatttactgggactgagagtgtacagacagttattgatgctgaagctacacgtacagccttaactcctgaaatcacacttgcatctacagtggctgaaactatgctttcctccacaatcacaggacgagtttacacccagaatacacctacagctgatggacacttgcttactttgatgtccactagatcagcttccacatccaaggcacctgagtcaggtcccacatccacaactgatgaagctgcccatctgttctccagcaatgagaccatttggacttctaggccagaccaggccctgctggcatctatgaacacaaccaccatactcacatttgtgcctaatgaaaattttacatcagcatttcatgagaatactacttatacagaatatttatccgcaactaccaatatcaccccactgaaagcatctccagagggcaaaggtaccactgccaatgatgctactacagccagatatacaacagctgtatccaaattgacatcaccatggtttgctaatttctccatagtttctggaaccacatccataaccaatatgcctgaatttaaacttaccactttactactaaaaacaatacctatgtctacaaaacctgcaaatgaacttcctttgacaccaagggagactgttgttccatcagtagatataatatctactcttgcttgcattcaaccaaatttttctactgaggaaagtgcttctgagaccacacaaacagaaataaatggtgcaattgtatttggaggtacaacga

SEQ ID NO: 7635 - DNA, 1316 bp, artificial
  synthetic oligonucleotide
cacaagattctggtatgtacaggccaagttctaattgctgattcagatatacaaagatctacctaattggggacatgtttctatgtcatttgtctgagcatgctcccttcctccacctctagtgccagtctttctttctattacctttcgtacctgtttaaacatacatgcaacataacaagaaaaattttcaaggagacaaaagataaaagttacccatcatcccagaagaaaattcaagaagacaaaagagaaaaaagtcacccataaccccactgcctgaacacagctgtttttaggttggcatatatttttttcatgtaacctttctctgtatgcctttaagttttatgtagcagtaatcactattcttgtatcaataatgtaatttaccatttcattcaatggtttatcaaacattttccatgttttacatttattatcttaatgttcatttcaaaataacgaccttggaaaccatctagttgatgggctatagtaatttactaaatcacttttctattgttgactttatcattttcctttttaaaataatcagccctcttttctcactctctgctgttcatggtttatgccattaacttaagtgggcaaaaccagaggggcagcaggttttgacagaggcttaaaagcactcttttagaaagcaacattaggggctttccttttcctccctgtgtctaatcagttggcaagtcctgcagctttgatggtcatagtcagagcccacatctagcctttcctttccaaccccactgccactaccctggtgcaagcccttattgcccactattagagcggtctccttgccatctaacttaacagtatcccttacccgcctccgccaactatattctacactgctgccagcatgattttcctgaagtatggctgctatcatgccactgtcgtgctccagctccacattgcctcaagaattaagtccaaacccctaaatatagtccagaccgtaggcttcctctcctgctgtctcactcagcattctccctccctttatcatacgctccagtcaaaatgaccatttgctgttctgggctcaatggacgcttcctggtgtctctttctctgcctgtgctgtttgctcttcttggggttgggggaagagatttttctctacctctgtcctttcagcacacagctcagctcaaatgctgaaagtaacgtctctttccttggtagtttgatagattcagttttgtttatacagcttttcatcttatatttgccctaagtttcgagtagttacacttagaattttaaaccccctaattaca

SEQ ID NO: 7636 - DNA, 1920 bp, artificial
  synthetic oligonucleotide
ccattgattatcttttaaaaatgggtcacattttttcttcacgtattgagtaattttggactatgtcctgggttttataaatgttatatatatgaacactctagattctactctattcttttgtagattatagatttttgtcataacaggcaattaacttggttggactatactgtagacaccaactcttgattggcagttcaaatctcagttaattcctttattcttagtggaagtatgtcctgtacatatgtggtccagaggtcaggcatatatttgggcagaatttatactcagaattttggatcccgctttccattccagatgtccaccacaacccccatcacctcccagtggctatggttgccctggcttttgtttctggttcttcattccacaaagactgcaattaaaaaaaaaatcaaagttttagatgtccttcacagcattagtttcagcctgccatcaggctacaagatgtaaaaacgggtaccccaccttgtgatgttacctttttccaagtgtttactcttctccagaaactgtctgcttttggtaattttccagtgccttcaagtcgttgttactttgtattgttgttatatgcaggagagttgagtttattaggagctacttagccatattgaaacagatgttgaattcccagtgtattttgtttacaatggggttttctatcatgaatcttggtggagagacaaaccaaacaacaccagttgtattcttggtgccaaactgcttacatattgaagctaaatcatgacctctccatggtacttgattgccctagcagagttcatttctgcttagcaaagagccatatgggttttgagactacaagtcatttttagaaatattattcacttttaacccccactatacacccagctagataatagcaacttgagaggcagcatagataattttaaaaagtgggccaaaattgcatatatctttgttcacccacatcccagttgtgtgatcctaagcaattcacttaatctttctacgccatttcctgttgccataatacaacgtacctctcagagttgatagagagattaaatgggagaatgcaggtaagtgtgtccacatattctgttttgtatgggagaatccagatttatggctgtggacttagtgtaattattaacaaagcccttttgactctcaaaaatgttccagtacttgtcaaatactattaccaatcaactcagcaaatacttctgatagtggatgtcttgttccattttgtgctgctataacagaataccacagaatggataatttctgatgaacagaaatttattggttcacagttctggtggctgggaagttgaagatcaaggggccgcctgcggtgagagccttcttgctgtgtcatccaatggcagatgtgcaaagagagggagagagagaacaaaagattgaactcacagcctcaagcccttttataattggcattaatccattcaacagggtggagccttcatgacctaaacatatcccattgtgccccagcccccattattatcacattggggattaagtttctagtacatgctttttgggggacatattcaaaccatagctgtgagcatgcagcagaattgctaagcgctaatgcctcacttccctgcttcactttttaaccaaaacattgctccataaactatgaggaaagtgcctaatatcattgtattgtgttttttattgttactttgttttttccttttaacatatggaggaaggtagcctgagttccaagactggtctttatttctgataatcagggcaaatgacctaatttgtcatttccctctcatctctattattacccaggtgaaaggagatcaaagggagagaacctcaggaataggcttagaaaggaaaagatgatgt

SEQ ID NO: 7637 - DNA, 1241 bp, artificial
  synthetic oligonucleotide
ttgttgtgttaatttcagtgtgtgttgtgtgtgtgtgtgtgtgtgtgtgtgtgtgtgtgtgtgtgttttagagacggagtgtctctctgtcacccagattggagttcagtggcatgcttatggctcactgcaacctcgaactcctgggctccagtgatccccctgccttagccttctgagtagccgggatgacaggcacatgtcactatgcccaactaattttaaatgttttttgtagagatggggtcttgttatgttgccagggctggtcttgaactcttggcctgaagtgatcctcctgcctctgcatcccaaagtgttgggattgcaggctgttcagtaatttttaattgtgaaagggaggacctgggaggaatgggctactccattttcaatcagaagtcagctcatgcctgtaatcccagcattttgggaggctgaggcaggtggatcaattgagcccaggagtttgagaccagcctgggtgacacagtgagacccttgcctctccacaaaaggaaaaaaagagtttgagctcccctcatcactccccactcttaaaaaaataaatcagattttttaaagattattttcgtatgctcctaaatttgaaagtgtattctgtaagtgggtggataaaataatgtctttgcccctagctctgttgtccttcttttaagtatgtcagtgtggatacattggtgtgggtaatgatgacaataacaaaactaacagttactgaattcgtactaagtgccaggcaccgttgcaagcactttccattaagaaatgcctgtcataggtccataagcttatatctacgattccaaaatccaaaaggctctgaaaattgtaagttttaaaaatggatttgacggcaaatctgtcttgaaatggcattaggctatttatggtctttatttattctatttaatgtgaagatacacacatttcactgcagaaatattaatgtgttttctaatgggatattacctcagaccccattagggatgttaacaaatacagagcatatataccatgttatctttctaaaagctaaaaatttctgaattctgaaatgtagctggcccccaacggttttggataagggattgtggactgattctagcttatgggcctccctcaaagattccattaagggaacattttcactaatgctttcaaagctcttttcaaattataactatggtaataaaagtgaacacaaaagtaagaaagag

SEQ ID NO: 7638 - DNA, 1097 bp, artificial
  synthetic oligonucleotide
aaatagcagtaaagggagaaaggaaggtaggtatagagtgagtgagtctattggcacaatagaaaagggctggaaaagacatgctagaagggacagggcaacagctcccccattattatttctaccacagaatgctttcagaggtccctaaacaggggcagcctttttggcaaaccagcctctgagctgcctaccagcccatcacacaaagcatggatcactattgatgcacaattttctaccacaaatcaccacccacacttatgcttccacatagttaaagcttgaggatgatagaaaagctgtgagtaattccaggcggctgtctctgtaaaagaaagaacacagctgctgtatcccagaaaagggatctcctacaccctgtgttcggggctgacacgtgttctccaatgtttctataatactgtggaggactaatgtcagagctccctatctggtcttcacattaagcctcctcctacatggacaacccctatgaaggggcagcttgtgtggacaggacagtgactctgtctctgttgttcccactgttctcttgactaataccgaatctctccatctgggtcatccaactcattctccctctgggcttcttccaagctacctagcaagggaacgatgtctcttgatccatctcccttataatcagtgcacaattgctcctactggaaagaaatcaggctctggaaaaatggaaaagctgatggtactttcagttcccagcatcataggaaaccctaagacagctattcaatttctgtctctcagagaggagagatcttcagaggccacaggtgcaaagaagcagaggcccatgaactaggttctagacctcacgaggcagcaacatttcctccacctcttcctgctttctgtgattctccttttgcaatgcctttctgcgcatcaagtaatgggaggatgactcttgttctgcccccctaataatcagtgcacatctgcttctgttggaaatagatcaggctctaaatggagctgccctatctcagtctacccaagagagaggtgaggtgtggagaacccacagtctagattacaaaacagagggaagaaaa

SEQ ID NO: 7639 - DNA, 1415 bp, artificial
  synthetic oligonucleotide
attctgttctgttctgttctcctaataccatctcgttactagacgtaggcattggacgtgacaatcaactgcatttgaactgagaagaagaaatattaaagacacagtcttcagaagaaatggctcaaaggcagcctcactcacctaatcagactttaatttcaatcacaaatgacacagaatcatcaagctctgtggtttctaacgataacacaaataaaggatggagcggggacaactctccaggaatagaagcattgtgtgccatctatattacttatgctgtgatcatttcagtgggcatccttggaaatgctattctcatcaaagtctttttcaagaccaaatccatgcaaacagttccaaatattttcatcaccagcctggcttttggagatcttttacttctgctaacttgtgtgccagtggatgcaactcactaccttgcagaaggatggctgttcggaagaattggttgtaaggtgctctctttcatccggctcacttctgttggtgtgtcagtgttcacattaacaattctcagcgctgacaggtgagtttcttttctccattatatttgccaggatgtgaaattgggcaaaaagaaaggaaagcttgtacttagcatttactggctactattctgcttttctcacactctgtaacgtggatgtgagattggaaaatctggtggcatttaaaataaaagttagtgtaagaatgttaaaatttctgtgttagcacggaggagaagttgaaattgcatgctttatggataatttattcttattgtttgctcggaagtatactgaacggggtttttatttttctccagtttattaagtaaagcaaattgttccaggtgtaaaggaaaaaaattcatgctttatacattagtgcagcctagtggtgcaatatagtcaacatgaaaaccaggataggtgtgaaattgaccacatatgtataactgtatattggaagagtggtaaaaagacacaggcatctaatttatttgaaattcatcaaattagctaatggcagaaaaacggtgaggttttcaactccctggtaacttagtgtaatgtcatcacgtaattctacttgttttctctgtaggcattcagtgacattatcatttccagagaaataaattaatcttggttgacttttagagctctgtggagagagcgtgtgagatcctcttgcagtcagggtgttcagattctgtgttaggatattttcagtccaagtactctgtttttctgtgttcctattgtagaataactgtaaaaacatgaaaaaatttgaggctccaaatgttaaaaatgatgctttacaaagcctgcaagattcctgtaagtaatcgatgtttggcagtaccagaaggaataacttcttcagattctagaatctga

SEQ ID NO: 7640 - DNA, 582 bp, artificial
  synthetic oligonucleotide
tgatactgtattagtattgttttaaagtggacactgtaacacgtgtggaaaaacaaataaatatgaaataaagttttaaatgactctgtgtaactttatattctaaaaacagtatttctgacagaatataacggaacccattttaattccaaaatgttactttcaagtcacagagccctaaaacaatcttactattttcctcactctgagtaaaaattacatctttactctcctaaactctaataacttttcagatataacttgataaaagtaccagaatactaaagtgaagacagctttttggaagttcataaaactagaactcaaagaactttttttttttccattctcagcaatccttaggtgagttagggatataaaataattccctaaatggctgtgtagggcatcagcctccttccatccgtagttgtagttggcttaaaattcacagctttgctttgatttttgagagggtggtctctttttcaacagattatccttgtcatggctaaccttacaagtaggccctaatagccacaatttttttcacactgacttttgtggttccagaaatgtttc

SEQ ID NO: 7641 - DNA, 1061 bp, artificial
  synthetic oligonucleotide
acatgggaaagtgttgtgaaaggcttcacacaggaggcaggtgcttgaagcaaagctctgaaagataattaggagtgaaggcccagaggcaagatagggcagaattgatcgaatgaaaaagatgtgggttttgctctcaggggctctcagttaaaaggaaacaggagaaagggagtgaagggtcaagtgctctgtggggtctactgggactgctgtaggggcacagaggagggcacagggctggtgggggtagagtaaggcttcctggaggaggtgatgtggcatcttaccacggagatcaaaagagaactaggagtagccaccgttcctggaatggaggtagaaaagtaatgtcttcttatatattaaaatatattgccaatacaatcagcatagaagagtaatcaatgttttaaaaatgtattctcaagaaatgcttcactcttgagattgtgcaatccttgaaatattgccttgtgagtggggatcttagtttctagtgcagcctcccacctatcacggggctttgcttataatagccctggctgagggctttgaagttctgcctgaatactacaggtgttgggggagaagggaattgagtgcatttgttaaattctgaactaaatgggaataaagacctcatttggggagataattattaaatcctatattcagaagtctggtgtttgctaagcccttcagtttcatggacaaagcataaacaatattcccttttcaacaccacaaattaacttttccaagaaaaattggctgtgagataaggatagattatattctggtatgtgtatgaggaatggggactttgaactgctctcaagtccctaactacagaaaatctaagaaatgatgttgtctcactttggtaaaataacatctggggaaaatacctactttctctttgcatttagtgcctcattaaaaaaaaaaacaaaaaaaaaaacaaaactaaaggtcagattagcaacctaaaaatgaaactagaatggaggtgaggaaagaagtagtgtaacattttaccctgaggctgagaagaggga

SEQ ID NO: 7642 - DNA, 1346 bp, artificial
  synthetic oligonucleotide
attgcctttttttttcccctcagcataattgcctcgagattcatccaagttgttgcatattgtattgtttgtattattgagtggcatttcacggtatggacatagaacaatttctttattgaagtttattcctattgaaggacatttgggtatttttccagtttttggctattacaaataaagacaagtatctgcatgcaaatttatgaccataaagttgtttgtagtatttcttattatccttttaatggctgcagaggttgctgtgatatctttgttttattcctcatattggtgatttttgtttttttgggttttttttttttttgtatttttttagggacaggatctcactatgttgcccaggctagagtgcaagtggctattcacagtcacaatcatagtgtactacagcctcatactcctgggctgaagcaatcctcctgcctcagcctcctgagtacctgggactacagatgtatgccactgtgcctggtctgatattggtgatttttatcttctttcgttttacctttgtcaaatttgctagaggtttatcaactttatcaagttatttcaaagaaccagcttttttttttttttttttgagacggagtttcgctcctgttgcccaggctggagtgcagtggcacaatctcagctcaccacaacctccacctcctgggttcaagcgattctcctgcctcagcctcccgaatagctgggattacaggcatgcaccaccacacccagctaattttgtatttttagtagaggcagggtttctacatgttggtcaggctggtcgcaaactcccaacctcagttgatccgcccccctcggcctcccaaagggctgggattacagacatgaaccactgcgcccgacctgaaccagctttttgtttcatcagtttttctaatgattctctgttttctatgccactgaaaacaatggtattgactttctcttctttttctaggctcttaagatgtgagcctaaattattgatttgagacttttgcccttttccaatgtaagcattcagtgttataaatttccttcttggcactgttttagctgatttccatatattttgatatgttgtgttttcattttattcagtcctatttatttttaaatttcctttgagactgcttttttgactcatgtattattaggcatgctgtttagtttccaagtgtttagatatttcccttttatttttctgttattgatttctagtttgattccatctggccaaataacacattgtatataattccattattttaatttgttaaattttttttgtaacccagggtatagttatcttggtgaatgtt

SEQ ID NO: 7643 - DNA, 2249 bp, artificial
  synthetic oligonucleotide
tttgttagcagcagcatttggccttggccctcagtctaaagttacctagagagggctctaggaagggtgctgagacctccacaacagataggaggacaaaaccaaaaggaaaaccaatattagtcaagagtgaaaccttctacaaggctccacccccagagaaaagccctccttacttcatcagttgtgggggtccctggtcttcctgcctctccacccacataacctaaagggaagcctgactgttgacatttcctacccacttaaacagaacccacagtcagccctcccattccggagagaggtttgtggggaaaacagatagatcaacacaattgcagaggaaactcatgccatctacccataataaccaacacgggttttcattcataaataaataaatggccaagcatttgagaaaaactagcaacataatgaaaaggaccaaaataaacaaatggaactgacccagaggaaagagggagaattaagggaattgaagaaaatgtaaatatattctgacatgtattgctagaaaagctagccaagcgctattctcccaggttagaatattttacaacttccccttctatctctttaaaataatatttagtaatttggcaaacatttactaactccttacaatgtgtcaggaaccaaaatttctgggtttttttgtttgtttgtttgttttaattatctttttcctctaatagctaatggtagaaaaatcagacaagtccattatgatatgatgtggcaaatgctatgatagattaagcacagaagaggtagggcacagtggctcacgcctgtgtaatcccagcactttgggaggccaaggcatgtggatcacctgaggtcaggagttcaagaccagcctggccaacttggtgaaaccccgtctctactaaatttacaaatattagccaggcagagtggtgcacgcctgtaatcccagctactcaagaggctgaggctggagaatcacttgaacccgggaggtggaggttgtagtgagccaagattatgacactgcactccagcctgggtgacaaagccagactccttctcaacaacaacaacaacaaaaagattaagtacagaagagagcaccttgtcagctggaacagaatatttcacttaaacattaatagatagccgggcgctgtggttcacatctgtaatcccagcactttgggacaccgaggctggcagatcatgaggtcaggagtttgagaccagcctagccaatatggtgaaaccccgtctctactaaaaaaattttgtaaaaattatccaggcgcggttgcgcaagcctgtagtcccagctacttgggaggctgaggcaggagaatcgtttgaacctgggagatggaggtttcagtgagctgagatcgtgccattgcactccagtctgggcgacagagtgagactttgtctcaaacaaacaaacaaacaaacaaaaaacattaatagataagacaggagagaattagccttggcacacaaataacatgaataagcacagcacatttcaggaaataaaactagcttaaaatgtttgagacctaatgagtcgtagacgatgaggagagaaatgtgggcaggggtcaactcatctgccatgttaagaatcgagaccctttcctctagtctagagcttttcaggtatattcagggaaaagaacccttaggaggcccttcatacaacaaacaaaatactgttatatttaactctttcatatgtactggaaatgattttccaagcagaaattatgactgtgttctgggttatcaatataaaatcacaaccacaggcatattcacatcaaaaacaaactgttgaagtatgatccattgtttttcttatttttcccttgatatttgctacaaatcaatcactagctagcagaaaagtagtagtagaaaagggtgaccaatatttaagaaaattctgtgtaaaaataactgaaaaatgagacttcaatccattaacttaattctttctgtaaacttagaaaaagatggtcaatatttgattttggctatagacacttgcatgcactcctatacatgtatacatttcttggaaactaagtttgataatcatttttggacgtgttaggcagctgaagatattaaaacggagccaactccctgttagggagagacaggcatgagaggttctgagacaaagaacttctgatgcagaatcagaaatcaaaaaaacagcccaaatgaggaag

SEQ ID NO: 7644 - DNA, 1708 bp, artificial
  synthetic oligonucleotide
ggagcaaatatttatccaaactatattcccagctgatacacacaattctgtcacctctttgtgagacatcacttactccttcacatgtgtcccaaagtaccttgtgtcccaaagtaccttgttcacagccttatagccaaatatgtccatatcgactggctgactgactttgcagtctgtctccaaatgaaactatgtttctagatgtgggcaggctgattccctgagtaactgagagcatcactgagcatgggacttctggaaggacttcagccttcgggtctatttagtctatctccctgcagaaaaatatctcaagtatcagaaactaagagggaaaaaatgtatccataggaaatgggtccctttagaggttctaaaccaggtgaggcaaaatactcaacacaaaaatgatacagatgacatctgcctaagatgacatgaagtgcagccgtaagaagcttattcaaatgtttaagaagtgaccaaagctttccatgcattcttctttatatgtaaaagacgatgtcaagaaaaaattgctccaatcatctgctttcaaataaatcctcacataaaagaagattctcatgttaatttatccataaacaactttcagaaagtacaaaacacatacttttcctaatcacatattcctcctccgatggttttctctcagtcttccttttatgaagaaatttcttcatcgttttagggcttttactagactcctgtgaggacagaggtttcttaatgaattaaaattctccctcaaaaacaaaagtaaaagcatgaatgaaactaagtagaattcctctctcttattttgacagtctcagttaggagtacatcaatgtttaattctatgcacaattaaaatggttccaataaactctaaaaggttaaataaaacagaggcaatgacattatcctctcaacttgcacagaggtgggactaagagtggagtgtgcctactgaagatgtggcagattctccaggaggccaaatggctttagggaaccatctgcagagaaagtaagggatgtcaaccctaaaaacgtaacagtattcctaatttggtttacgttccccactgatacagttttaggggaactaaataaccactgtaaccactaatgtagtaatgatcacttttcaaagagcttcaaagctatttaaataattctgccttagaaacagtcccacaaataagaatataatttccatttgtgagacagaaaaattaaggcagagagactaagccatttttccgcagtcaaagagaagaaccaaatgaaggatttcctaaaaaataattttgggttagaagtaacacacccacagccaaacttaactatccatatataaagccatgtatttaactagtagacaaaataaatgtattgaatttgtttttgccatatgagtaaccagcaggtcaaaaaaatactcattgtcaatatccttaatccttaatccaataatctgtaaacagattacaaccttagacttaggaaaaaactctcatgatcacctaatcccaattttccaagaaatgtgtatacatggagcatggatattaattattaatagtaccttaaaaatataggaaacaaatcatttaatttatttcacttagccacagtacttacacttgaaaacaagacagatatgaaaaactctcacatgacaaaaataacaggaaaa

SEQ ID NO: 7645 - DNA, 1075 bp, artificial
  synthetic oligonucleotide
tgggaggattacagtgaccctctccaacagtcagtggcccacttttggttccccttagtaggagaacacacccacacaagctctgtcactggaagcctgtttacagggcttggatgctgtatataaaaggcattattgtgtgagtttttattttgttttgttttgcttggaactggtttctggaaaagacagactagcaatccattactggggaccaccagtctgctacctctgtttaactcagtggccaatgacagtgaaaataaacaagtactcttactaccaatcttgattagcagagcaaaaaaacgatgacaacagggaaggcacccggggtaggcttacttccacttggagggttgcacatcctttcaggaagtcattgatgttgttgatgcagtcagcttcagtttggggatccagacaaaactagaggaacacagtgaaatgtcacttggagattgtcatcccatgccaagcaaagtatactcatcatttgctgataactagagaaagcaggcctcttaaggtgtggggcaacactgctgtcaatccaggaagagaaataaccactgaaggaagtgatgcaaaaatctaaacggtcgatctttgtttcaaatgtcaccaaacctttagtggcaagccatgtctacttacaagctttctctcatgccttctgttccagtgtgctgatggcaaattagggagaccaagacagttttttgagcttagttcttgctttcaagaaaggaagcaatccctggtacctctctctcctccttccccctgataatttaataaaattctatttcccctctacatttgaccacacttctttacattttatcactatttaatcactctttctcaagtttaagaaattataagtaaatttatttgctcaataaaaatacaaactggctcatgaaggcaaaagtgctatgctcacagtccatgatgaccttaagaaagtaaatgtaaaattgtacctttaagcttacttaaagtgcctactttagaaattatctattctcgtgatcgtggatttccagctattaaaaatcttgaattgttt

SEQ ID NO: 7646 - DNA, 1559 bp, artificial
  synthetic oligonucleotide
gtatatactgaaaaacaacgaaaactcaaaagctgtcctagaccagacttggacaactacatgttattttatgcactagtaacaggttatcatccatcgtgtagacaatctcacctttccattcatgtctctggctgcatccttagcgtctgctgggctttcaaaggtgacaaaagcaaatcctcttgatttgttggtttcacggtctttcatcaagagtactaaaaagtagttttcagaaaaataaagtgttaccctaggtcaaatgaaataaccaaagtaaatgtgtaaacagaaagctcagaacttcttagaggacaaaaatacattatcatgtcagacgatcaatgcaatcaaattcatcatagcttatattttaattataatagcccagcctgtactgccagacaactcaccttccactattcgtccatatttgccaaatactgcttcaagagctttctcatttgtttccgtattaagcccaccaatgaagagctttcctgggcgatctgcttcaaccatgtttttttttttttgggccggtgagtctgttgaaaaggaatagtattacctcactgcaaaaagttcctcaagtttattggacacttttactttcgcacatttctcatattttccactaaaaccattgttccttaataactaaagaaaacgataacgagctaagcctcagccacagtaggaagcaatttgaactaagtagtttagtaacactgcaatttacataaaactggttaaaagggccaacttaacttttaccactacccttgatcacccttagctgttcttaagcaacagctgcttaacatttgaaaaagcaacttttagttccagtcctcttgcctttgaaagattcaattactcatcacacccttcctaacgatggttttaaaagactcccaaggtcacaggctagacacaggaccttaacaccaagccctcttccaacgactcctcttttcctcattaggattccctactaaatccaaggagaaatgtgaagtttaagccaagttatgccgcccctcttcttcaccggcccccgccctaccgaaaattctactatccggccaaaaagataaaaacaaatcgtcaacatcgtttgctattaagtaacggaacgcggacgcacacactaacactcgacactccgtgactgcagcggaacctaattaaaactcgtcattaaaaaccgcgtgtaaaagacaaaatggcgacacttggattcaacccagaaccaccgacactggtcaggggactaacttttaccaccaacattggctgggaacattcagagggcttcttctccggggccgccaatgaatacgaagcccgcagcccgcatggaagtccacatgcccatcattagcgccagcgccataccaatgcaggtatcgccgtggtgcggtcgctcctcgccccgctccagcctacaaagccccgacctccgctaccaactcccgcagatggcagccaaactttctcgagaagcatacaaccaaacgggccccctcatttgttttccctcgaccccctca

SEQ ID NO: 7647 - DNA, 699 bp, artificial
  synthetic oligonucleotide
gtgcctgagccggctcccgaaatgagtactcgtggtttccgcgtgggaaccaacctcgagcgccagtggcccgccctctccgggctgaggtggctgctgaggctggggctgctcctgaggcttcagggccgcccgctgcacggctttctaccttcccaggttagccgcggtcaacttctgccaggcggagcgagaaatcgcattttgtcaggtgaggattggagggagtgagagagatgtgaggggaaggcttcgggtaggggtatagggccgataggggacgaccagggccgagagctcatggacttggacccggaatgccattgccttccctgtgggtatgtctcaggggctttcaatctcggagtctcccacttcgcggatctttcccgccctctcagtatctcctccttcctcacagttcctccccttcctcttctttttctgctccctcccttccctctcatctcgtcttcttccttctccctctcggctccaacgcctactgtttcggccccaccttcttatcttggctcctccccttcccccccttatcgactccttacccagtctctttttgttctgccagtgctctctcggctcctccccctcctcctttctcctggatgctacgccctctcccatctccttctctttcccctccctctcggctcctctccctacccctccctctcttct

SEQ ID NO: 7648 - DNA, 591 bp, artificial
  synthetic oligonucleotide
tgccttcatttataaactaaaaatggagcttgtcagtttttgatagccagagtagtgattttcgtaaacaaagctgctgtaaaaaatggctcattagatgtttcagatgtcaatgataatttcaaaaatcagcttttagggttatattttcctgagaccaattctcactttgatttttttttcattcctgagcttgaataaaaggaaacagaaggaaatttctttgggaaaaaaagaagtgctgtttttggagtgactactgaagtgggaaagggggagatattttgtgtaattttgatttagacagtgaaattaaggctaattcaacttatgaaaacttacttccacttaccttgaatggaaaatcagactttttcattaagaaaaagtgtcaagtacttagccaagcaaataacatttgcttatagcatcccttgcttgtagtactcccattagataatttacttgtgtgccgtttcatataatgtcttaataaggttgtgcttaatttcttataaagtcctatgtacttttgagactattattgttgctggttttctatttcatttttgtgcctttaggtctggcctg

SEQ ID NO: 7649 - DNA, 2031 bp, artificial
  synthetic oligonucleotide
agctgctatatctagtttccaacatttgttgctagtatcttctctccctattctcctaccttgtgtgtttatgccattttataattcccttactgtaattttatcagggttttgaggaaggagcagagctaaacgtgtgagttaaattatctgccatctttaaccacaagtctcttaattctttttttgtttttttaaattattttattttacattcaggggtacacgtgcacatttgtttcatgggtattcttaactcttcatgtcttttatatccatctcttttcattttaaccatcaccacattatacagcttcttaccacttcctatctgggctcctttcctctatcatctcgtcccttaggtctgttttccacaatgttgtggattcttcttcccaaacaactgcactgtgtatcagagttttgattgtaaaagactcttctgttgcttcttaatgccaaaaggagaaaatcaaagtcttccacagtctagcctctgtctactgtttcaaccttattttttaggctttccgaaacactcatatccatatccatacccatctccacttgtagctttggtcaaacttgtctggtgtaccaaataagtaggggcacagcagctcggcttgcctggtgatgtatccagtagacttagaagttggcctgttgattttgagcaaccaatttaaaactccttaagtgaatacctgtctaacttgaaggcatcttatggcccctttcagcctaggatttgaaaatctattttccatatatgctatttcttgattgtgttcactatatagcatatagagttttttccatggtctattactcacaccttatttaccttctgctagactttgaaggtgcaaggatgagtaggctgtggaaattacatcctataagaaacttccatcttctttcttatatggtattaagtttaagccatagctcaatgactgggtatacacattgtgatttaatattcttctaggatttaacattgtcatttattatatccttcttatgaaaagaatatctggatattcataggtgtgatggctcttgcccaccactccagtgctttgagaggctgagatgggaggatcacttgagcccaggaatttgagaacaacttgggcaaggtagtgagacttcctctctacaaaaaaggttagccagtcctggtggcacacacctgtagtcctagctgctcaggaggctttagtgggatggttgcttgagtccaggaggttgaagctacatgtaagcgatgattgtgctgctgcactccagcctgggtgacagggcaagctattatctcaaaaaaagttacgtttataacattttcctgaaagtatattgttttcttttgttgtacacatttttaaattaaaaatttaaaaatttaatggacatataatatttgtacatattcttggggtacatagtgatatttcaatgcatataatgtatagtgatcaaatcagggtaattaacatatccatcatctcaaaatttattatttctttgtgttgggaacattgaatatcctcctcctagctagctatttgagactatatgacatattattattaattgttgtcaccctacagcattatagaatgctagaacttacttttcttatctagctgtaattttgtggcctttaacaaatctctccctaccccttgtttcctaatgacttttttctcccttcagaattgtctttgctgatctctttattatgatgaaaattctctggatggaagggtcatcagctgccgtctcctttgctactctgctagatatccttacaatttggtttagaattttagtaccactaacattttttggtgcatattttggaaataaagaaaaggtaaactcttaaaatactgcttttggccactgagcgatgactgaaataatacctcagtgtatatattacacatgaaatacaaaaagtcccactggagaaaactacagagaataatcattttggaataaaagatactttaaaaaatt

SEQ ID NO: 7650 - DNA, 391 bp, artificial
  synthetic oligonucleotide
acttgaataactttcaaattagtaaattagattaattaaatatgtcatcatataagcaattatatatgaaggacaagatgtatacttctcaggattattcgtttggggttgttacttggattcatatgtgatgggaacttctgtctagattgatgcttgaagcaggtggaaaaaaatggaatgttttataaaatgctccacttggagaaataatgaagttggagagctctgggaccttctgaactcaagcaaagtagcatttctgtctgtgtcatgtcaagttctggctttaactcaagtcatatcacttgcataggtcagattggaaagttcaaggattttctctgattttaactctcaggttcaacaaatatataaaaataaacaatgg

SEQ ID NO: 7651 - DNA, 7345 bp, artificial
  synthetic oligonucleotide
tacactactctcactggtccccgtgcttccttccttggccttcaggctgccgtccttggcttccattctgccctccttggccttgacctcaccttcatgctggcggcgaaactcactctcatcctggaactcctccttcttctctgctccctcttcatcctcattctccacacagtccttgactcgcacttccaagctgtgtctcttgacattgtacagcagagcatgctgcctccgggctgcacagaacaccacggagtagcaggcaatcatgacaatcagtggaatgacgatgaaggacaccacgctgagaatagtgtagctggggctggccccccagatcatggagcagagagcattgcgctcatcaaaggcagcctggccccagccgtagagtggaggagtgctctgcaggatggccacaatccaggtgccatagaggagcaggtaaccgcggcgctgggtcatcttggacgggtaggagagagggtggatgatggacaagtagcgatccactgacaccacgacaatggtgttgacgctggcgaaggcgaacaggtgggtgaggctaaccagggccgtgcagaagtggctgttgaggggccagaagagaggcacagaggtggccaccacccagggggccacgagcgaaatctgcagcaggtcggtgacgaggaggttaaagataaaacggttggtcacctgcagcagctgcggcttgcgctgcaacactagcgccagcactatgttgccgacgaaagaggcggcgaggaagataaccagcacggttgagcggatgatgccgtgggccaggctgatgggcattttggagaggggcatgcacgtgtggctgctgttactctcgcgcgtgctgttggtgcaggtggacgtcatggcaacagccagagggcgtgagacaggttgcaggctcagtgccggcaccggtgggtggcaaaggggtgcacagaccgcactcagtgcctatgctggtgacaaaagaaacacgcaggcagagttagtcacccgtcaaggggagaagcctccgcgcccagcaaggacgctgcaggaccccctaccccgggtttccgcacggctccatccccagtgcgggcagcttctatggctcctttccggactctccagatctgtctgcctgtctctctccagggctctgatttcctctcatctgtttctcctgctggcgcgtgcgtgcgtgcgctttctctgcttgtctctcacactgtctctggctccggggagttttggtcgctagcgctagcgcatgcgcgtgcgctctctgtttctgtctgtttacgaccgtcagtttctgtctcttctccagtgtctctcgctagcgcactttttttctttatctctcgggttgtgtgtctgtatgtgtctcaccgtttcctgattctttctcatccttgtctctcacttatgtctgtctctgtttctccgtctctcgatagcacgtgcacgctgtctctttcctgttactctcatttatctcttccactctgtttgtcactcagtctctctgtgtgtgtctctttcgctagcgcactttctctgcagggcttgcgctctcgctccctatctttctcacagtcttgcccgtctctccctcagtctctttctgatccattctgtctctctgtgtctctgcctgtcactgtgtcgctcgctagttcatgtgtgtctccgtctttccctagtgctctcttgtctctccatttctctctcagtctatttccccagcagttcatctttgtgggtccctagcgcacctgttcaatgtcgttcgctgtgtctctgcccgtctccgtgtctctccaactctcttgtttctgcgtctccctcgggttctctgggtgtctccttctgtctctcactggcacgtgtgcgcttgctctgtctttctcggaccctcttgtctctgtgtctctccgtgtggtttctgtctctccctgcctaagttctctctgcattactctgcctctctctccattgatctctaacactctactgcttgtctcacctgtctctcaagctatctctttagtgtgtgcactctctcgttggtttctctgtccttcactttcctgtcaccccaggactctggctaaacacttgctttgtatctttgagtgtgtgcgcatctctatttctctacatctttttcccatggcccctcaccttggtttttctctggctggatctctgtctctttggatctctgtctccctgtggactttattttgccgtggaaaccacctgccgccccggccaccgcgggctttggttaaaaaacccttagtttatcagcagtgcaatggagactggaaaatgcagagaggatgcctattgagctcccctaccctcaccctccacagccccatccccattcccaatttggcatcctctttgctttctccggatctgcttggtgtcggtgacagccgaggggagtgggaaaggagctggggagaaaggcaaaagaggcaggggtgcagggtggtggagagagtcagaaaggcagggcgagagagactgagaggcagagagacaaaaaggaaatgagagacagcgaaagaatgagatacatacagagagacagagagaatgtgagcaacagagagggagaaagaaagaaaaaagaagaaatgggagcgtgagagtgagagagaatgagagagcaagacagactgggagagacgcagacagaaaaagcaaaaaataataagaaaagagaacaagcagaggaagagggaaaggatgaggaaaaaacgagagaatggagaggaagggggaaaagaacgcacgagaaaaagtgagagagaaaacgcgagggcgggaggatggctagggaaaggcgagaaggggccgcaccgcgggccaccgcgcctggtagctcagcagccgtcgggacgcttcagagggggcgtcgtgggctcccaggctcggggccctgccgggtgctgggggccacggagcccggagtagggccgggctgcttacctgttgctgctgcagacgtggcgtcgcgggcgccgcgtgcaggtccttcggggctcctcgcgctcgtcccggccgcctctcggggctcgggcggctgcgagctggcacggggcagcgggcgctgcgggcgcggcaggagcggggcacagcgtctgtgcccgcacgtccggccagcgcgccgcgctgcaagctctgagaggcagcgggggcgcgcggcgtcttaaggcagcgcggtgccctcaccttgcggtgccgccctcccctcggcccccgcctgcgcccgtgacgcacgaggccgccgcagcccagggagcggggctggcaggtggggggccgtgcaccagaccccactcagattttctcactccgggttcccacccctggggccccgagtccaccgagagctcacagactggggattgtcaccggggctgattttcgtgcaaaccccgtgccttcctagccccctgatttcgggccagctcccaggcacagaccctgcactatccttccgattcttccaaataggagggcccgggactcccctcgacttctgaaaaccctccaaagtatgaatagcccctgagcccgagaaaggaatcgtgactttaatgtcaacgattttccacgaatttctctagctcccaggaagagctaagcggcagtgctttccctgtgggatttggaagcatttcatttaagacaagccacataattacccactatattctttgattgaagtatgtctgtctgtaagtcagtcagcatctctccctctctccctctttctccccctctctctgccaggtactgtgttaaactgtttacacagagaataccgctgaatctttaccccagccttgtgagataagtaccgctattatcttcattttatagagacagaagcagaagccaagaaagattaccctacttgcctaagttcaagtaaatattgcacacgttctattagccaagacattctggtctctcctaaacacatactgggtatttgttgtatatcaggactgaggaggccccctcttccctgcccccagaaggtagggaaggtgacccagaccagggatcatttgcattagatttccaagggattaggaggtgttttctaggcagggcacaaggggaaatgtgttctgtaaaaagaagatgcatggggtaaaactagggctgcaagagagacttgagttccaaaggctgggaaaacaggctgcagcatggtgagtgccaggaggttagctggttaaactgggtagagacaaatcctgaggggtcttgaatgccagtctgcagacttcggactttaccctgagatccctggaggtcgtcggagagtcgttttattatgaaagacttcaagcatacacaaacgtaatgagaataataaaataatcctccatgttcctattacccagccttcacaagggtaaataatttgccattcttgttcattggtgggttttaggtagggcgatattctaaaatcagggctggtgttggatggagaaagctgaagggaggctgtggcaggagacaaagagggtcttgacaggtccaacagagcggggcaagcagagacctacagagaggcaaattgacagggaataagggcaaggaggtgttggggagggtctagaatgagcacagggtttggagttggttgatgggctggatggagatacctcctccccttctcgtcacctgcctctgagacagggagatgagacaggtgtataatcgggcctcaagaatgctctttggatctggagtcctgcatttgctcttagatcatttgtcctttttctgctatgcctgattttatctccccaaggttgaatggtaaaaacctggtcatttttcctagagacagtttccgtgataatcactcacagttattattaattcctagcttcgtgctggccatggtacagaatcctgggtggcatgcactgtcaagcggtagtttgttcagactcaatgattttacaatcacttgggaggcagtgaagctgctagaagtggccagagacaaaggccagtctttcttgacctttcctatttttattgtggttgtgaccatgcccgagactgctaggttccagcaggggaccctctagacacatgttaaagattggtgcctcagagggatgggctcatggagtctgcagctgcacttttgggcacgaagggggataatagggagtggaaggggttgggtgggatgaggcctctgcaactgagacaagcctgccagccggagataggaaaaaagccagagaagtgctaggaaataaataccagctatttttctgtatagggagatgtttgagggtggttaatcctccggtgtcttctctttccctccagatgtgagcagagtaggtattcttggatttcaaagacatccaaatatcagttccccaactggaagtatgtggtggagctttggggaatgtggatttggcttccagccctgcaggctctgattctgatagccttgaaggagcccttcaactgacaagcctcattacattctggggagagtctttgggatgaaacagggagactttgggatgatggcttaagaagtcacctagtccttttccctaccttcataattcagtagcagcagaggcacgatcaagctgatgatattaatggaccaggactagagggcaagaagctaccaacaagaaagggcccaaggtcccattgacaatcacacgttgcaacactggtcagtagtgtgccggcctcaggcttgttcaccttgtcagactaattgccccaattgctgtaccaatagctagatgagggaagttgggaaacccaagactcagccaagtattagttctagtcattcattctagtaataaacggtgcaagagtccttgagtgcctactttatgcttgctgtcttgtattaaatccttgaggaagctctgcaagttaggaaacaataccgtattttctgaaagcatgacacagtacataccactaggaaatggaaaaatgctgaacatttaaccatcataccatggctaacaagatacatcttgatttcaaagatgctagaatgtgaaaaaaaatgtgctttagaatcaatgtaagacagtatcatccctgtctttacagaggggttaagtaacttatccaaggtcacacagcaaataagttttggagctgagagttaaagcctactctaactccaaagcaggggcatttcctaggctacatcaaggaagagtgcagagacaagacagaagggctcccagacccagctcagataaaatttttgaatctaggtgaaaggggactaggagttgctagaattgtgaaaagacaagtgcatttgcagtggtaatggtttctttttgtaggacagacacatggttcccataggtggtaaaaagactaaatcagtcaatctaagttctaagtcacactcctttttgcttagcgagttcataataagtcgatggggaaaaatatatggttttgttctggagtgcctacccatgggggtgttttacatttttcagtgttatgtgttactctggaattcacttcaggccaactcctagaagctgtgtttgcaaaactgaaacaaaatcaagtaccacctgggtgtgagctaatattgcacattctgtgggtttgggcagtacagaagttctggatttcaaagctatgtctatccaaataaactaatttggaagagaaaatcagcagaaaataacttgatggattaaaactagagagcagaagacttgaattctagccctaattctgtggctaacttgcatgtaactttgggaagatccccttcctctctctgatctcacttctgtaatccaccaaatgaatgtgtgtgtgtgtggtggggctaggggttggatgttaggtagtctctaaggatcctgtcagtctatgacctttgatgccatctactttctatctgagtgttatttttaaaaacccaaaactaatctgacccaaatattaaaaaaattgaaagctggactctgcttctggccatgaaagaataagagacaggatttacccttttatcttaaacaactaaaaaagtggacaacatacataaaataatagttgttagacattggaaaatagacagtacagcacagtgatcttcaagaaaagagaaacaaatgaggtgagccctacaattgcctccgtttactacctagagagaatttccagtcctctgtgcaggaagaaagaatccaggctgagcctggaagtccgcctaaatttaggagacaaagttcagaattcaaggaggtga

SEQ ID NO: 7652 - DNA, 773 bp, artificial
  synthetic oligonucleotide
cggtgtcctatcctctcatcacgattttgattgtcacaacagccctgtgcagtaggtgctgtgattttctacattctcctgatagaaaacagttcagagacgtgaaatgactttcctcaggattggacagctagaaaggagaagaactaggacttaaacccaagtgacgtggcaatgacaggagtcctggggtctagtgtgcagaacaagccaatttcagctatattacaggctgtggaaaacctatctcagtacttaaaataatacatattttcctaaagaacagaggaaataattaatttttcttggttttgacatgtgggtcaatactaggagttgagtaagcactattaccattattccaaggggcttcactaagctctccatttttacactatcactacaatgtagtgataatgtaagtcactccattcctcctctccttctccctgcctgcctccctgctcagccccctcttctctaagagtagatgcaggtattattagagaaaaatgattatagttgtagacagctgctaatgctggtccatgtggcatttgacacagtcccaaaaatgggagaagaaaaaaagccaaatagagcacttcctttgaccagtgagttttatcatcaataagtagttggatgccttctgtgcaaataaagggagaaatgtttgccgagtacatttctaaactgacaatgaatagtagtattaggaatgtcatcaggctgagaaatctcttagcaacaactgaaaaagcgagactata

SEQ ID NO: 7653 - DNA, 698 bp, artificial
  synthetic oligonucleotide
cagctggattctggccactccaaatcaaaggccaaatagcaactggtttccacttatagcccttccagggtctatgaatgtctcttggagagtgcacactttctggaacttatcattacactttgaggaatttttcagggaaaagtttttcaattcagaaagaaacctgatttctcattgcctgttcaccacaaaattttgaaagggcaaaccaaatgctaaatgttgaaaaggaggaagaaacccaattgtcaaattgccttcagagtctgtcgcacattcctttgaatctcctcagtggtgacaaatctttgtcctcagaataggctatatttgaacaaacagctagaagtcatcagggcccacactggtggataaggtgggtaatcatgctcggtgatgaatgttttggatttagaaaggagctgtgtctctctgggaaggactttcttgtgtggcttaaaagtgagttttggaggacattgtgacaaaaagtgcagcagaaagtttggagcactgtttatgtccttgaaatcagtgtatatcctcccatgggtacaactcagagtggtatcattcacttggttttggtggttggttgaaaaacagaaaccatatttgactttgtattcatctgttatatgaatgtgggatataacacctggagctctttataatatttgcccattctgaaaaca

SEQ ID NO: 7654 - DNA, 884 bp, artificial
  synthetic oligonucleotide
acataaaaaaatgtagtgccatgcctggcacatattaaggactcaactaattgtagctatcatcatcgtcatcatcatcatcatcatcatcatcatcatcatcatcactgctgctgctattactactattaagcaaacatccaatggtcaagaaatgattagaggactattttgtaagcatccactgataggatggcactgcttcaggcaggggatgtgggagtggaggagggagaggcaaggtcttgggcagacgaaactatgaggacagaatgaaggtgatttgggactgcccatctccgtctgtttgtgggatttccatttttagcaggtaatgtttgttttttagggaagttggtaatgagagatttgtttagagtttattatgtaaatggttaggggtcaaaaaaccatattgatattcccctcaattaggctggaaatatttaaaacatttggacaattaactgccttgtttatatgaacactataataaattaaaacataccagactggtcagaaatcaccacacaaaaacaaataaacaaacgaaaaacccaggatcaacaaggtgaaattttaactggagctgagatttttttttctctccaagtcactctgtgcccatcaattttgtgctgttaggtcacttttgccttggagtccctttttttaaactgatgagttttacagtaatgaggatatttaaaagtaggctctggggtttaaaaaatgtgttatgaatatgtttcatttgcagaaagtgacttagttgatgcacaaacttaggcaaaagttcacgtggagtgactttgagagagctcctggtaataagagatatggttgagatgagcagctgcaaatttctccttgctgttctttag

SEQ ID NO: 7655 - DNA, 555 bp, artificial
  synthetic oligonucleotide
acattcacagtgcctgatattagctaccttttgttgagtgcttatgtgagcaaaacactaagctaagaaatttacatatattatcttatcacatccttacagcacccacttgaagcatgttatgggctgaattgtgtgaccctccccagttgatatgttgcagtcttaacccgtagtccctcaggatgtgatcttatgtggcctttagagaggtaataaaggtaaaacgagatgattaaggtgtgtccttataaaaaggggaaatttggatacaggcatgtgtgtggggagaacatcatgtgaacatgaggacagccatctacaagccaagggaaaaggtccggaagagatccttctctcacagcccctaggagaaaccaactctgcagacactgtgatctcagccttttagcccccagaattgtgagatgatacttttctgttgtttaagtaacctttctccaagtttgtggtgctttgttatagcaatcctagcagactaatgcaagagagtattactattaaccccactctacagatgaataagctgaggtg

SEQ ID NO: 7656 - DNA, 930 bp, artificial
  synthetic oligonucleotide
acaggggtgcagatataaccaagagtcagaagcccccaagaagcttatgatttaagggggcaaataggaaagaaagcaactatcaagatagggtaaaaaaaaaaagatgctatgcttgaaaacccaaatacctgctcagcttcctttggagctcaaggtggccacatgacagtgacataattatggctaatgatacataaacaaaagactgctaaggggcttctagcagagtttttctttcctgaagaaaagatacaggcattgctaatgctttctgcttttccctagttcctgccttgaatgcagacatgatacctggggctctaataaccatcttgcagctgaattactggcaacaatgaaggtgagaagccaacacattaagggtgggtggcagtgcggagactgtaagatggtctggtctcttgatggccacaatgaatgaatgccagcaaccacctacctccggacttatgtaagaaaaatagccttctatttgtatgagtcattgctgctggacgttctgttacctgaagccagaaagtgttctccactgatacagagtgtatgaagaaactttataagccaaaaaattatttaaaaaaataaagaatgatttctagaaaaggagaaatatatgacttgagttacattttgatagcaggctaaaaaataaattggcgagttgtagtagggaatgttagtgaggtggtggtgacaagaatgaagacaataaacaatggaagtgcagtggcagcgaggatggggacaaaaggacagatgccagagagaacatggaggggtaactgataggaccagacaactgatcggacatcagaaggggtgcagaaatgggagggtttgaaaatgctttgaaagattttagccctggtgaccgaagggatggtggaactgtaaacctacattcct

SEQ ID NO: 7657 - DNA, 1030 bp, artificial
  synthetic oligonucleotide
tggtgcggtttgcttttcataactcacagatctgtagtaggaatcaagtaagctaacactgtaggaaatgaaaagccttggacacatataagaaatactagtcaagaattcagggaagtccgtgtgcatcttgggacttgacctgtatttgtaattccttttcaacaaatgtcttctgttaaaaatagttacattttgtctagttcgtaatattgaaaaaggccaatggtggaatgtcctaaacttttgtatgtctgacattcactctgccttggaatagtttatgtaaccaaggaattgtctcttacttaatgggttggtgactcacatggatgtgtaaatatataattacttctcagctttaatgacacttccaaaaagctctctcgactctcctggaccaggagaggacctctccccatagcatttggtacttatttgtctcattaaccatctcctccctgctagatataagctcaacgagggcaacagctagatccacctcgttcatcactgtcgcctcagtgcctacatagcaagcactcactaaatatttgttgaaaggcagctcttattcaagaaagataaatgaataaaaatcctcactgaaggaagagttgtatgttttagcaagtatttttgagcatgtacgatgtgcagtgcccttggctaaacaacatgggggctacagaggtcattctgagtcttgcagtttctgacaagaccactcagatcccagactgtcattttctcctctctggaggctggaagtgactgtttgcagagtcactctgccaccttttggctgtacgtaggaattgcaccttttctggcattcccctcatccggagaggacctgcaactcgctctacagacctagggcagcagcatcattcattcatccattccacaaacatccactgaatgcacacctcatgccaagttctgtgccaggagctggagacatagtggtggaaaagcacacacagttcttgccctcaaggagtttactgtctggtctaggggagaa

SEQ ID NO: 7658 - DNA, 1312 bp, artificial
  synthetic oligonucleotide
attgtaccccataaaatatacacaattattgtcaattaaaacaaataaaaaattaaaaaaagagaaaaatcctaaaatgctttaatgctatctaaactttttaccttctgatattctcaaaactctcttttcccagacttccattgagaaaatttccaactttctgctctgaagagagagaagtcttttatctcagtggaagaggacacgttctgttttcatggagtaacatccctatctgctggccttccaaaatattgccactgcagacaaagagtttctgaggcagaagcatgatggctctatctccactccaccaacccctgcatcctgagccagccaggtccagaagcaggaggcgggcaaaaccccatgctggtctctctctctctctctctaatcaagagcctacttccctggaagccctgacaaattccacttcacaagtctattatagcctaaatcacacactgccttagacttatcctgtgtagcagtctgacttccccctctgaagatagggattatttcttattattatagagtcctaagtgccatcagtgtctagcatacattaggccgtcaataaaatattggctgaacaaaaatttaccataaaggatagagtgtcctaagttgcttaaaagtgtgcattaactacctgatgagacttcagcttgtgttacagctgcttttgtgaaataaagattgtccatttctttttatgattattttaaagcagcttttatgcagagatacaaatgattttttctcatagtgacaatgatcttgctttcatctttgagcagtaaaacttttaaaaatgactttgaatgcttatgtgaaattgtgatcacctaattaccaatgataaagagaaagcagtgatgtggtacaccaaatgctatttcaagaataatgagtaattacattcagggaagctcccttacttttctgacgggatcaaccatacatgtgtattctagacatgtggaaagagaatccatttgtgtaacagttatggtcttcaaagtagtttcacatatgtgacttcattttagtctcacaatccccttcggagttagacagaggagctttcatttccatttgccagttaggacactgccacagacagctttagtaatagggccaagatgagcctacaaattagtgccagagccaggacagagccatgtagctccctcctcttgtccaggatgcacaggggttggtgtttcgtgcttggactgtattaactctttggagagcaatattaagacaaaaacatcataatgtcagagctttatatgca

SEQ ID NO: 7659 - DNA, 1806 bp, artificial
  synthetic oligonucleotide
acctaaaattaggccctgcatgaccaaccaccatcctgcctatcttctagcactcttggcctacttcactaaactcccgccccaccattctccttgtagtttctcaaatatgccgcaattcttttcactcaaacttgtctttccttcttctgaagagctcttgccgctcctccccttttacctcctctcttcatcctagaccagattagaggtctgggtctacttggctctcacagtgccctgctttttctctgtagcacttagcacaactgtaactaaataattatgcatgttatcatttgtttaatatctgtttccctaactagattataagtttcaggagatggagactgtgtctatattgttatcattttatccttaacaacttacactacctagaacatagtagatgccaactcagtgtttgttgaatgaactaatgacagaaagcagcatggcatggtatactgcaaaatgggcataccgatgtggacttcagagtgttatcgggaggattagatcaaagagtacctacatgcctaacacacagtacgtgttgagcacctaaactgtttatagatttggtgaggcattttttgttgaatgtattagttagaggggcgaagtatgagaaaatactgtattagacatcgaaaagttatttggtattgtcaactgtggcataccaatatttgttctgtcatgtacataaaagctgtttcttctgacaatagaagcttctattaaacataaactcttctagtcaatttccaggttctgtgagggtactttatttaaggatctcaggagtaggcatcatgtctgttggctgtttcatggttgaaatatattttgggcgaacaagattctagtatgggagctgatagaatttttaaaaatcaagatacttaatagtagttgagtaagaatctaattcctattttaaggcgtggtaagaatctttgagatataggtcaaaacttgtaaaaatagatgttctatgtaacccactaatcattagagcctaatgggatctgtaaaacattctagaagagaaggctggggggagtcacagcagaatatgactgatctgcatgcctttatgaggagcctttaatcaaagtttgcagttgcctgagctttgaatccctccctccagccgtccagtgatgccacactggtggcgttgacctcagggtcattcttttttaaacaattatgtttaatttgtgaatgcgatttccaaatgcaaaagctcccctgccttcccctgatttccctctgtggaagaatgtgtgaattcacatgcatcctgtcctaactgtgcaggggaaaattccagtcaggggacattgtctcacatcctagatatctgagagaataatgaactgataacataaaagtagattttctagcaatagagcttcttttctgagtgtgaaaattgccaaagtgtcttaggttatcatctactttacttctgggttttgtttctctgaccagattgggctaaaagtaaaacaagaggtgaaagcccttacttctgtttgttaatctttcttcttctatctttttttaaagcagtcctcttttttctccctctcttttgcctcaatagaaagaaaaaaaagttttgtcagcactcctgtttcttttgttgttttctttttctcagaagtctttttctgcttttatcctaatcccagtcatgcatgagagaacagttgtgctctgttgtttggctgttctgctagttttgaatcagtgggactccctctttgttctctttattttctgaacacagaa

SEQ ID NO: 7660 - DNA, 1203 bp, artificial
  synthetic oligonucleotide
agccccagctctttgacaacacaattggcgacaagcagttgaaatgtgttagaagaggctcccgtttgggaagagaaacataactccaagtgacaatgaagtctccacagatctgagactgctcagaagaaaatccttgttgatgaatgtaggaaatgaaagtgtccgcctttctctcacctatcagcctcagggattaggggaggatgtggcgatctctctcccatcttcaaaggttgcttcaaagatcctttggagaaatatggcacaatttagacatttgacattccttatgcatactgatgctgtgacttcaaaagctctattggccaagctggttagggaggtgttatttatttacttttactgggaaatgttgttgttgttgttttctcctgcttgttttgttttcttaacctgtagaggcagtagccaaaggacacatcagaaacggcacgatggagttgttactgtgttgtgagtctggaaagactgctgaatctaaggtcctgacccacagggagcactatttttggcagtaatttctgatgcaactttgagggaaagggcagaaataaaagggaaccacagccagaggactctgtacagccagcagcatattggccgacggtgtaggtttcttctgctgtatttgagcagctctctgttcagtctttaccttggcaggtggagttttttttgtaaagggaagccttgtttagacaacatttgcacagaagctttgaattcccaaattgtgaaactctccaaagaagaaagaacatgtgcatttacatgaaaatataattgatagatttcatgtcctcctttccgtgcatattcaagtaattctctttctgggtggatttcacttgccacagcctttatttaaaacttaattcagaggaatcacagtttgttaggtcttttctttccctctggatttttctctaaacctcgaaagcagaagcattggcctgcatgtaacatagcaagtatgggatacagaaagtaataattggatatttatcataatgttgctttcccagaacactattcattaactgccccatatttaattatgctgaaattagcacaggggagtctctggctagtgtatttgcacatgctatcaattatgtcctaataaattaatttgcttttcaggattcaccagaggcactggttgggcctctgcgctcc

SEQ ID NO: 7661 - DNA, 809 bp, artificial
  synthetic oligonucleotide
cctttattaatacaaataattttacaatgaaatccttgtagcttaatcattatgcacatctttaattattaccttaggatacattcttagaaatgcaatgtctgagcccaagagttaaatgtgtgcttttaagctttcaaaatttcctactgaaaggctgactacctacaccaactccactacaggtaattatcgatatgtatctcattgttttgattgtcatttcttgatgaatatttttacaagtgttgcttggccatttgtattttcatattaacttgatagtctgatggatgcttaacagatggatattaaattgatggatgctagcaggttttgttgacttttgtctacactggcaccgcgtcatgcgtgcacacacacacacccattctatgtgttacacaaataaatgctggttgaatgaataagtacatgtaataattaagtatttaaagaatctggtcaaaggaaacttcttctacttctttgctcttgacagtttcatgatttatttatccactcaacaagcaatgtggagtgcctaatgtatacataactcaatgctaggctatttaaaaataataagcattgggaataatttcagtcaatacaataaaagtaaaaatcacacacattctaagaacatctcagctatatagcaacttcagtggaatgaccctctttagattggcgaatgctctaagtactttgagatttacacacttactttaaatttttaaatggttgttggaaaaaatatttctacaagataccatatgcttctgtatttttataaatatggtacc

SEQ ID NO: 7662 - DNA, 1855 bp, artificial
  synthetic oligonucleotide
tgcctgtgtggagttcagaggggaaaataatggagtaggttttgcctcttcccttttacagtagtccccaaaagagtgtacatttgataagggccaaagtctgtttgtgaaaagaaacctctgaggggatgtacagcacctaagaccaaagaacttaattttgcctcaaattttggctatactgtttctatagagaccaaagggaagctttggctcccccactcagctattaaagtttagtgcattgaaaactgtcttcatgctgtgataccctttcagggaggagaatagggtctgaactaatccatgaaagttgtcatgctatgaactagtagtcaagctttttcctttcaattgaatctaaaactatactgtacttcacacttgattggtccttcagatggaaggattcaatatccctgctggaaatcagctcgtcttcttcacacagtgctgttgaacgtggaaagaacttatttctgaggcataattaccagctctaacatatgaaaagttgtaaggatatttaatttttttccttttcttaaatttcagtcaaactctttaaaatgttaacttttatttccccctgtgacaaagcttgtttactagactgtgtctccatccttgggcttgttgtttgtcaatagatgttgggatccatacatgctcaccagcctttctttcttcaggatgatagacagacatacagcataaatgtatcgaggacaaaaaaatatcttctgaatgcagccgtcagcgagccattgaatgtcctgtagcaaaggtaacgggtcacttatttaccatgaagagtgggacgagaactcaaggaatctgagtagtgctatgccaattgtctaagggaaaggacacttttcctttcccactcaaagagttagctttgtttgtttgcacatgttttagatcaataactggtaatagtaaaggcagaataaaagctctaataaccatgaaccatctgtagtgtgaattgacattttccaagttaaacactatgtcttgtgagtgaatacatacagtgtgtatgattttttttaattggaaaaaaaaaaaggcttgatctagctacaccaaaagggggcaccagggtattaaggaagttatgatggtttcggaggctaaaaattaaattaagtgaagtttgaagaggtttttagtataattattatgtgcatgattttaaaaacgtgttgttttaaaagtcagttggatgatttcaagtattttgataagactgttttgatatcagaatgtaatttcctactagcatggggcaatatttctggggttggtggtataaatgctaaaaaatatttgacaaaaaattatataagaaaaaatcacatatgtctcctgagagtgctattaatattcatagtatttctcatcaaaattttggtatattctgtcttttaaaatataaatttgtctcttctttgttgtataagacactcagtaaatgtaagaatatttgtctatgtgtatctgtgtctagatgaaaaaaatcagcattctgtatttgcttttctgagagaggatgcagaaagtgggaacctgtgggttatggcaaatagcacctaacttagagatactgtagcttccagagttcaaaaggaataaataaagagaacagatggcatttcctggaaagattttcaaattatacgttttgattaacactatctaatttctatgattctagtaaagggaatttaatgaaagaaaatagagacaaaatactttttaatggggttgtaaatatattcaatgcaagtagatgactcttctgatttaatgtcacctatgaagagtaaaaaccagttcaatttct

SEQ ID NO: 7663 - DNA, 1649 bp, artificial
  synthetic oligonucleotide
attgtatagatatatagatattcatatagatgttttatttctctgtgtactcttcaggttctgccattttcatgaagggtcgatctgaccgataaaatcaggtgttatacgtttttggaataacagaaaaccagaatagccaagatctgaacacgcaattaatcatgatgctgatgattagtgtattgtttcagccacaatctatgctttgggagggcttgacttggatctaagacattgttccattttaagaaaatgttcatatggtgatatctgaggtcagaacagacaaaataataagtagatcagattttgattaaagctttttagttgtttagcctggtatttcttatgaaaagatttcacatcaataggtcacaaagactttctggctttaattttttttttttcaaaaagtcaatttactcatgcttaaaagtccgtccatgcacatgctcaatggcttacttttgtggtgttttcaagtcacctctccatggaagcaaattagtggccaagtagagcttatgaaagaacctgaaacacagaagggtttccgaaggggctattctcctttagggaagctatctccggattaaaaaaaaaaaaaaaaaaaaaagaatcgaaatcacagctgcaagggtccctgatctgttccctggcatgatgtgttcattgaaaaccctgtatagaggagtttcacattagatatgtcatttctttttaacagatcgatttgcctacacagggcacagtctgtgggagttttcagtcacaggttttatttattttttttcccataatccagctccatctctgaataagtgaaaggaacattttggcctctttgattataaagacatgcaagaagcatagaaaatctgatgaaattaaagcaacaagagatttcaaagcacgtaatcaaaaagcaaaattttcttttcaaatgaaacactatgttattgtaaaaccagacattctacataggaagctgactaaaaagagataatttcagagacatagaaaataggcatcctgactagattcctgcagcaccttcaaaaagtttggtttttggtatttgggacagtaagctaaaacaacagaatagaatttgatcctagaacaactagatagagttacatgtttgttttctctctctctctctctctctctctctctctctctctctctctctcttaaatagacaaacagaatagctgagataaaacttgaggactagtcattcagcagagctgtaatctctaaattcacaatggactttccagcttaactggccttcatgcaactgtttattagaaattgcagtattaattttcagtgttgctctagtgatgtgattaggagtacagatgtccagagttaaattaaagaggtgttctaaacctcacaatttaaaacatttccctgaactgatgtggagacaataccggtctctctatttttaaaattcagttctcttggtttgaatagtgagaacaaaggtgctaatctgtagtactgagaaaggccaattatgccctctgcatcagacagggcttaatatgattttaaataattgccaaattagatgcatatgaatgtagttttactatttactcaaaacccattaacccagtgtctatgtt

SEQ ID NO: 7664 - DNA, 559 bp, artificial
  synthetic oligonucleotide
cttcagaattgcaaatcctattaactcctaactgaatggaaaatcaaaaatgtgcacctacaagatgctaaacaactgtgggaaaaatgtgtcattgagcagatgctttgaatatatgtgtagatgtttctagttgtgtagatacatgactactccagggtggacaaatttctcagagtatggggcactcatatgaggtgcctgcttccttgtgactatggcctgaaaactgccattttcaattttccaagttattccctttggaagtaatttagcaaaggatgccaggtatgtgtttgggagaatggagaagtttggaggatatattcatctacagcagcctttcgcctcctctgaacttttccagcagttattctttgtattatttctgggttactcacatttgcaaaatttgagaatattacccaatatcatattgtggatgtggaatgggggtccagagagacttccccaacgtatctgactccccgtttgtgaatttcatgtgtcttcattgaatgacaaagctccttgagggcaaggactgagccttatcatg

SEQ ID NO: 7665 - DNA, 1831 bp, artificial
  synthetic oligonucleotide
gtaaagcctttaaacagggtctggcccatagtaagtatcttataattgtgctattatgcaaggtataaatgacacacacaaaggcagctcttattgctacagtgttggccaccagtcccacttatcttcaggaatagttccagcctacacagttgagaactcctttaaactagactctttaaaccttggcttagattttaagtcccaagcaacttgctatagttttccccaagtatggagcatggactttatgcccagttacatcatatcattatgcccaggcagagggagcaagaggaaagaataagagtctgtatccccaggattttgatatatgctggggcagaggggcaggaaaagatattaaagtcatcctggaggagctctctctggaattgtggtggtttcccatccacgagatttccagaaacagagctgttttagcatcctggcacttgtttccttcctctcaggcctcctgcaggacctgggaaatggtccctttctcctaaaaggcacaagatgggttgcacagaatgatctgaaggctgtgtaacattcaccctagactggattccctgcatagggatggagtggagaggagtgctgaggatgacaggggcagcttttcattctggtatagaaatctttcagagggatgctttgtggtttaaggctgggccatgtcgctgttgccatgttaggtactgactggctgcccacctggacagattgtaatctccgtaagtacagagaccgagtcagttcagcaccatacatcaaggccagtgcttggctcacagaaaataaatgtttattgaatgaaaactgtgttctcttgctcagaaaggctggggaacctatggggagggaatggtttgcaggaatactctcagagtacatacattattcttccccaaaactgggggtggggagggcattaaattccatgatccattggttatctcagtgccaacttagacaaaaatctttcctcaaatcttccttctctcttcagcttttctaccaaatcttccttctctcctcagcttttctgccagacaaagacaatttatggccactattgtttttcctcagtttgggttacaaggttttttttttttttttttttttgtcaattttcttcttcctacagaaacttgattgcagctgggtatagcatttatgtaaatttcaagtgccactcctgtttgtctctgggttaacctaatggtttatgttaatctcaatcaggtctgccactcagacctcttatccccttcacctttcacctaattgccaattttccttgaggaccaggctatagaagccctgtctatctcttcttccccttgcttcattcatttcttctctgctgtatattccatctgattgttccctggagcagtgagtggatgatttcatgtgttcctgacacatgataactacatgcaaccgccatgaaactgtgcttcccaaatggtctatgtacacggtcacatggcaataacagggacagatctcccaaacacaatgttgagtgaaagaagcctgacacaaaaaaggagcatcttacaagatgccatttctatgaagtccaaaaccaggcaaaattaatctgattaacctgcgggcagtgtaggggggcaggggaggcagtgagtgggaaggggaagtgaaggtgcctctggagtattggtcatgttctgtttcttgatctgggtgctggttacaagaatgtgttcaatttttgaaaattcatcaaactgaacacttatcatttgtgcacatttctgtatgtaagttatactttaatgaatatttccccaaa

SEQ ID NO: 7666 - DNA, 2246 bp, artificial
  synthetic oligonucleotide
gcttcaggagtgttgtcaaaaactcaattattgataaagtccagctccaaactctctctctctctctctcacacacacacacacacatgcacacacacacaaacacacacacaccaactcaatgttcatatctttttgtgttgtataatggggagagagatgctagcattgcttctagaatcacatcaaacagcatgaggaatcacgaagccatggaaacaacttgtctggttatatgtaaccgtaaaaagaaattggattttgaaaactaacaacaaaaaaccaactggagttttcttatgaactttctcggaattgtattactgatttctttatttgtacttcattccttagttatacatgtatatatagagagagatgtttatagacaaatagatctatatatatatatagagagagagagagaagagaaagttctctctctctctatatatatatttagttatatatatatatttagttatatatagaagtgtgtatatatatatatgtgaacatatatacacacacacatatatatggccctcctaaaataagctttaatggtttttccctcaatttgagattttattcttctgcaaattttgtacatttttacatgttaacaatctcttacacatgtacagcaaaactctttcatatttgttaccttaccatgtcctaatacatttgtgagacaggtaaaagcttccagattcagataaggaaatttgaagccctgaaagattaagtggcctatccaaagtcacacagctaccaggtgttgaaatctggacagtgatccccatcctttgcctctagagttcttcacactctaccacctggatgtgtgtgtctgtgtctgtaccggtgagtaagtgggactcctccactggtcattcaaacctatttggtgtcacctatgctttatcccttccctggatgcaaaccagggctagtacctgtgacttttctggttatgctcagataatataacattatcttgtcactttgggtcattttcagtaaagagtctagtccacttatgagtcaaaatccctatcttcatttgaaatgaaggtttctccatttccccaaccaggaactgtagtgggaaaggggggatggtggtcacctcattctcaagttccataccttgcacttctactcctcttcccaacctggctaactatggtttctgacttcctcagtggcaaagcagggatgaagaaaataggtaacgggcaagaccttgcctgactagcgtggctgtggtaattcagcaccagaactctgtggattaggccaggtgtggtggctcatgcctgtaatgacttgaggacaggagtttgagaccagcctgcccaacatggcaaaaccccgtctctactaaaaatagaaaaaactaaattagcctggagtggtggtgtgctcctgtagttccagctacttaggaggctgagacacaagaatggcttgaatcctggaggcagaggttgcagttgcagtgagccaagatggcaccactgcactccagcctggagggcagagtgagactctgtctcaaaaaaagaaaaaaaaaaaagaaaaagaacaagaactttgtggatttagcaggtgtttcaagctggctctttccctgtgggctgcttcatggattcctcttttacaccctcagtgttggagagattaataatcaaaagccaatttttaagaatctccttagtcttggggtttcagctgcaactgagataaaactagttttgttgtaacatcctgttacatgtaaccgatttattcattcacaatgtgaataaagaccatgagctttggagtcaaaaagacctaactataaatcaaggtactgccactcactagttgtatgaccttggaaaaacttttctaccatctcttagtctcagttttttaatccgggcattacaatacttactttacaggcattataagattacttgagataatatatgttaattgcctgggataaaatagacactcaataattggtaatagaagtagctgtttttgttatataggcaagctgaccctaatgaacatttccacgtagataatgtgtccctttagcatagtactacaccctcttttgcttcccgatatcctaaagcttacagggttcttctcactttctcactgtgcttgaaatccttcactaggctattctacctaagcctcacagccctgcaaatggacttttttccagattgtaa

SEQ ID NO: 7667 - DNA, 1379 bp, artificial
  synthetic oligonucleotide
gtttgtttttgcttggcctctaggggcagaaagaaagagggaaaagatccagtatccaaacattccaggatgatagctggatactgaaggtgtccttgaaggaaaatacaataaaattaaaagaagtataggcatctgaaggcttaaggtgcatcagcttcaacatttgaaatgccactgtagttgtgttgaagtgtgttaacttttaaaatcatcacctaacctttcagggctttgtcatgagagcatttaatacaaattcgtatttcagttgcataaccagagtccacttctcagatatttctggcccaagtcaaatagtcacagcactatttgagagtttaggtttgctggatggccgaatctaaggagatcttcattaaagtcaatggagaagaaaattaagtcatttaaattgctatttctggagttgtggaacttgaaagtgtccaaacaagaaatattccattatttattatggtgactcgatttgtgcctattgaggtgcttaactagtgctcttccatctttcctacgtggtctgtgctggtagcatgtccgaggaagggaaaggtagtacataaaataacagcagctctggggcccaatactaattattgttagttagtgcaaagtacagagtgacgtaaagagttaaatgactgatcgcgagctgaaattctaaaaccatctcttgcccaacaggggagaagacttttctggagtttccttctttctttcttcttccttattagaatagccctttggacccaggaggattgcactactgatggtatcgttcctttgttggaaactaggagttgtttggtaatgaaatggctgcttgagattgacagggccccatatactgataagaaggtttaactagcttctgctcctttcactcaatatttgtcaattatacctcaataaaacaggaaaacaactactgaggtaaacactggaaaactactctattatctcttaaaatttggaatccccaactcatctttgtgatatcaattgtagtctaacctacatcctggatagcagaggttcttaatctgagtttaaggaggtctataaatcccttgaaattatatggaaccttttgtgggtaggtatacatctgcttctttcctgggagaacacatagctttcattggatttccaaaagggtctgtggcctcaaacggactaacagtaatttctctgtctgcagaaattggaactaaccatcatgtttcctttctgtttcaatcactttgcattaatccaggatgaatgctacataaaccatttctttagttctcacaaactccttgtttctgagagcatctctccttccacctcccctgtttgtgttcttctcctgacag

SEQ ID NO: 7668 - DNA, 1158 bp, artificial
  synthetic oligonucleotide
tcataaggaaatcagaaatgatgatgaatcataaactgttgacactcaaaagggcctcagagaccatctatcccaagccctttttatagatgaggacattgaggctcagagtgggcaattggttgacctgttaagatcacacagtggaaagcggcagagccaatattgcctcttcttccctctccgtctgtctgtctttcagtctactcactccatttttcaagctagcccttcatccctaaagcagcagccctgacgtctcatggattttctcagtttttgcatagagtttgaagggcagagcctcaaagcatgcctttctgggtgaatgtctaaagaggctgagaaaaggagtgacaggtaatccaggcaaatccatgcttctgacatttatttgttttgtttccatatatatatatatatataaaattttatgcctctaagcagtaacatttaaggaatatacaaactctttggaaccatggtaacatttacttgttttaagatttcatcaatgagtttttcttctcaaaacagccctgagaaatgggcaggcacaggtagatttgaaggttattttaaatgcagctctccttcttggaatatgtgaacgactcccctgatcaattgccttgctttcaagtttataaatgatgctcaggaaacgtcttcatggaagactgaaccaagaggacatctaggtgaagaatggatgatgccaaagggctcacttactgtttccatttgtctcgggagatgagcttttccctgactgctttcagcccttgagtgaggaccgattagtattggttgaagaggcttccttccttggttaggacttcctatggctttgctgggtctataactaggcagtgtgtgtggcccgggggtgggggagggcggggccgaggacttctataacatcgtgaactggcaaaatgcacaccacaggttttccaacaccatatcacgtcatagggttaattatcccacacattattgttgaaatggaaggatttcgtgtctggagccaaggacaacatatcacccacagatctgcttggagccacagttgcccaatgtgtggagagaaaaaaccagtaatagtgaaaagagcaaataaaaaacacttgcaaacctgtttcattcaaagagcct

SEQ ID NO: 7669 - DNA, 6228 bp, artificial
  synthetic oligonucleotide
ttcactatatctttgtataactttatgaagtaggtactattattatctgcattttatgtatgaggaaactagtacacaaccaggttaagtagtttacccaaggtcacatgactaataataatgaaataaaggattcgaacactgacagtggctctagaatctaaaatctcagccactgtgttaagttgtacatttaaatgagacgtattgccagtggacaaggaagcgcagacctataagggcaaagcaagtgagaaagggcttggaactgaagacagaaattttaataaatcaggaaaattaccttctcagtcctatattgctaaaaaactcataacccatagtcatactccacctgaggcagggattagaagatttttgtgggggataatctccccacatctctaattgaagatgcctacactttttacctctattgaaaagggaagtatataatttccaaaaagataaatttgaatacttgggtctaaaatatacgatgttattcagaaggattggcaccttagatttatagtatgacttgactagcataagtcaaagcatagttctgaaaatggcatggaaaagggtggcagggatggggctttgagagtgaagtacagtggggatcagccagtaagcacatgaaaggaaaatacaaaggctatttccagcggaattctcagaaacactataggaaattaatacaagagactggcataatctcacctaataaaaccaggagcaggtgtgtgctagtcctatagtcaaaacaagttaataagattagtctacagtacatagagggcttggagattgcatggcttaggataagtaggattcggttttcattaaggatataggaaaataaggaactttctgttacaactgcagatccctcattcaataagcatttaccttgaatgcctactatgtgccaggttctgtactaagtgttaaggattcagaaatgaaagggacagacacagtctctgccttcatggttttacagtctataaagcaaacatttttaacatcacaaataaatatataaattctgataagtgcttgaaggaaaagagtggagttttatgaaaaatgctaattatgaggctaatttagatagaaactttggagtcagctcccctgagtcagcgaaacttaagctgaaacctgaaggaagagtagtagttgaacagatttggaggtgaggttggaagtgaacatccaggcacagagtggagataggagagagtttggtaacattctaggaattgagaaagcttatgtggttacagggtagtaagcaatgggtagagaggctcaggattaagaatgaacaggtggggagggaccatatcatataagtcattgtagaccgtgaaaagagtctagattttattctaagtacaatgggaagtcaccattgaggattttaactgggggaaagaggaagtgataccaaccaatgtgtagtttagacatcacaaaactatatacaatcaagtcctgaattaagaagcacagattatttcctgatagaatcagtgtgagctgcaggaaaggcattaatcatggtgatggtggccggtgggtgggaagtgatcttcaactgagccttgatgggctgtatgaggcaaagccatgctgaaccagaatgatgccagtgtagctaaatagaagaaggaaatctgcaagaaatgaaacagggcttggagaccctttggacactgggtaagaatacagaacagttattaaaagttccatgatttggagccattggacgtggaaaaaatggtatgactattcagataaatgagataagagagatgaggaagtggattgctaaagaaaattatcatttccattttttaaatgtcgatcataaatgtctgaggaccaaaagtgtagatgccgtgctggtgatataaaagattaggctggaaatttatttaagaataaatggaagtgaaatgaaagctgaaattgagcgaaaggagcagggtacatcaggatggaaggagaaaatgaagtcctggaaggagacaccaagagaacactcagtggagttggtaaagaactcagatagatcatcattgcaaatagtcaaacacagccaaatcaagatgatgcaagtgaagactaaggaaggaacactaaatttacctaccttacagaaatgtctatagggtgatgagtacaaggcattaaagaaaaaaacaatactgcacttagaatgacaacattggatcagattcaccctttattcagactgaggagtcactaagaactgtgtaatgtcatgttgatcattcttatgtcaacttcctgtatcagggaagaaaattttatgttttacttttgccaattcttgaataattaattacttcaaaaaactctacttcctgctttgtaaagtgagtgagacttactttagttagcaagaacgtctttattttaaacctcaggggtacccttctgcccaacattgtggaattcagtaaacaagttttgtcaagaaagaaccccaacctcatagaagatgtcaagaagtaacaagactacaaaggagattactaaagcagcaggttgtctttgtcttgtcacaggtgccaaatgtagacaatgagactcaatggatcacagcaagaaggttgattactcacagcacaggaaaaccagcagcatcaacatgtagcactagcacctttaaatccaagtcccatgggaccatgcaatgggcccagatggtagctatgtgcatagccagttgtgccctaggctgagggaccaagagttaaaggctatgcgccctggtagcaagaaataaacaaaccagtcccccaaacctacagagtgagtagttccgtagtagtcactctgacattgcctcgacccactcagttgcctacatgagtagctacagaaactgcttagcgtgagaggacaataaggcattgcagaatgtcagtctcagcaagggtgcataggaatgctcagagcccatggcagactgcctcttccaaaaaattggaattcaccttatctgttaagcattcataaatcagatacattttggttatcaaaagtctcttttggccaggcgcagtgactcacgcctgtaatcccagcactttgggagtctgaggcgggcaaacgacaaggtcaagagatcgagaccatcttggccaacatggtgaaaccctgtctctactaaaaaaaaagaaatttgaaaattagctgggcgtgggggtacacgccagtagtcccagctattcgggaggctaaggcaggagaatcacctgaacccgggaggcagaggttgcagtgagctgagattgtaccactgcactccagcctggccacagaatgagactccgtctcaaaaaaaaataaaaataaaaataaataaataaacaagtcctttttgtctttattctttccagaattaaaaattctaatcttataagtctgtcctcctgttgctattagcactccccttcccctcagtaccccaaacacccaaacatcttagtcattttagttccttcctctggaattttttccatttttctcaatcatctctttctttcatatggaataatcgctgaatttgttcccagaatttcatgtctagacaaaccgtagtttggagcaggagtcagcaaaattttctctaaaggtcctgatagtaaatattttaggctttgcaggtcatatggtttctgccacaactgttcaaatctaccattgtagtgtaaaagcagccatagacaagaatacttaaataaatgagtgtggctgtgttccaataaaattttattaatatttataaaaacagactgtgggctagttagcacacaggccacagtttgctgaccctggcttagaaaatagtaagatgttttgtgtttgttacaagaacaaagttgctgactaatatgtttcataaacatagatgcaaatattcttcaaaatatgagactttaacaccccactgtcaattctatccatctaacaaagggctaatatcaaaaatctacaaagaatttaaacaaatttacaagaacaaaaataacaaccccatcaaaaagtgggcaaaggatacgaacagacacttctcaaaagaagacatctatgtagccaacaaacatatgaaaaaaagctcatcatcactggtcattagagaaatgcaaatcaaaaccacaatgaggtaccatctcacgccagttagaatggcaatcattaaaaagtcaggaaacaacagatgctggaggggatttggagaaataggaacacttttacactgttggtgggagtgtcaattagttcaactattgtggaagacagtgtggtgattcctcaaggatctagaaccagaaataccatttgacccagcaatcccgttactgagtgtatatacccaaaggattataaatcattctactataaagacacatgctcacgtatgtttattgcagcactgttcacaatagcaaagacttggaaccaacccaaatgcctatcaatgatagactggataaagaaaatgtggcacatatacaccatggaatactatgcagccataaaaaaggatgagtgcatgttctttgcagggacgtggatgaagctggaaaccatcattctcagcaaactaacacaagaacagaaaaccaaacaccacatattctcactcataagtgggagttgaacaatgagaatacatggacatagggaggggaacatcacataccggggcctgtcggggggtcgggggctaggggaggatagcattaggagaaatgcctaatgtagatgacgggttgatgggtgcagcaaaccaccacggcacatatatatccatgtaacaaacctgcacattctgcacatgtaccccagaacttaaaatataaataataataataataatatgagcaactgaatctagcaacatatagaaaaggttatataccatgaccaagtaggttatcccaggaatgcaaggttgatttaacattcaaattaatgaatattattcaccatatttacagaataaagaagaaaaacatagaatcatctcaaaagatagagaaaaagcatttgacaaaattcaatatccattcatgataaaaattcccagcaaactagaatagaacatactaaaactaataaaagtcatttatgtaaaatctatagcaaatatgcttactaataaaaagactgaatatttttcctttaagatcaggaacatggcaatcgcttgtccctgatcccaccatttttattcaacactgcagtggacattctagtcattgcaaagcaagcaatggagtgcatataaactgaaaatgagaaggtaaaactggctttattaacacatgacatggatgtgtatgttttagaacattctgaaacatttacaaagtggtaatagaaataataagtgaatttagaaagataacagattagaaaggcaatataaaaacaatttatttttgaaatgaaaatttggaaattggatttttaaaataatccaatttcaacattatccaaaaacatggcatacttaggaataagtttaacaaaatatgagcaagaccagcacacaggaaaccgtaaaacattgccaatagaaatggaagaaaacccatataaattgagagatatatcatgcctatgcctctaaattgataaaaattgatcagtttagagttctcccaaagtcgatttatagattcaatacgatcctaataaaaactccagtagacttttttgtagaaactgacaagctgaatctgcaatacatagggaaataaaaagacatagacatttcaaaataatttaaaaatttaagcaaacaaacaaaagaggacttaaactatctgatttcaagacttactataaatgtacattaattaaaagctggcaaattagctgggcatggtggtgggtgcctataatcccagctacttgggaggctgagggatgagaattgcttgaatcagggaggcagaggttgcagtgagccgagatggagccactgcacaccagcctaggccacaagagtgaaactccatctcaaacaaacaaagcaaaacaaaaagagcgggcatttggatgaatggaatagaagagagagtcaaaaaataaatccatacatactacctgctcgattttcaaaaaaactgccttggaaattcaactggggaaaggatagtgttttcaaca

SEQ ID NO: 7670 - DNA, 1286 bp, artificial
  synthetic oligonucleotide
ggatgactgcaataaccactaactggtcttgccgactctacccttgacccttacagtctattctcaacaagaagccagagtgagcttgtgaaaatgtgaacaaaatcatgtcatgtctctgctaaaaatagtttaggggctactcactgctcataggataaagaaaaactccttcccaggcctaaaaagtcctcacatggattggcctccatctgcctccccaggctcctgttgccccacacttctctttactctctccaagccccaggcggtgcagtgtagtgctaagagcctagattctggagccagactgcctggacttgaattctggcttgaccacttagtagctctgtgaccttgggcaacttacttaagattcctgtacctcaatgtcccctattaataaaatagaataataatagtacctagctcatagataccaactcaattaagtgaatttgtatatggcaagttcttcaaatagtgcttggaatatagtgagcattgttattataatgcccagctcagccctgcctcagggcacttccacttgctgtttcttctacctggaacgttcgcacaccaggtcttcattagacaagcactttctcattcttaagacctaagtgcaaatatcatttttgccaaaaaccaccccgaccctcccatcccgatccagtcaactctattacaatgcttggttttattgccttcatgacactcacaatttgttaaataaatgaataaatgtactgtcttctcagggactgcattaggacgtagttagaaggaggagtggaaccttgtaaggctctttgcaacctttactggtgtttaaagatcagaaacttctgtttcagaaatctatttttatgctgcttgtttattctataattgtttccttttatttccccttagtgattagtaaagttctcttggaaaatgtcagttctcccagctgtgcaaaggaaaacacagaaaggggtttttgtacctaactggtcctgagtcagaggaactagaagggggagcatgagagtggcattcaatatccaagaaagagacccccaggagagtgaggaagaaccaaggactgagggcacggcaacagcctagcggtgcttcttcggaaaatcgtcatgctttgcaggtgattgttttaataaagaaggctgagcccttaccgctcccatctgtcatggccatggaacaggaatcccacaatgaagaagagggcttcacacattgcttggcacacagtaagcatctagtaactaaacatagca

SEQ ID NO: 7671 - DNA, 8887 bp, artificial
  synthetic oligonucleotide
tctctaaatagggctaatgagatgtgtggttagatagtacatttgacttggtgttcacagggttaacctgcatttccattatcacaaaatgcctaatgcatgtttgcatacttaaggtgttaatacatattatagttttctccccctttttgataaaagagaatttaataaaggtaaccgaattaccgagaaatataatccaaaaatatgtcttggattttaaattattggtgaacctaactactgagaatgtaagatgtgttcggaatgtttaggtcaattccagtccttaagctctgtaatgaacagcagtaggtcttttttttttttttttcagcagtaggtctttcactcactgagaccaatgtgatttttttcctaccttgcatctctatttcagctgaaaggaaaaaaaaaaagaaattaaacaacaaatggtctttttgtttatcacttgcaagttgctttagacaactggctttttgtccagttgtcttgtttatctctccctgtgttatggtgataacccaagcattctaaaatcccatctgcaaaaccaggtgggaaactaacacaccattactacattcctctagagcccattttaaagaagactttcacagaaatagataaatcctttctcccttccaaggccaacataactcagggcagcgagttcagacaaaaatttcatttatggttgggttgcctaatcccatcccctctcctaaaggccagtatacctcttgagttgtttgatgttttgagagaggtccctaagttgagagacagatatcaattgttttatatacacataacacacactgagtcagagaagtagaaagaagtaactcagtgggccagtgctaaaatctttgcgaaggagatacaggcacccgcgaacgcgcgcgggcgcgcacacacacacaaacacacacacaaatacgcacacgcacagccaatctatatggcctagtgccttccctcaggctgtctttttctactctctttttgcctggatccacgtgttgggggaggggaccagagacaaagttccgcagtgctttcctccccctgcaactcaagcgaggaggtcgggacttctcctcccctccccctcccaggaatggccctaagcatatctcctccagctaaatcctccttcctcacccaagtctgattgatgctaactaatgtcgagttagttcctttaaagaagttatcttgctaccaagtgtgagccagtccataccggaggtggaggacggggggcgggggcccgggggcggggggcggggagagggggacgaggacggaaggtgaggaaatggagctgggagtggcacctcacaccaaacaaaaacgacgatcgttacattgtatttaatttctaattaatcctcaagagaaatatagccgttttccttaccaatggatccctgttcttactgtgggtatctcgcgcgcgcgaacggtccccaccttcccggagcctcgcagctctaaggagagcaaggagtccccagataactatttagtataaacaaaccgtgtggctttaatggaattacctcagcctgctagtaaataatttatagtaggcagtaaataaaatatggttttacgtctttaaaagagttgtcaagtggaaaacacccaccagagggacataaaccccgaagactgccacgcttaaagacgccggttgggatgacagccgggtggaaagacatgattttctaccccgaaggaagacgcgggtgctgccagagccagagcgggcagctctcaaagaaggttcccgcatggagaaggagcagagacagcctgtctttgtcacttagcagaggggcaacggattaaaacgcaaagggaggaggtgcactctcataatggtaccttctacttaaaagcctagacgctctcaaattcgttatcacacttaatcctcgccaccagtcttccagaaagaccaggccggagccgtgtttcccattttgccgatgaataaaaataaggctcagaggctaagggacagtggctgtgtatgcttgctgggcactaaatgggacgcgggaatctaggtttttgcagctctggcccgcgcagttcttcacccagtgcccccaggagtagctcgcctctgacacacacacacacacacacacacacacacacacacacacacgcagtccagcccagcacacttgcccagttttacaacactccggcatgtcttcttttttcggtgacctgagaaccctctaattaaattttctgcccccctcttccacgaatcacgcccctggaaggctcatccccaattcagagaggaagaaagatttatgagcctctcctcaaggtttcccccaagacaaccttgaccatgaaactagaatcttgaacacttgacctaaatttccaagggcatctgtttccgtctgtaattgtcaccaggcttcatttgaaattcgatcctgtgtcactaatggtattaacaggagctgaggtccaaccttccaacgggagactgttgcatatgattttacatccaaacgaaagtaaatcagtttctataaacctgcagcaaccccctccctgagtacaataaaactgttgtcgcaatcaataaatctctggtttggggcaatgaaaattagataactgttctctctctctttctgtctcttctccccacccccccacccccattaagacaaagccactattcaaagaacggggcgtcttgttaaccatttctgaagtccctcgctgtacccggcgcctttcagacacgcacctctcagtcataggagaaaaccagacgtttaattacggtgacttttgttcgatcattacggataataaagacaaccttttcgctagataacaattataacgcaagctgctccaacacctgcacggatcgcatttgtctccagcgtgtttttttttgtttgttttttgttttttttttttttacttctctaaactgcctttgaatttccccttctcttctgaccagaaaatttaatatgttgcaagagatagatttcacgaaaacgcgttgtcccttctgtagctacatctgctccgacctattaagaaaagtaagacattttgatactaattgcaaataaattgtgatgtgttcaccgagtaattgatttaatgaagttcatatgaaactcctgagattggccaagtgaaaggccccctggtgcttctattgtggagggaaaggaaggttggtttttcgttttctttctttaaaaaaaaaaaaatagaggtggcttggagggaggaaggggatgggggagggggtgggcacagatgttacctccacagaggcagctccgtggcgggaacgagcagccagatagtccctccctcccgtcggcgtcggccgctagccgccagcccggctaaacgaggcgcaggctgccgctcccagcctcgggccccggcagtcggttgagcgcaattcaggggcaaacgtgggccaaggagagggtcagtgcgcgggccgcccgcgtcctccgagttgccaaagttgcacagggcgctgcctccggatcctgttccctcgcttcctgaagtgctcgacgatggcctctaaacctctttatccggctagaggcccagaggctaggaggggcccccaggcggctctcccctgagtcccggcgcccaggtcccagttgaggccaggggagagggctgcggtagctagcactacgccactccgcgtgcgggccagggtctccaaggttcgggtcccgagctcaccccacaagcaagaatatacggacaataaagccgccttcggcctcacgggggttttccttttcaacctttctggccagccacgtcggcgagttaaagggccgggcgtgcatgaagggtacagagagggaataagacttttctgaacacctactgtgtgccagacccagtgcttcacaacagttccctttctccaagcaacggtgggaggtattattgctccctcttaacagatgtggaaactgagatcggacccttgacagcaacgtgccaacaatgccctggctaccctgggccatcaacaagcacggctcgtcggaaaggagaaggcagattcccgcaaaactgtccccagtttgccccaaagccctccaaatattccccccggagcatagggatacaaggcagaaactgccgccgggccccgcccatatctcctagttggcggagcacagtctcctgctcgagtttgaaatttttgtttcgttttgttttaaagaaagaagacctcttttgaataatcagagccctagctgagctagcgagtggctccaagctcctcggagttgccctgcagatgaactttccctgagttcttcctcccgggtcgcgggtccccctaatctgggtcccaaagtgcccgcaggagacagcggtgcaagggtggtcatgctgactcgggtgtcgggcgccgccagaacccacaagccagagtgcgtgggagacgggggccggagggatgccccctccaccctctcagcccacttctgggaggccgcacccgctctgcgccttgaagagaccgcccgcagcgcgaaggcgggtcctcacccgaggatgtggcgaaacgcttaacacccaggcaaatgcaaatggtcaacgctggggtctgaccgaggccaaattatctccccaagaggcaaaagcaggcgcgaatgaaggcgaagagaccagcccctcgctttccgtttcgacatttgcaactgtacagcgctccacccccagcccggggggaggggggctgggaagccagcagggcctgcctgggccgggccgccagaatgccaccttgttctgggtggaaactggacactaagtgcccagcctgcttcttccagggagctccgacaccacgctctatcagaacgtgtccggcgctggcccacccttgccgctgctcatggcccgccgtattcgttgttcggcccgaagaacttccccttttgctttgatgcgggcttttcctatgtttttcgggacccagaacgaggaagggctaggccatctcgccctagcacgggggaacccagctagatgtccttgaccccagggttagcgtttctgggacccaagagaggtctcatggatgtctgggccccttccctcacctctgggtcctggagtaggtgaactggaagcaactctctcccgctccatgtgacaagtacactttcttgggtcgcaagtccgagccctcccctcctgttcatcacaaacggcggccgcaagggcccggggcgtcgaggaaggggtgggctacagcgccgcgggctagggaggccacggggcatgggccacaaggatcttcgggattgttgagggaggcgcccgttgggagagaaaagttagaatctgagcttggccagccgggattgtttcgggatgaccttttcttcccaataagtgggcaccagctgctgataaaggcgggagagggacactcagcctttgtgaacactttccacattcctggggccaggagattgacaggggccttagagggtatggagctcgcggcatcccgcttagtttgaagttgcagccttcgcaccccaagacttcccccttccccagggatcagctgcaaccccaatccaggcggcccgctccccctgccgcagcgccccctacggtctggaggtgggccctgaaaggttccgacgggcgcggggagcccaggggtgggggccggggaggccgagggaagctggtgtgctccggtccccgtctgagaagcggtcacccgctggggcttggcttctgaaagtgcgatttaggtagctgggagtggagatttacgatcctggaggacagagcgtgaaagggttatcatcatcagttttgactgaaagaaagaaaacatatctttaacaaaaagaagggctcttgccattcacccgcgttgttaggacaacgtgaactatccttgaaatgattagttccacttcaaaggaatttacattcaacagtgaaaactcagcctctttttatttattcgaaaagacttttcactacggagaaaagtctttcctgctatttatttttccgcgttcacggtgcacttgtattaaatcaacagagaccgcgcaacgcactcagtatgcggaccagtccagggttccggggacgcaggggtacaggtagagcgggggagggggttgttggggttggggtttgcaccacgcaggcacctgcctggcccaggggatggggtgggaagcagtggatcaggtctggggccgtggggggaatgcaaccgaagaaacctcacccaagcccagcccaagtgcagtaatcagagattttgaatgctcgcgattctcatagagcctggcactctctacgtcatttgtggagaaagtggacctgaagttccccagcgacaccttaggaacatctgttaaaaactgatcaggttggcgtaacttcgctgggcaaaattaaagcctatctccacaaattgagaagacaaatcccacctcttagtagcttgggacgtttgctcacacacactctctcagggcccacacctccgcgccccaccccccaccctcaggtcgccaattgtcgccaaatccaggaaacctctacccaaaggaacaacagcactaagtttacgagcggcgcgtcctcccggggcgggggagggggcgggggagggggtggggagttggggaatgctacccctctaactgtccccggagtgccttgagctgtggctggaatacttcccacctcctccggaaacgagcagcagcaaccaactctcagcttcacctcacacacccacccgcccaaccccattcccacctcccgcagcaaaatcttttcttcaacccagggctaagtttttctcaccaaggacaatgatgttaagctttcccttgatggtcttttccagcttctaattaaataggaaaaaaaaatctgggttggacattggattcaagtttttctaccattccttaacatatctggatttgtacctggcaactggccccatatcttgaaatattgtcaacatgaatcgtaacagttgtcctttctaacacagtttttggacggctcctcagtaggttcagaagcagtgaccacaggctgcttggctgggagttaaaggtggccgctgtttgccacctggtaacaaaggtgtaagttggagcagtgactggggcaagcccttattctcctgtgtttcaggttgaataagaactcaggttttgttcaccattctggagctactctcatgttccttcttcctcctggatcttcctgggcttatttcaccttcttggtctgaaggtttcctttgtttcttctcttgctcaaacctaatcctgaggcatcccctgctccctctctatctctatcccctgctccctccctatcatctcctgttccctctctatctccctccctatctctctaaatctctctgggacatttcctgtccttcatgaggaatcaaactacagttacacttgagtcagaatcccaagcaggaatgtggatttgccaactctcccaggtggttgaagagaatgtgcagagaatcatgagattccaacccccatccagccccattcccaactagatctatgccttaattctaacactgagctcctagagactttcaaatgggttgatgtttgttccttagtggtatctacttttctctgcaggtggcaaacaaattccagtgtcagcaccaaggtctgtctttgtggggttgtatgtagctttagaggtgcctctcttgatctcaggcagtgaagaaagaaaaaaaagaaaaagaagaaagaaaagagagaaaggggaaagaaaaagaaagaaagaaatagaaagacaggaaggagggagggaaggaagaaagaaaggaaggaagggagaaagaaagaaaggaaagagagaaacaaaggagggagggagggaaggaaggaagaacaaaggaaggaaggaagagaaagacagcaagaaagaaggaaggaaggaaaagaaagaaaggaagagaaaaagagtgagaaggaaggaaggaaggaaagaaagaaagaaagagaagaagaaagaaagcaaggaaggaggaaaggaataaaaaaaggaagggagggagaaagcgaaagaaaggaaagaaagagagagacgagagaaagaaagaaagaagggagggagggagagaaggaaggaaaagaaagaaagaaagaggagggaaggagggagggagggaaggaagagaaagaaagaaaggaaagaaagagaaaaaagaaagagaaagaagaaagaaaaagaaagaaaaaagagaaataaagaaaggaaggaaggaaggaaagaaataagagaaagaaagaaagagagagagaatatgagaaagggagtgggaaaggagaggccctgatagaaagcaatgctgggagagtgcagccaggcctccagctgaaaaggcttgagaatgagaggcttgcagctcccaaggcagctctggtggggggagggtaggaagaggcatgtgagaaaagtgacacatcctaaagcacaccccaggagagctagggatctaggaagcactcaaaatgtatttccaattacttttcatgctctcagaaaaggggctccttttaagttctattttaaaagcttgttattgtactgagttatagtccacattttaaagcactgtttatatgttttaactttttatgtagagtgggaggatggtaaatgttagaaatgtagttttctgaaaaaatatgtagaaaatcagaacttggaaacttctttaataatagcttctttcctcattataaggactaatacaaagtatcaa

SEQ ID NO: 7672 - DNA, 2008 bp, artificial
  synthetic oligonucleotide
gaagctcgagaaagctgctattgatttctgtagcctcctacccaagtgtggcaatgctcctagtgaatattgaaggcatattgaaaggccactttcctggctctctctgttctctgttcactgtgtgcatttgcagtcaattgagaggcatggaattatttggctgattaaagaatcaactaacccaaattgaatggttttgttgtgtcctttttcatttgattcagctataaaagattaagtaaatgcatttcctctccttcccaaaggtgcaaaatctcgaatgcatgccagctaactgttttctcctatgactaattgatgttttgcactcacagccttgaaaactaatcttttccatgcccggtgctagttgtaatgagatatattatgctgacagcttgaacctttgcaaaggtatggaactcagcatgtaaataattgtgtctgcaattttaaaatttgatataaatggtgcactgttcgaggtgaaggctgtgcttgccagcacttggccagctgtgccccaaagtgcaactcagccactgtttggccctagcagcctttaaccagccatgtgtatcctgggctgctgcctaactccctggcatagcacctagcacaatgcttggcaaatggggattagtcaacaaatatttgtagaatgattgaataaatgaaccagtacaaaaaaaatcagtctaaatagaataaaagtttatttctcaccgaaaaaggaaaactaaatgagacagttccagacaagcccacaggaggctctgacagaactcaatccccggtgtggtgaccataggctattggttgactcacactggctagccacagtgtgcaaatgaaatcctgcattttcaaatgagtatttaattttttttctcaaaaagatctggtcatctccctaatactcactaattattagggaaatcctgcattttcaaatgagtatttaattttttttctcaaaaagatctggtcatctccctaatactcactaattattagtattagtattttaaattctggataagaaagtaaaaaatcatagtgaaaaaattatctaaagccataaataacagtgtttcaggtatgaaaagcataaaaacaggtcaactcaattggaactgtggggcagtctcctggaccgaagatttaggcaggaactgttgaatggtacggaggtctatacaagagccctaaaatgatccctaccctttgacctggtaatctcacttataggaatatatcccaaggaaataatccaaacaacaaaaggtaattttgtaaggatatttatggcaaagccatttataataggagaaaattggaaacaacccaagtgcccaagagtaaggagactggctaagccaagaatatcatatcaactatgtggtgcactgcacagacattagcgcatcgagcaggtggtacgtttcaatgtgtggaaatgtctacatgaaatcatgttaattgaaaaaagcagaacacaaacgattatgtgtccagtgattacaactttgtgaaaatgtacctgctattttgaaaagggtcaggagggcatcgagtgatataaacacagctgtaggttcattgaattcgttttctgcattgtggatggttgtttaagtatataatgtataaaaaagaaaggaaggacagaaggaagaaagaaaaaaaagaaactactgaatacaaaccagagctgctatttaaaacaatctgtcatttagatgtttatagattaagaacaccagagagaaatacaagtgggaaatcagaaagacccaggaacatctaaatggtagtctatatgcctaatagaaagttgaaattcatttggagcaagatcccttctgaatgccttgcagcattggatcaacaattggaagccataatgacaaagatgtgctcagactcctacagggaaagacaacttcccatggccagcaatgtttgttccttagcaaaccacttctcaagtgatgatgtcatc

SEQ ID NO: 7673 - DNA, 492 bp, artificial
  synthetic oligonucleotide
gatgacttcatgaatatgacatcaaaagcacaggcaacaaaagcaaaaaaaaaagataaattggacttcaccaaaattaagaatgtttgtgcaccaaaggatactattaagaaagtaaaaagacatataatcccagcactttgggagaccgaggcaggtggatcacttgaggccaggagtttgagaccagcctgggcaacatggtgaaaccctgtctctactaaaaataaacaatgagccaggcgtggtggcgcatgcctgtaatcccagctactcaggaggctgaggcaggagaatcgcttgaacccgggagacagaggttacagtaagccgagatcatgccactgaactccagcctggatgacagagtgagaccctatctcaaaaaaaagaaagaaagtaaaaagacaatctactgaatgggagaaaatatttgtaaatcatatatctgataaggcattaatattcagaatatataaagaattcctacag

SEQ ID NO: 7674 - DNA, 8352 bp, artificial
  synthetic oligonucleotide
aatgaagtgtgtgtgtgtgtgtgtgtgtgtgtgtgtgagagagagagaggtgtttgtggtaggctggagaggccaaactggagtcctcataagctcagcctggcacagagggtgagagtcagctaaaactttgtaggaatggggcattttgaggtggggacaggacgggccactgttccccatgcctagatagactaacagctgaagctactgttttccccagggtatcattgggttcttgtcacaaagcacctcaggacatcccagaccagcgccagacatgcataagtactagagcagtacttattcactcactcactcactcactcactcactcactcactcactttctcttcagcaccttgccttgagatgctccagcgctgggcttttcctgctttaacctttccaaagcaaaaaaggtgtgctcattccttctcctggagctagggaccctcgagtccagactgaatgcaggctgcttccgcgaagagacggtggaggtggtgctagcaggcacatcgtaattctttcccaaacgttccttgtgcccaagtcttccggaatggctccggggaacccagtctaggtactaccttatttacacttgacctcgccctttgaagacccaagctagatgtggacccaagcgccctcgaaataccaataatcatcgccgggagctctggaacataaggcattttctgaacagcctcggtccctcgggccagcgactcgcaagctgccaggtgcgtcctgtaactttccctcagactatgcgcgttccccggctgggccgcagcgggctcccggacagtgccagagtcgtgctctagaggctgctcgcaggaggtcaggggacttcccagcaagcttgcctctcaccacgtaggcttgtagcacaccggggacaagctgggtaaggaagcgacttcgatctggctggaagcagatgttaatggtgtacaactagttgaacatggaagtctagaaaaattacaagcacaaaaggcagagggccagttggtgcactgggcaaagagaactgagagagtgagcggattgactttttgaggccagatttgaagatatagatggggcagggggacgtgctggagcccttgagaatcggaaggcctcctgtgcatagcactaagtgtttgcaccaagcttgctcctggatcctcgatcctggatcctcgaccccaaggagggaagaggacacgtttctcccacccacctcttggcttgggatgggatgggcagtgccgaggcaagagaaagcgacccgagaaataggtgcgtggtaggaggcggcggctgggactgctgcgcaactgcagggtagttgggagcactacagcgccagaggagcgtcccgcccggcagggacttagcaggttgctggaatcctaacctcccgcctctttctggcatgcagagcagaaggggcccaactgaagaaatgatcacgcggctcaggaaagaagctacttgtgtctggtggtctcgactgtcacggtttcacaaccggagagcaagcttagctcaacactggaaacagcctgagggctgtgccctctcgcccttggacccctggagctggctgggtccaccctggagtcagcttctgctttttggcaagaccttggatagccttatttttaaacattttaacgcccccactttttgaagaagcagtccaagagtaaagtgaccctttagtacccccaaagaggggatgtggttggcccctttaagtgaaagcctagggaaggccacgtagaccttccggggggagcctctgggtccccaccccactcctgaaaagaggccctggcctttgggatcgctgggctttacggactagaggtggggtaggtggggaggctgcactgccaggaccccagcaacttccaactgctgctggggacaacttactgcatgggcaaggctctggggacagaggaggtggtaggagagaaagtccgtttagaggaacagatgggctcaaaagaagttttcagacaaacctgtggaatgggggtaaagaggacaagcaggactccatgcatttcccaataaaagtagggtgagtccaagtctacggcaggagaccagttactgtgaagaatgtacagaacgtacagaatgtgcagaaccaacttgtaggagcctaggtgagactggaagccagctccagattccgatttgaatgatgtgtgacgctgtctcttccctcaggtagacagcatacaccttccgagctccctggcctcggccataattgccagccgctcctctgggttgggcctaagagcagccggctcccggaccgcggtggcgcaggcgggctctgcggcgagccggggagagcgcggctgccggagaaatatgctaatggcggcctctccggcacagtcctggatttggtctaggctttctggcttggccctggaactctcagcaaggacgggtcgagtacccaagccgtggagaaagcccaggaagggcacgtgctaggatctcacacctgacccgcggcagaggctgctcgggggtcagacctggcgctggcgtttctttctgctcttccgcctgtgttcgggtagccacaggcttcccagaggcctggagctggtcgcccatatgcgcgtgagtgctcatctcccagtcacaactgttggcaaaccgactactacagccgtcgagttcacacttgaactggtttacgcctggaaatagaaacttcaacgctctcaccccatcctacggagccgctaagcaatatataagaagggtaataacgtattcgctggagacaacaaataattccccacgttaaaataactgattgttttcagaaatttattttttacataaatatataaaacgaattcacgccgatccccattgcacccagcatttgagaaattaccgagtgatctgtagctcagagacagacaccggcgtggtccgagtgttacagcaaagtctcagcacctgtaaacttgcaacactgagacaaatgaaacccctcgcgccggcatccgctggcgcacaagctcctgcggcccccgtcgcttgctctggaactcctagctctgggaccacttccctacccgcagatttcgccaaaggctattgcaaaaacccaccctttgtctcataaaactacaaagagccacacagccagaggcaggcttttcggcaggctcctcagccttccccggagataccggcgagtctcgggtgcaccaggcaggagcaagttttctccttactgggattggggtgcgcctctcttccacccggtggtcctgtgcgcaggggtgtgctgaggagactgtaaaaaagctactaaccggcagggcctgctctccacggaacaaggccacagggagaagaagaggggagcccctgggaacagaagaacacctggcagggctggggtggggattgcagctagtccatgacccaactacggtgtgaacctggacccggaagctgggctgtaagcggagctaaggtttcttctcctccctatagggctagcctaaagatgtagtcattacggaagccaccttttgggaatgaatcgggatgggcagcaatttccgaggggtgtggggtggggaagagagagcgagagcgagcctgagggtaggcgggggctagcaaaaattcggagagctgagcactcccctcgccttcggctcccataaggacccacccctgtcaacaaatggtaagtcctttggggaatgctagagaaagaaactggcaggtcagagataaaggtgcgcctgggcgctggggatggagtgggagggcagggaagggttagtggtccttgtcccgtggaaatcgtacatgtgctcggaaggcttgtgtaattggaggccaaggggtgcttgtattagtgtgcatgagaaagagacagagagacacatgagaccaagaagctgaatggacgtgtaagtcgcactggacgacaatttcaaaatgcagagtttggcttattatgcaaacgaataaatctcacacagctttcacttgttcatcccctgcagaccgtagcggtttgcactctcctggttcaagttcgaagtggaacgggaaacaaaagcaggcaacgattccagcgcggcctgaaagacggaccacaaagcctcctccctcgtctctcctccgggagccgggaagccaatgtgacgatcaaaagcttccacatcgccccggcggggcgcgccctcagccctgtcggggaggtggggaatctgcagaaatctaggtctggaggctcctgccaatttttccttgaatcagaggaaggcgcgggttatagggccctttctcccgtgggttcaccgccgggagaaccaagtttgtatttggccattcagtgccacccgcgcctgccctaaggctccgaggtccattaggccagtaatcgtcccaactggggaaatgaatggttggcctggcctgggggcaccggttccttcctgcctgtgggcgtctctagctgagcctctggttcagggctctgagctctgccaaggcccatgtcatttagtggcccctccggggtggggacggcctctctcggaagggtggggaagtccctcgaaactatgggcagggagagagaagagagaagagacccactgcttgttcaaaaccaagccctaacctaagccaggtctaggcaagacagagacacctcttacataggagtcaccggccctaactcctccccgccatagctctggagaggaggtgcatcttaaagatgatcctcggctcctggtggttgaggtgcagcgtcaggttgcacctggtcttgcctttcccggcgggcgggccaagagggcggctattgagcctcgcggatccaggccctagaggccaggaagaggagatcgcgcggccttgataagccggatcaccagcagtgaccctcgttgacgtcggggtaaccccgctaagtgaccgccacgtgagaaagtctgggccgctcacaatgcgccggcgcctcgttagggccgggcgggcgctcggggagccaggccagcagtgtccgcggcctcatcattcattcccctggacgtgctggtaaaaatgcatcaaaataggctgcggagcgcggtataaaagcacagcgggatgagctgctttccaaaaaggatctcggtgattggaccgagctcggcgtgattgacaagagcttagtttggtaaagggaagacacgcaagctttcacagcaggagcccttttctaaaatatatcacactagcctttgaaaagcgccgcacactataaggaaatagcgtttcacggcttgctttatggtgcgatgacatttctttaaaacacagcgaagatcaaaaaaaggagagagagaaataaaatgtgttgcaaacacaatgttttaattagtttattctgcgcgttgcttttaactgtcgtatacattgcgggttttcctttaattaaacagtccctctcgagcggtggcaggcgaggaaggcgaggcgctgcgccctttcgtttccttttggaaaaacgagaaggttggctggccccagagcccagctcgcaggctcctgtgccctcgcggccaggataggcagactgaggcgttggggcttcggaaagcggcgggacccgagcgccccacggaggcggagaaggaggggacgaggaggaaaggaaggggaggaggttctcccccggggaaccgaatgggaccaaggcagtgcgagtagctcgggcatggcgccaacctccaatcccctccccacgagctccagccagcagccggtgtccccccgcccccctaacccgcaccacctttccaagccctctctggtcgccagggtggtggggagcgataggcaccaggatgagccctgcggttctggccgtctcctcggctttcgggctccgatttccagctacttagccctctttggatcccaaagtagcggattctctgattcctgacccacaggaagaagagactacgcaagcatccgctcgccgaaagcgcgggcgccgcaggcgctgtcaaaagtggcgcctcaagaaagacgagagttgagctaatgggggaatgtgttgtggacctaagcctgttcttacacacacacaccccacactctcactcgtacttactacacgattacttcatggaaacctctgcagatttcggttctaccaacaaccaccctctctgctccacacaccccaaagacccggcctcagccttaacccagcgcttgagcctggcatagagtcagctcatgcagtactctctcaacaatatttactgctcaggccggtaggtagtgatggtaggcagtctgtggccttaaaatcagagggcattgttttgttaattctgctggtgagatctgaagacaatacaaacctgcagtctggtgagaaggtggagtggaggtgtagataagagatgcagatgtgacctcctaaatgaaccacagaacacaacccagtaaattcatggactggacataaggctttctctcctgtccaaatgtatttcttctactaaaactgggaatggaagagactgagtcaaggttttttgcctagtgtgtttggggcagggggtggggagagtagggagggagatggggacaaccaccatgtggctggggtgcctcctttccactttttgctcagaggaaaattttctccagatgtctttcctttcaaggcaatgaaacagaaagcaggttgagccgtgggatgcctctatggcctgtttgactaactgaagaggtctgcaatgttgcttctcccaccaaaatttttttttttttcgagacggagtctcacactgtcgcccagcctggagtgcagtggtgcgatctgcgctcactgcaacctctgcctcccgggttcaagcgattctcctgcctcagcctcccaagtagctgggattagaggcatgcgccaccatgcccagctaatttttttgtatttttagttgacatggggtttcaccatgttggccaggctggtctcgaactcctgacctcgtgatctgcctgcctcggcctcccaaagtcctgggattataggcgtgagccaccatgcctgacctaatttttttttaacatttttgtttaaacattgagatttgtgtaaatgtttgaaattatgctcctcagggtaatggactccattttatttatttatttatttatttatttatttatttatttagtgttttggagacagggactctctttattgcccaggctggagtgcagtggtgagatctcagctcactgcaacctctgcctcccaggttcaagcagttctcctgcttcagccaccaaagtagctgggattacaagtgtgtgccactacatctggctaatttttgtatttttaggtgagatggagttgcatcattttgtccaggctggtcttgaactcctgacttcaagtgaacagattccattttactttattttttatttttattttcatttttgagatggagcctcactctgtcgcccaggctggagtgcagtggcatgatttcggctcactgcaacctctgtctcctggtttcaagcaattctcctgcctcagcctcccgagtagctggcatttcaggagcacaccaccatacacagctaattttttatatatttttggtagaggcagggtttcaccttgttggccaggcttgtctcgaactcctgaccacaagtgatctgcacgccttggccttccaaagtgctgggattacaggcgtgagccaccatgctcagccagactccattttaaatcatatacaccctccccatgtaatagcaatagcacacataagcagcacatgattataactggatggaccttttaaaacaactgcaaagatcacttgataataatcaaaataattcatttaatatgtagtttctatgaatcacaaaagtcaatattacagggcatatgcacaatataggctctccattgtattatccttggagggacctttttctttacattatttgtgatgtacacatatattataaaagcaatcagcaaaaattaagtgacatgtgtgatggcaaagtaatgccaagccaactcccagagcagtttgcctcccaattcatttgaacattacattcagaataatgacttaaacccaccatggccacagaatgaaaccatagctcaagaagtaaagctcgtatacggcactgagctacagagtgcttttccatagctagccttctgtgtgtgtgtgtgtgtgtgtgtgtgtgtgtgtgtgtgtgtgtgtgtgtgtgtgttgtgggggagtt

SEQ ID NO: 7675 - DNA, 8657 bp, artificial
  synthetic oligonucleotide
cattacattgggtaacaatatgccttgtatttcagaggacaaaggcaaaaaaaaaagggggggggttaattaacaatatctgtttattctcgattgaattttaaaggtatttagggcttataaaatatgtgtcaaatgataggaccatagtgaaaattctgatgtggccaataaaatctggagctgtgtgattttacgctcaccaacctgcagacacacttggttggcaagtgtgtcagcatgtcctggagatcgatagttcagcttggcccctgatgccaattaagtgctttatcttagcataaaaataaagagaagttaaaaatgcattcttttcccagctttcttcccccttcattttttattgccacttgcagtttttcttttaaaaagatctgggactctgaagagagggtggggatttatgtaaagaaagtgtcatttaccaggaaaaaaggcgaataatggtgagtttcaaggacatgttgcaatgagaaacactttgtgctccactagggagagacaggggcaccaaattcagcgtcctggaataattcccttcctggattcaaagattcatttattgaaataaatcaggaagccttggcagaacggaaatccgcttgctgggtttaaagggcctttaaaatgttgcgagtgttagattgcaagtcttttctaaatacaaaacagaagaaaagaccgcagcgtttcccttgaacttaaagaaaattactaggtcaccgaatcaggataatttcatgtccaccacataaaatgtgtttagaaagaaatgctgcatgataacacaatgtgctgtgtatgttctgtttttcggaggttcgacggaagagaaaagtgctgtggagttgggctctgggttgtaggaagaacccggtcctaccctactgcccctcaggacgttctgtttccctactgcttcttcaagatggattctaaaaatcgggctcaaaagctttgctggtttagaagtgatcagtttttctgattttatttactgctttagatttgggcataaaaataaatctttttcctatttaccgtttgaactcagtgtgagggaaaggatcccattatatttcctatccatacaaacatgtggatatttagacccgaccacatacaacttggggacacataaaagagatttattggttaatttacgttgcctactacacatgtaaaccctagtaagccaaagctgctgagggagcctcagctatagaaccacgacccctgggttcgagttgtcctccctgactagagctgtgactcctgtctccacctgaaaaacgaaaacacgagagttgtctccatcccctcacctctgcctgtgtgtaggaaaaacttttctcctcttagctttccctcttctgccaccactctgttctcagactcagctccccaaagcgccctgttccccgaagttgttcccagagtctcctcttgaaaatcaagtttggggaggagagaagctctaagtcataagaaaaacttcgcgatttttcccccccaacagcagtgatttgctttgttgggggtggggactttgttttcatgtgcagtaactagctttatctggagggattttgctttctaccctcttttaagggtcaggggtccccctccccaaataaggaaactcccactcaaaccaactgaaaccgacttagaaatggcctgcctctgacctgctgttcacaaagcccccagcctcgtccttttgcgcgcatctgggacccctgcgtcccacagaacaacgacaccccctcagaaccgcactctcaggatgggcccggctgtcccgtgaagggctccattgcccgggattttggcctggctgaatcgcctcaggtctgcccccttaacaagcatccacccccccggcccccacctccccacttctcggttgatgatctaattgaattatgcctttttgttccagggactacagagcacgtgctggaggcaattaattatcggaatgtggccgtatcaaaacggacactgggcaccgggtaggtcagcggcggcaacttccccctgccttgagctcaagaccccttcccaaataggggcatgatgagctccctcggctgccccccttctgagcccttcacccagttgcaatcgcgcaaggccctcgattctcggggtacctggcgggactccccggaaactctcgcatcagcgctggcccggccagagctcgacagccgccccttcccggtcccctagtctcgagaaccgctgtccgcgggaccagctcagtgaggaaatccaaactttttcaaaccaactacttagccaagggcggttggggttggtgggaggtgaagagaggtagagggaagagaggaaataaaggagaaagtgaaaagaaaggtggggcgggggggggggggggaagaaaggcaatcctccttttttgtaaacctgactccaggggattcatttgcatgatttaagcatatttgttctctgaacacaccagcgcccccctacccccccaaagaaaccctctgctgagaggcactgaaaccattcttggagagcctatgttcggcagacgcaataatttaagtcagcagtgaactcaccttccaacctggggagagagctctggatgtggagagagaattggggcgagtttgatgggagggggtgaatacggtaagatgtgctaccggtagggtgttctcccagcaaactggctaagaaagaaggtgaagtgttggctgggccaggcagactggggagcaggaagtgaaaggctgcagttataaagcgctgcttaaggcggtctctcctggcgcctctgaacttgatcagatgttctatttcctacagagagatggcggccaggctgtgaggctgcctcaaggcgcagactttggggcttggcccagctagggatgtgacaatcacagccatctttctctctgccttttctttccactctcttctgcattctttgcaaatgccttgcaggacacaaaaatgagtgaatttatagccttgtctgaacctggtcattatgtcagaaagaccttgcaacagacagaaggcgagaggactttcacacacacccctggaagtaaatccttaaggggtaagcagtccctgaggtcactacatgctttaccttctccgggtaggagtagaagagagtaaagccttggctgttcagaggaaagaaaattccatgtcacagtccccattcagcatcagcaacccccaacacgacttttgcatttgaaaatgttgagaattcaaagctgattagcctagtgatttggaaaccaccctgatactgtgtgtgtctagtgtgtttattatgtgtttagtgtgttgtgtgcatgttttgcgtacactggctaaaagtgttctttgcatgttttgtatttgtgggtatgctcgctgttatgtgtatttgctctgttgtgtttagttgtgtttctgtgtttgctgtgttgtgcgtagtttatgttactgtgttgtatgtgcttactttgttgtgttgtgtgcgtatttcatatgtcgtgtttgtttcctgtggtgcgcttgtgtttactgtgttgtgtgcttgtttcctactgtgtgcttgggtttactgcgttgtatatgtttgctgtgtcgtgcccggtgtgtaattcgggaagtgggcagcggcgagtacggccgctgctcacaaactaaagggtcaacgcttggcgcagacggaagtaacggagatcagctctaattgtaatcgtttcttctcctttgggtctcggacagctgccgacaggttgggggcacaaacggcgaactatcccggcctgggtcccggcctcgaggccatcagaactcgcagtgattggaggtggacgcagcggctggaccgggagcgcgaaactgctgcgctctccccaggatctgcgccctgcagctacagaggggacatgttctcaaggtggtgaggcagcgggggcccaagcaggactggacgttgagcgccgcgtctcctccatcggcgcagcagtgggaccgatcctcgcggggcaaagagcccgcgaggggtgggggaaagcccgcgagagtcccggcggcgtcccgccgtttgccggctggagcctggccccagttccccgcagccactcaagcccggtggagcccactcgcggccgcccggcagccgccgcctcacctgccaggcacccggcggctgcccaatcagcgggggtcgctcggccgcggctgccatgttctccgctccgcgctgccaatcagcctcgcggcggccaatgggcagtccggccggaggtcaggtgaccgcgggccagctggctccccattggcgcgcgcctcgcggcctcccgctcggtttatgtgcgaggagtgagtgattgactttatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgcagcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcat

SEQ ID NO: 7676 - DNA, 5727 bp, artificial
  synthetic oligonucleotide
aattattctaccataaaattttacaggaaagtacttgagggtcctaagaggggaagatatcaattaaatgaaaaacaattatgataaccaatattaggagaatataaaagttttgcccctgtacatgattacctctaatttgggtgtagcatggtatttctcaaaatcacgtcctccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccctaaaacagaggagcaaagtcgaagggcctcttaacatgtaagtttgtggaagaatcgccagcagcgtgcccatcgcctgaaaagagaggttatcttggcacctagactgctttcctctcacaggtttctgtccctcgagtcccaagcctccagtggatccttggccggggccggggcggaggcggcgaggccaggcgtttcggaagtcggggctccagctcagctgtcctcgggcccctcgtcggggctcccagggtccctgtccacacaccaagttcttgcaagtctctgtcgaggctcgggcggggggggaagggacctcatttcctagggtcaattctctcgcggtctctgcccgctgaccctttgacctccacctacagggcccttggcggccgtaagccggcggtcgcccgggctccgaggacgcttcgcgccccatcgcctcccagcctcattaggccggcggggctgtaaagcaggaatcagcctctgcctaatccggacctggggtcaatacgagcccaaacaatggtgagctccgaaggccactgcgtagcgctggccgcaaactttgtgttcaattcaattttctaaagcggtgggggttgggggcagggaggcattcgtccacccgaaagccgcttgcggctcccggggctcatcagcgaacgtcctctctcgctcggcccctccagccttttcgcagcgcctgggatagagggggcggcgaggcctggggactggttgtcggcccgcgcgggtgcccaggggctggcgcaaaaggggccgcccccgtgccgggaacagactttgaagtgggtttttagcgcgcacgtgtgagagccgggccagggccggagcggggacccgctgggaggaaagaggaggctccggccggggccccaacccctcccccgcttccccgtggctccggccttttcaagccgcggccgggggcccgtaggcctcccacacccacccccactcccgcgccctgcccgcgccgcgcgcaggcgcacacttcgcagccgtcgagtcggattttgcagcgagggggttggggatagagttgaaagccgctttgcagtgccgcggcctcggtcgagctgggagggaggggaggggaggtatgtgggaaggggggctggttttggggcggctctcgagtcgtgaacatggcggccggatgcgaacccccgcggagcgcagcaaagcgcagcaaaggctgcagaactgttgcgtagtttaaactcccttgttattcctcagttctgggcgcctcgcgggggaatgtaggtcgtggcggttgagcgcaaaattgttaaaaaaacggaagcgaagaagttcttcctgggcattctcctgggaagttggcgtgtgctttttgggtttggggttcccatgggacttggacaaaaaacccgccagaggcctccccacccacctggcccgacctaaaacgccccctccgggagctgccatggctaggggatgccatttcgagttatcaggccccggtcgggattccacagaaccttgagtccctaaaaatgccccaagagcggacagtatgttctcttccaggacagtggcgaagcctatgaacacgtaagcaccattttccaagaaaatgccccggctgttagacaaatgtgccattgcgagttcgacccctacacgttgcccaggctccgttttctgtatatctcatttaaacgtgagcctatgaaaattggcactgtagctttggtgtgtgccttaacagctggtgatcttatgttaaggggaaaaaaggccagaattccgaaaactttaattcagcttttgcttaactgccttaatgctggcgttgaaagaacccctggtagctctgggatctcgagctcgtgttttgtccgtagaaaaatgcttcggattcaccttcagatgtgtcttttgtgaggaaaaaaaaaatgtaagattttaaaaagtgtagtaattgaacctcagctcctctaggaaaataagcggcacgaactcttccaggttgggtcttcgtggagaccaacggccaaacggaaaagtcagccctcttggggttgtccagtgtcacgcatttgggctcctgaaggtgtggggcagttcccgtgggccaccttgggaagggccccaggtgggtgggcaggtcattagcaaggctggcccagatctggggggaaatctgcaaaacagtgcctttatctgcagagaacaattgatggggttgtctttcctccttttcagtgcacaaagaagacggctttggagcaagaatttggaatatgcatttaagttgtcgtgctttgcattggaaacccatgggcaattaaaataagcatgccctgtagtattttctgtccttttcttatgtgtgattcctgcaagtcaaaggaggccggagcctcttcagtagtttggaaacttgttttgaaattgccaccaagccgatttttttttttttttctgtgggtgaagtttccttccccggttcactcactcccccattccccaccccctcgctggaatagagtattgacatctttgagagatcaaaggaagtaaatggtgcttgctgtatactctatttttccattctgtagtgtgaaccctgaggtttgagcttttttctggttaaatctcttggtaccaaaagtgtggaaaataaaaagttcattaagttaaaaaagctttagccaatggttagacgggtttgtccctttaagagctacagagcccagatcgtctcttaaattgactttaaagtcgagctaagatgcattggtggactgtttcccctggatacctgcggtgttctttgggtcatttgacatggtaaaactggttgatttttatagaagttatgtgaatggaatttctgcaaaaccgggcaagtgataaattggtagagctcttgtatttgtttggatgacgactccaaagggtactgcttttttaccgaggtttgattctgtcataaccattgaaatttacagcttggaaaacactaagtttgctggaagcatttaaaccagggaatgttcagagcacttggactaatggtaacttttaacagacgaacataaatcctttgaatattagagaaacttgtttcaaaaaatctgttgaaactgaagaaaatctctttcattaacatttaacaaaccaagcagttttgtatatttttaatctgatgacagttcaacctatttacacatctgatgaatggagagaaatgtaagctttatagtaactataataatagctttcaccagatggcaaattataatatttgatctctaatagggtgtgtgtcttgtgtcatatattttattaaaatacaacctgcgtcaagaccatttgaatttgaggtgttaaaaataaaacattccatcgtgttttattataaaccagagtttaaaacaacatattcatgtgacattttatgacattcttttctaagaggaaatgtggcctgttttgacctatctgcagttcactttttgtttttttgccagtgttgtcctgcttggtatccgggacagtctctaattcctgacgaagaacttgatactgacgttggtatgcagcagccagccctccataacactacctatcctaaatgcagggttaatgccgaacctactgtgcaagaaatgatttactgatgaggtttcaaagaaaaccacatcaatttggatgtctgttaccttgaagtgatcattttaagagtagtagcttcttccctaggtataaaaagactattttcttcttttggtgtatttcatcctgtgttgagcaatcatttgtgaaatgaaaaagcaaaaaaactccccccactttaggatttataaatgggaagatggaggtgaagactggcctaattcataacccagtatgcattatctcatgcattgtgttgaccttggtgaaaatctttttcaaataccagcattctatatgtagaactaaagtgtttaaaactagaaacatgaattgttgttttgttaattttatgtttgtgttcagaaagcaatacccaggatccctttaatttttgtttgacttaaataaaaccatttaaattatttttgtgattattgttttattaaaatgacagtagcccctaaataactttgattaacctgttgacttgggacaatttacattcaattcacatttttcacgatatagctggactttcactaggcaataaatgggggtgggggggaaccggccgaacaaaccccaaacaactgttttgaacccacagtgttttcccagaggggttcaaggccaggtgttgggaaggccaggggaagaattcagagtcaaggattgattggagtgattagaagaaatgaaaggatgcaggagtctggagggaaaaaaagagcatttgaacaccaatatatgggtgagaaagagagggaaagataaagctgaagataacctgaaaggtgaagagagtgcctctgtggcatccagggaggagacattgcagcattacatatatattattcagaagccctgaagtggtttttggggcagacaactttgcacaaccattgattagaacacttagagaatcatggaatataggtgttattaaaacacaagttgtcgttaattaactgtaatgttagagaagatgaagacactacagaaaaattactggaactccagatacttgatttctcattttaaatttaacatctataatctaatgtaatctgtgaatgactgtcattctatttatttggcgtgattatgtgatgatgaagtattgtaaaattgcagcctgatagagtatattactattggttctttagatccaattttattgaaatttttggtaagtagactgatgatagtataattttttagtagtaggaaacatgctcatgtccctgtgattccaattgttcatttacatcaaga

SEQ ID NO: 7677 - DNA, 163 bp, artificial
  synthetic oligonucleotide
ctttttagttctacaagttttgatcaagatacagagcatttcatcacctccccagactcccccatatctctgtatagtcaactgctccctctccaccaacctctgttttctaatctatagttttatgttttctagattaacatagaaatgaaatcttaaaata

SEQ ID NO: 7678 - DNA, 1814 bp, artificial
  synthetic oligonucleotide
taagaaattattttatgttgtgcatatttcatctccttattgtcttaggaaaagcttattatagtaacctaactctatatttgaaactctcagttagactttttgtgaatcagactcacagagtattggagttgaacaaaatcttagagatcatttaatctaccttccttatctggtaaatgagaaaactatggcccagaaacaaaagggactttttgcttaaggtcaaaaagttagtagcagaaatggaactgtaactgacttagagtttagtgcttcaaatacaacattccttgtttattttacctgccatgttatttcaccttttccctaattcctgacattgaacccaagatccaacttatttttacatctactgaaatatttgtctaatttgtatatttttaaaaattttttttctcatcaatagctatgttacttgacccagaatatcatttctaactagagagtggcttgttctttaaggttgtgtattgctaataggaatgccagttaataaattggactttagaaaagctctggtttactttttgagggctattttttgccctcacattgatcatgagtagtactagccacacaatagaccctccataaatatttcttaataaattcactggttaaaccttgactaaggagggtgagtccagctgattggaacaaaattaatcctagatgctttggcacagaagtgatttgactgacccttattctacaaatacctcttaattgaaagatatccccaaactgctatttttgagcctctagggttctctatctctgtgtcataaccagagaactagcaattaatgtccataccttgaaaaatatcctccatacttattttttaaacttcatgctttgtatgtcattcatcaagtcctgacatttttacctccaaaatgtagtaaatctgtgtactttttaacacctccactgccacaaccctagtctaagctaccattatctctcacctggccaactcaataagcttattaactggtcttctttccactgttatctccctttacctgtactttaaactgcagcaagaatggtctttgagaaagtgggtgagatcatatttcccacctaattctacccttatctatacccctagagtaaagttttttcagttaccttctaatacttccacagtaaagactgccttcattaccatgccagttccctttgctcccactttcatccttgctcaccagtttccagcaatactgacctcctttcagctccaagaacaagccaaatacttggacatttgtccactctgttctttcttgatggtcctttttgtaaatccaagggtgcttcataaagtcagcatttgagctgggacttgacagataggtaagattaccacagagagggatgattcattttaagattactacatgtaaataatttcctaactgctctggggaggtgttcaaataattattatttatttatctattaattttgagatggagtcttgctctgtcgcccaggctagagtgcagtggtgcgatctcagctcactgcaacccccacctcccaggttcaagcaattctcctgcctcagcctcctgagtaactgggattacaggtgcatgccaccgtgcctggctaatttttgtatttttagtagagatggggtttcaccatgttggccaggcgggtcttgagctcctgacctcaagtgatccacccacccccgcctcctaaagtatggggattgcaggcatgagccaccgcacccagtcatcaaatcattaatttgtaactggaagcagttc

SEQ ID NO: 7679 - DNA, 194 bp, artificial
  synthetic oligonucleotide
ctcattttaactattattgaattaagtcaagataagaaggaaatctaaatatgaaactgggactcagaaaataccacctgttcttctaggcaatggagcagagcagtaaacaaaatggacaaaaatctctttgctctcatagagttagcattctagtgaaaaaatactaattggatggactttataatataaat

SEQ ID NO: 7680 - DNA, 2814 bp, artificial
  synthetic oligonucleotide
tgccagccagaaagctttgaattttatctttaaatttcatgtaattattgcattgtattccctagaatatttttgcatgtcttaaagttaaaaaaaaaatcttaccaaaatattggtttaaaatggacatttggggaagttgtcttatatttgtcagtgaatccaaagatccctcagttgggttcaagtgtgcctgattttctctgtgtttactttaaaagtgttaggtacatataaacttaaaataaagcatgtttgcagggctgacttttcagtttctttcattttgtaggattttctttctcagaaaattctactttggatcaaaagaagctatgaattctattttccaaagatcttccattttgcagaacacgattttaaccatccgaaatgtcgttagttgaaattatttttttcaatatctcaattcaactaccaaatgccattctgtgttcagaaatggtgtctcttctgccatcttggaggaagtgcgtggtttgccttctgttcactattacccttctaattttatctctatccatgaggtaggtgatacaaccctgaagacacaatgcctatatgggctaaggaaattgaagtagaggatttgtcccaggacatcggtgataaagtgggacaagaaagttaatcttctgatacccattatctttttgtgagggaatgttgtgtagcattgagaattcctatgtgatgataggccttggttctaccacttactaactgggaggcttgttgcgaggtacatcacttctgtatacctcagttttctcatctataaaatggagatagtaatatttactttgcagggtggtggtaaggactaaaggagataatatctgtaaagtgtctggtatatagtaggtaaaatgtagagattaattaacctatccttccatgcttcttggaaaagttctttgtggagagaaataagtcttatgaagattctattgcgaactttattttggcaattcaatcatagaatctaagattctctggaactggaagagcacttagagattgactagtttaattaacttgtgttacagaggcagaaacaggctgagagagggtgatgacatgctcagggtcacaaggtgatgtagaatccccggtaaagacacttatacttaagaggggaatatgtattttcaggaacctttgtttcaaaagatgtattaaaaagaagtctttcaaagtaaaaatgctttgtgccctaaaataggaatccccatgtctaaagttcatttgataatggatataaatcagttatatttaaaatggtaccaaagtaaagtaaaacaggtgggtttctttaaaattaaaaggtcatatgcattttaaaaatacaatgatgtgcagataatgaacatgttagcatatatagccattaaaatgtaaatcaccttgctaatctccctcacaattgaaaaaataaatagactatcaaaatatttaggggaatatcagatgaaattttacttaaattttttcttccagactttttattcttcacccaagattactttggtctatctaaccataagaagaaaaataagcttaatacatagataaatgcttgtcttcctaacactacaaaagaaacatttgttctcccagataactcttaagtaaactgctgtcaaaacaattagtgttatttttctattatcttcctatttgagagtaaataaccatttcatgaatatgttaattatctggtaggtggaaaagataagaagggctctatatctccagaagcaatgataaatcatcaattgtatacaaaaacacaagaaagggttataagcgggatagtcatatgtctacatttcacctagccaaagtaaaatcagttcagttttgatagttgaaagagaaccaggaaaaaagtgacaatattttgatagaatgaaccacgaataagccttcatttgtgcactgtggctgcaatgagactgtcttctatctcaccaagtattcaatagttttattgctaagaaagctatttgattttcacaaaatttagaacacacgttttgggattgtgttaattgtcactgtaaagaattggagaagtgaagataaacccttgagtatgttcctctcacttagaaaagcctagtttatgttacaagtactgaacagagatttttctcttataaaatcactttttaaaatatatgatcgtgcttactttaagcttcatctacctttagtaatcatgcccaacttttggcagctttgaatgtgccttttgaaatctccggcacagaattcttcaccatccgcagtggttaaatgttttgctgaaagggaacacattttgaagggggagaggaggtgggggtggggagaaaacgcagaaaagtgctttctcttcctattttgaaggggcaagatgtatttttccatattaaatattttgaaaaagttgaatgcagcattgtgccagataattaaaatgtaaatttcagtatctatgcttgctttgtgatttttttaatacatttaagttagttgtcttttaaaacatgtggtcagctgttgtattcacatatggtcaaatgatcaaagtctgaactcctctctaattgtccccccgctgctcgtctgctctgtccgtgatcaaggcctcagcaggtgatgagaaaggcatgagaacaagctggaaggagaatgaggcaccgagaggcccaagctgaaagaaataaagacttccagtacatcaccctgacagtaaagagcaaaggaaaagtgacgtctggttagtagtgcttatatatttttttg

SEQ ID NO: 7681 - DNA, 438 bp, artificial
  synthetic oligonucleotide
ctgcttggctttgggggacatggtgaacttactttcacctactgtgaggagaagtgagggcaaaggagaagaaatctccaagtccaaaaagtgcgatacaattctcagcgttcttttggttgtaggataatgcctggtgtgattcagcgctgcctaccagcttacctcttttctttctaaaagtcgtaaactcagagaatctattgaggggctttccctcactttgagaatgcatctgtgggttaagaatgaatgttatggaattccatgttataagagacctcagaggccataaggagcagtgattttcatgatgaaactctacaacgcagagatatttatgtgagaagatagcataaatattacccacttattaaattaaatgaagaaattctgttaagcactaggaagctggagttcatttcattccttagggac

SEQ ID NO: 7682 - DNA, 762 bp, artificial
  synthetic oligonucleotide
agtgattataggcttgttaaagagtagaaataagttatgaaataaaacaaggtccactaaagccttctggttaggaacacagacctggtatacaagcctcaattcttttgcttattagctgcgtgaccttgagcaaaatactcaatgccatcaaatctaagatgtcatcaattatatgatgcattattattttacggaccactaagaaagaaaaataattccaatgaaacagtgatatgctcttttagcaatattgctgtgcaatgtgcaagttggctacgcaggcttctcattacaagccttgaaattttttgcatctatatagtgagatttgacaatttctcctgccttcagtcactttgtttggcaattcttttggatacataagttaacacaatacaccaaagctttctttttgttggcatctttctttcttaggtcttgcaaatcacttaattactttgcaagaaaataaggacttgtatgcattcctctaactgtttcactaatacgcaattgctaccttgctactgtgttttcagtgcttttcagcatacacaataccttttcctttcaatgtaaattcggagtgaatactcttgaaaacatttaaaatggcaataaaactcaccatgtctagtactaacattgtatataaatgcaaaggaagtgacaacaatatcaacaactatgaccaagtgtgcacacacacaggtaatagctactatgccaggctatcatctgggtaatagtgattgtaag

SEQ ID NO: 7683 - DNA, 856 bp, artificial
  synthetic oligonucleotide
atagcatagggttctaaggaaagctatatagcacattcttgtggacaaatagagcagagcccagagcagaaaactgaaactcatatactgaggtttgctgggcaaataaagcccagcatttcaaagtatagaaaggtccctgagtagactaggttggctcattgtttgcttttgaatcctcattgtaagcgggggagccaaaagagggctgcataagattgtcccattattctgagagccaggctgcccagaggaaggagcccagtgcaggccagtcgacaactccattgggggcttaatatcatccaaataaaaggaaacaaggctgatttctggtgatccaccagaaggctgactacagaacgagcatttttggagtgtgtcacttacagttcctgtatattgactgaggaccttaagctcactgcattgaggctaaggctgtgcggctaaggcttatttcaggcgtactgaatatcaacaaacacactgacttgtgttgcagatggaaattatgatcaaaaagtgattggagtgatagaattcctaagtaaagatttatacacacagctaaacctagttagtggacgtaacacttttaaaaaaggacatagatatacaagtttaaaaaaatcgtgtgtttcagttaaaactcaagctttgcttaatatttattggttggctaagtcaagcaatatttcacctgaggcagaggaagaaatttctaatgttttcatagaattggcaatatgagaggaataattagaatacaagtttgagggttctttctgcaagtccacatcactgaaccaattctctctattctcattgcaagatttagcatcaagtaatccct

SEQ ID NO: 7684 - DNA, 1740 bp, artificial
  synthetic oligonucleotide
tcacacctctgccgtttcatagccttgtcacttaccttctcaagtgggaatcatagtatccatttttgagggttgttgtgaggattaaatgaggcaatgtatttaaagagcatagtatgtagaaggggtcccaataatgctagttccccttcctatgtacctctttgtcttatagtacatatgagctggatttactaacaactcttgctcctgatctctgtgagttgttgtagttgggtagggaaaaatactctaggtatcttctgctagcattttcattgctctcctgtctcaatgagtggtgtaggatactttgtcatttgacagcaactgagatatctgcacctttttcattcaaaaagcaaaagcaatctaggtaacagatgtatcttcctaaccacatgctgtgccattttgaaattctcaagattctaggattttctttggttgatgaattttttatattagaatattaaatgtttcttatctgatcagattttgataatttcttcagaaaatgtagattatttgcttgagatggatttaaaggtttgatttgcagtccaaaatacttgaatcacataataacatcaaacactgacattgttctagacactgttcgaaatttcctatgaggcagatggtcttatgtgtatgtatatgtgcacctatgtatgctcacacatactatcttttgaactatctatctttctgtgtatccatttgcagtaatatcctaggtaaatggtctctttgttctctctttttcttagtgtaacatctggtgtcatgttgtcagtgttcaaatcccagctccattattacttagcttcacctcaatttttctcacttataaaatgtggacaataataatgcctactttagccagccaggtttcttggttgcaagcaacagcaaccaactacagttagcatgttcaaagcagaaatttcttggaaagatattaggaagactggcaaaacaggtttcaaaaatggcacaaaacaaaggaacctgcaagggccaggttaggtactagactctggaggctatttttggtaccacgacaactcatcactctgatcacttgatgttcctactgctaaaaggcatcactcatttcagatgccaagttctctatgggattattcaattggccaactttagggcactagctcatgatcactatagtagcaagatctggcttttgtagtgggaggtaggaccctgccttccataaagattcacatggtgggttggatgcagtggctcacacctgtaattccagaactttgggaggctgaggcaggaggattggttgagcccaggagtgtgagttcagcctgggcaacatagtgagattctgcctctacaaataataataataataataattagccaggtgtgatggtgcatacctgaggtctcagctactatggaggctgagatgggaggatcactcgagcctgagaggtcaaggccacagtgagccatgatggcaccactgcactccagcttgggtgacagaatgagaccctgtctcaaaaaaaaaaaaaaaaaaaaaaaaaaaaaagactcacacagtggtggaattttcaaacaagggaagaatgttcaggtacttgactaccataaagcaagtcaaaacaaaatgaaacaaacaaacatcactggaaaaaagtctacaatccatctcatagggttgttgtacagatgaaatgaggggcacatagttaagaa

SEQ ID NO: 7685 - DNA, 1466 bp, artificial
  synthetic oligonucleotide
ctaggggtcagcatctggcaaacgggaggggaaagagcatataagattgtgttttaaagacctggaagtggtgcacataacttttgttcattttttagtagccagacatgactacaattaattacaagggaaatttggaaatgtactctagctgggtgcccaagaaaaagaggagaacatggatattgatgaattagtctctgccacacgtaataataacaattatcataagtaacattttaggacacttattctgtgccaggttctgtgcaatgtgcatttacatgcattatcttatttagtctttgcaaccttaatgaggtgagcactgtttttgaggtgagcctgatttttcagatgaagaaactgagattcaaataatccagcaagtcagctctaaagctgtgctttaaacctgggtctacttgacctcagagttggaccccttaacgtctatacacttataactgcccgatatgattgtttaatgttggaatatattctattgagttccagcctaatggaaacacagatcatttagtaaaatgttttctttagctctttgagtgtttatatcatgttatggctggccaatgtcccagtcatattttagctctccacaggtgagctttcagaatatgtccatagataaaatatactgcctcaatcagattcttagccacagtttctcttggaatgttgtccacacgtggtatatgaagtgtttatgaatgtagggaatgatggttggaaatctcaggagctacttctctgatgaggtttccagttccctttgagtcatgtgggacattgatctaactgtactcttgtggtactgggagagttctgctttgggtcttggccatcatcagaaaggctgggaagtgaagcattcagggatgcaaattagcatggatctatggccaaggctataaagaatccagactgcctgaggtcagaaaccttacacactgaaagcaactggcctttcaggtgcatagtttgtgggggaggagaatgcacctggagaaagcggagacctggatatggcaaaccccatcctctgtgaagggtggaggtggcaatcagtcataccaattgaggagagatggtggcctgattgaagaagtttaaaagcctgctatgaggctaaccaatgttgaagaaaaatatataaactacgagtaatggaatcttttgagtgtttgattttcaacctgttgttttgatatcttgtaaacacactggttttccttacatatttttactcattcaggctttaaattctgagaaacactactctttcaattaggtcatgtggcccagccataagatgaaatttaagctattcctccactctctgtccctggctacttccctcttaagttggttgtgataactggaggtaggaattttttgtttgccttgtaaagcagggaaaacaaagcaatgtttagcatacgtgt

SEQ ID NO: 7686 - DNA, 1468 bp, artificial
  synthetic oligonucleotide
atatttacaaccaccgaagtttaagtgtgagtatgattgttaagacactggcaccaagttcaatcgggggccttggaatttcaatcagttctgaccacttcatgtccaagtccttcaccttccagacccaagcagatggtcctacaaagccccaaggtaaaagcccattttacaattgaacagaatgaagacatgcatatttgtaaaatagcaagtacaatagcaacaactgtgatgagaaagaggcattttatttgtatagcacttagcaatttgccaagcacttttcttgaaattcttattctggtcttcacaaaagcttgtaacagagggtttattgtgttcattttttagatggataaattaagatccagtgaaggtaagtgagttttgcaaggctgcacaactagtaggcaacataactggcactcatatttggatcttttgacacaaaatccaatctcttttttacagcagtaatttaccttaactgtatccactctcgcagttctgcaggatctaatttatgtctgctttagccacagaacacctttgggtaggagatacccacgtgtgaaacatacccaggtttacattggcttctggtgaattggccaatcacaatgtctgccttgtattccctaatagtcaagttctatagtccgttctaaagtagtaacaatggctaatactgtgtgctgagtgttgcactaagcacttcacatttattaactcatttaaagctttaccttacaacaaccctacaaggtaggtattgttttgtatccacatttcacaattgaggaatctgaggcagagagaggttaagtaatttgttcgtagtggaactccctagtgtggtccgaatctatgctttcagcactatacaaaatcatctgtctatggcagaattcagaaatccatccatgggtacaagacattcacactcccagatcttttccaaatcaatcctgctaatgccccagagctgtgcattccctttattgaactgggagtggaaagtgtgaggctagatggctaggtaattgctatgccgaagtgaaagaagagaagaaactaaaattacaaaaagaaaaacaaaacccatttaaaatggcacctctatggtaccaggtactatattagtcaattcactaatgttttcttctttcatttaaaccaaactattataaaacctatttttcaggtgaggaaataggctcagtgaggttaagttgcctaacacaacctgtagttccataattgcatcccaaacagtccgatatcagagcttgaacactgaaccactctatcaaagttacataatgacaaccattaaacattaccacttaatgggcacataccacgtgccaggcactgccttgaatgctttctctacaatgggtcacttaattctcaggacaaccctatgaggctggtcttataattatccccattccaaagaaag

SEQ ID NO: 7687 - DNA, 622 bp, artificial
  synthetic oligonucleotide
ttggtgtctcttttcccagtcctaaagagatgcaatacatatcagagtggttctttcttgttcctctggatatcaggtggattttagtactatagaaacatagtactatagaaacaggaataacttaaccagaaagattacaatggatttcttcaagttaacaacttttttttttttttgatggagtctcactctgtcactcaggctggagtgcagtggcgtgatctcagctcactgcaacctctgcctcccgggttcaagcgactctcctgcctcagcctcctgagcagctggtattacaggtgtgtgccaccacgcctggctaatttttgtatttttagtagagacggggttttaccatgttggtcaggctggtctgaaactcctgacctcgtgatccacccgcctcagcctcccaaagtgcggggattacaggtttgaaccaccaagcccagcaactttagcttttaaagcctttttaatttaatatattttaagaaacaatcttctctgttataaaacagtacagtaacatctacactaaatacagtctcgagataaaaggaaaatgtcacttatccctcccttttcacagattgatttttgctttgtgcaatgtctt

SEQ ID NO: 7688 - DNA, 1730 bp, artificial
  synthetic oligonucleotide
ttttcagtgcctagtccaatacctagcacatcataaactctcataatgtatgttgactgattaaataaatgaatgaatgtgtggaccagatagaggcttggctggaggaaggtgtcagccctggctgagagagattatagaggaccagtctatgtagaacactgaacaagttcattcaggaaatacttcctgcaagataaataaatacattttaaaatccaaacaagatcacaaagactttctttagtagtggtagacatgcattcagaattttaccttagcacttcagaaatgaaagaaaatgtctagtctttcaaccacttgaggaagataaattttgtatttcaaatccatcagagggtttatgtgatttaagagatatgtgacttcagagctaatccttatctcttggcttagaatttcaagtcaagttaaatttgaagtgccttgattaattacatggaggccagacacctaaaaaacattttggttctcatagcgtaaatgttaaggctattactcttctaactttagcttttaggataaatttggtgtctatgaaatgataagattagaggcctggaaacagcacaaatgcattggcattcataagtaaaaggggacatttggcctctgctcctgagtaaagggtatgcgctttgagacatttctgaatttgtcaaacatgcttagacttgagccatgtaattgtcgtatgttggaaaggcattgggtactcttgaatgtttcttgcagtggcctgtgtctttgtttgggcttagagattgaagagactaaagaggatctggatcagtgaagaggcagacatgagaggatttgaccaaattgcaccttccaagcctggcagtatagtatgttcacacttgcatgtttatgagactttcttgatcctgattctgggaattatgatatgtttcacagagtcacagcatgtcagagctgaaaagggttttagagatcacctaaacccatcatgattgtatggagaaactgaggcccgggaaatgatttatccaaggtctcagagttagtacatgctaggatagaaccctggtctctgacacttcaatatgttgttttttctactactccaaagtaactccttggagaaagaaaaggttgagggaaatgtatctcctttctcagtgagtgacaccaccacttattgcattatattctgtcattgaatcttcctggacaaataccatgtggaattggtcccacaatacgtttctctagtcttgtcccagagcatcttcatactgtaagagaaaatccttctaaaaattcatgaccatcaatctcagttggattcttgatacttcttggacatcatttttgcttgtcatttctttcagtgattgtaccaaatttttcctagtctcgttaagtcctgtatccaactatcagcagatgatgttgcatgacttcattaagagagttagagttatcagatatgagttttccccagtctcttggccctcctctactatattttccttggcctctggtttttcttttctcgattctcagtgaaagatgtgtcctttcttcaaatcaagttcattcccttaccctggtttttggtcatatttagaatcagctccttttctgggataagttagttactcattattctatttctttatgctctctctctactaatttcactctggtctgtctgtctttgctttttaagccttgcttct

SEQ ID NO: 7689 - DNA, 3876 bp, artificial
  synthetic oligonucleotide
tccatctgattattaagctacttctctgctgaggtaattctttgatgggcatttatatggtacacaaatatcatcacactctatgcctattgacaaaggtctatccacatagtgcttcctcagatctccttgtcactacttttccagtattatatttttccaagtccccgacatccagccaaaccactatctaagctcatgaatcagtgtagatctgtgcgcctccagccatctctcctcaggcacaatgagcaaccagatgcactgatcaaaattttgcctatgagaaggacttcccttcacaactttctttcagggccatccagagtgagacaggaatagtacatctgtcaacttttgggtggtgactgcaatattgtaaactgatcttgagttttttcttcttcagatcagctcataaggaattcctcatgagaccatacatgcaggctgggagagagaagataatacagcaggagcaagggtaatgtgcagctgggccatttgctcatgtaacttacttgttgcctccaggacctaattgagactaagctaatctatagtctctagttgatgactgagtgctgctgtgcaggtccaaatttgtgtctcagttagtcagacaacagccaatttatgaggggcagcttaggtcacatggtaacttggagattttccctgaggcacagtagaaagtcagaaactgtttatcaaaaggagaatacctgcatatctcatttatctcctgcataaatgactgtgctgtgattcaccaataggggcctggccaaagttccatacagcatctttatccgttcctgacacttcaagctcccagatctgctgtatgtcaagcactttagatctgctagattaacgaagcctacgtggctgagtggcttgcatgagtccggaccttgtgcagcgccttctcttgttctgagcccactcaaaactggcatccatttgagatactcgttacatggattgaacccaaatgaggaccaaaataaagactcaaatgctccaaaatccagaagcccactgtgcactgtgcctctgccatcaacaaatatgttaatttgctccagcaatgaaaccacttctggaagagcagctgcaattgaaatttgacttcaatttatgataatctgctgtcattcattttccgtgcttgatttgccttctgcacaggttaaacagttgacttggatgggaaatggtaggtaaaagcagttttaatggcttctgcttttcttccttaccctaatagtcctcacttcatagatcggaaaaccaagataagtattcttccagttgctgagtatgtatattccaactatctatttggaactggggaaatagccacagtgggagtttgaggacttgcaggtccactatgagacagacctgaggtactctactactgtcagacctacatgactcctattggtggaccatattggcatttttggtctccagtaattaatgtcaactcatagacagtgtccagttatcacccccaaagtctgattattccccttttctagatacgcagttacccgataagtggccacaggtctctttctctgccttctccaacgcacttagatgtaacaaatcaacccattagaatactttattttccactaaagtgttttatgagagcaaattctcggtccctccaaatgttgtcctttattacaagcatctgcaggtgatgacttaagtaactcttgccactacatggcatgtactagcatatctgtgtcaccactgggaaaaaggcaatttgaacctttagatctaatcaattcagacaatcagttacaaataagttagaatcaatagaggaatttataattaaggctctgtgggtaccctagaactacatttggtatcatatactgtatcaattagtatttgatctaagaagaattgttatgaaaatatagcataagaaacttatcatagaaatttaatgttaagcaactgtagtactgtggggaaccagactatgccaccccaaaatatgtcactttggcataagaattattttgagatagaggcaaaagggaatcaacagatgcagaaagaaacttttctagaacttcccttatctgactaaaagtggaaacttctgagaaatgaagattgccataaatcccctctctcagagaagttttatggccataaaaaagatggacaatttaatggacatatacaaacaagccttacttcattagttttccccatatatttaccttcttttttaaaaatttttttaaattatactttaagttctagggtacatgggcacaacgtgcaggtttgttacatatgtatacatgtgccgtgttggtgtgctgcacccattaactcatcatttacattaggtatctctcctaatgctatccctctcccatccccccaccccatgacaggccccggggtgtgatgttccctgccctgtgtctaagtgttctcattgttcaattcccacctatgagtgagaacatgcagtgtttggttttctgcccttgcgacagtttgctcagaatgatggtttccagcttcatccatgtccctacaaaggacatgaactcatcattttttatggctgcatagtatcccatgttgtatatgtgccacattttcttaatccagtctatcattgatggacatttgggttggttccaagtctttgctattgtgaatagtgctgcaatgaacatacgtgtgcatgtgtctttatagtagcatgatttacaatcctttgggtatacacctagtaatgggatggctaggtcaaatggtatttctagttctaggtccttgaggaattgccacaccgtcttccacaatggttcaactagtttatactcccactaacagtgtaaaagcattcctgtttctccacatcctctccagcacctgttgtttcctgactttttaatgatcgccattctaactggtgtgatctaactggtatctcattgtggttttaatttgcatttctctggtggccagtgatgatgagcattttttcatgtgtcttttggctgcataaatgtcttctttcgagaagtgtctgctcatatcctttgcccactttttgatgttacccatatatttaccttctaagagtttgctgccattggaaccctaaaactctttttctttcccttgccacttctttacaaatttactgttctttgctaagatgctatataaagccaacttctaaccatctctttgagttattcatctgagatttctcctgcatgatgtgtgctgcttgcactaatgaactgtttttcacttgttaatatgtcttctgtcagtctaattcgcagggtcccagctggaaaacctaggagaattgaaggaaaaatgttttcttcctaacaagatccaggaaacagtttatataaggctgttgcttatgaatatagtgagagtgtaaagtcagcagagccagtagtcagaaagggaaattggatgtggagtagggggtaacatatctacactggagcctgtgaggacaacctaaaacctgtattttccatcatctacttcaatcttgatgatgagggacacctgcaggatgaactagtgccttttactgtaggtacagatgctcctggctcagggcttagagaaggtgaagacaaaatccatcaggagctgaaagaactgcaatctttgctgcctccccacaccaaggtaagccacatcaatgaaagtatggctgagttgcaaaagtacctagttcttacaccaaacttctgaacataagaatggttgctattttatttctgccttttctatctcatgtagatttctcttttggagaagcctaaccctgaatcatac

SEQ ID NO: 7690 - DNA, 315 bp, artificial
  synthetic oligonucleotide
acattagcaggtgtatttataccctaccttatatgttttgattggccctatgggaacctagacaatagtttatcttgccactcctttttaccccagcataatcagaaacaagctctgaatcaatagttgaaatgcacagggatcatatactttaagtaaggtttcagtgagctaattcctccttcagcatggctagggattgccaatatttaaaaacctgccacaatggatataaaatttagaacattgtctattctcaccccacaccccaatcactgccaatgctgctcccactgccactaccaccactacgac

SEQ ID NO: 7691 - DNA, 517 bp, artificial
  synthetic oligonucleotide
agggaactctcattaaccttgattatggacccacaagatccagcctaatgctgtggactctgagtacatttttggtgaattacagacggattatctgtgaaaagcacaggctgtgaagagactgttaattagggattaaattgtataactgattacatcatatttaataagttttatgaaatccagtttgattgaaaagatataccagtgccacttaaaaatgaacaacactatataaaccataataggaggtaaacatgaatgcaaacagtccagaagaaatgcagcatcagattgtgaacaattgaaaacttggacttcccatgcttggcatgtgccttacttctgtctcctttctcatcatatggagaagaattaagttaaagaagggaaactgcatggaaggtgatgtccttattcttgttcactttgtggttattattcttgcccacttctggtttaccttgctccttgtaagcacctgcatagcattttatgttttagaaattaaaattgg

SEQ ID NO: 7692 - DNA, 567 bp, artificial
  synthetic oligonucleotide
tagaaaaaggaagaggaaagggagaaggcttcctcctcctcatcatcagtgggaacctatgcatccaccaagtccttcctatatctcaattgggtgctgaaagtcttgctcaaaagtgaggcaagaatactgcaaaacaaaccatgattattcttatcaggagcagcaggtagaggtgtgagcaggagtgtgagtgttgggttcctacaggcctgggagagaggtggacagtttgaatggcctcagctgagaaatttactcattctgactctgacaaaggttgacttacagatcttttcttacagtgatgctctatggcctcacaggtctcctgtcttgttagaggatttgtctcctagtaggaggacatgagaaagtgcctcagggtgcggctggcaggcaaagcctgaggctccagggctgacggtgggtggggcaagcactgtggggcctcctctgttttgggggtagtgtcttggtatactgttagggtgttatgtcaccttcacttttggcactgcctgggcctcctttgctatatgaccttaggacactgcttcagaccaa

SEQ ID NO: 7693 - DNA, 230 bp, artificial
  synthetic oligonucleotide
ttaaatttatgaagatatgtaaacattcagaagggaaattaaacatatctgtcccaaatgcaaatgttctgctctctgacacttgatattaaatcaaatgtccctcagtccgatcagtgtggtgcaatgtgaagtgcaatggcttgggacctagagattcagttaccaggtgtgtgatcaggggcaagggattacaatttctccatttcctcatctctaaaaaaaaatgt

SEQ ID NO: 7694 - DNA, 1962 bp, artificial
  synthetic oligonucleotide
tgctttgcaaccacttaagcctttttgaaacaagcctaatttacagttaatgcattaaaaactttgtgcaaacagaaaacgttatgtctgcttttccatcccagggtgtagcacacataaatggagaaataacagatcggtgactcttattttttttgtaatatttatctagtaaaaggcagaaaagagtgtaaaagattcatttggttaagaatggcaaataaactgcatgctcgcctgaaggtctgccttgacgcaacctgacacctagagctgaatttccagtcgctggaatatcgcgctactcctaccactgaaaatgttcaaaagcaccacagtctgggtatgagcttaaatcccctcttcaacaccgcattttagtagcatgtaaccgattacactaagtctaaccaaatctctcagctctttgcaacaaggttctagaaatcccccctccccccgccccagcaaacatttcgaagctgcaccacaagtcaagtctgtcccaaaaagcttaaaagtcatcaaagaaacgcaatgcctagacagcagaagcccacatcccttggaggtggaagctggaggggaagggtctgaggcagagataaaagcaagagagggattccccaggctctcctggggacgggaggatggtgtctgcccagctctgcgcctgcaatttccacgccatacatatcacagccatgtctgggtcacgcctgcccagagcccaccgggcatgcacatatgtgacatgtccgaagctgagggcaagccacccagggcagagtatgcccccaggctctgcgcctgtcccagggcagttgcaatgcagcaagcgtgttactgttacggaggcaagaaagccagcgccttcccacgcacgcacacaggctaggtggcctcttctgcacaagatgggccaccaacaaactcacctatgctacatacctgctccccaccgcccccacctcactcgtaaagtatggggaaaagaaagcaaaagccctttccgacctggtcttcttctgcgcctcttcttggagccgaagagtttgacccgggaaaagacatttaacttgtttttgtcgcagctggtcttgcctttgctggggctgctgacacacttgcaggcgttggatttctcgcgctcgcgggcttgcctcttctgacggatgagcgagctggcgatagccgccgccatggccacgacgcccaccaccaccgcttcttttgctgcccctctctgggttcgcctcctcctccttctcctccgctgcttgtccgctgtctcgcgacttcgccgctttggtctccttagcctgcgtttgcccgggcttctccgcactcgggcttcagccaaggagggggctcagcatgccgtccgagctcctccggcggcggtccggctcccgcgcgggctgctggctgcctgggtcggagtcgacgccacagccccgggcccgggatcgcgggcgagactggcacgcggatgctgaactgcgcgactgcgtgtggtcggcccctgcgcccggcggacaccgtgcatgtccagctgctccggtccgaatttcgccggaccccctcgccctgttgcccttctgatgggggccagaggagggaggcgggcggagggagtgagcgcgggcgggagagaggccgggagctcgggcggccggacggaggagggacgaggcagcgcgcgggggagcgcgccctcgccctggcccctccgagtcttcgactagtccttgcaacttcttggcgtgataatcgggaaaagttggcccgtgccaggtttccgacagggatcaaacaggtaatggcctcgcatcttcgctgttgctgctgctctgggcgcggcacagtcgcagcacaggaattcagccgccgcaggcaccctccggaacagcgcgacagcctccttgcagccccctcccgcgacggcccctccctcccggg

SEQ ID NO: 7695 - DNA, 628 bp, artificial
  synthetic oligonucleotide
aacatattgaaaatttccctgctcactgtattcctcttcaattgtgcttaatcagtttttctattgctgtgcttcaattctggaaatttagctatcaactctttacttattgcctctctttaaatctctgttgttctactgaaacttctgttaggtgcatcctacctattcttccataaaacatagaaataacggataaaatattcattttatttagtctctccctcatgattccttacttctctttcctagttccatctctgtatctttctttgcaaaatctgggtgcttcactgatcccctctttagctggatttatctgttgattttgtttttatttcattggtagaaatactatatattatacaataatattttatgaatggcatacaaaatcatatctatacacacaaatgttatatataaaatatatatacacacatatattaaatacatatatatatttacaatttctgtttggtgtttgataatatgtctattttttcataacgttctgatcatatcttaagagttttattcctttatcttactgaacattttgatcacacttatgcacttatgttaaagcctctttcatattgccttatttctggaatatgaattactc

SEQ ID NO: 7696 - DNA, 2981 bp, artificial
  synthetic oligonucleotide
aaaacttcccattaaaaatgtagctggaggagtgatttcactcctccaaaagaatccctgtcctgctcttttcaaagagacttgaaactggtcgctccggcaaccttctctcagcttgtttttctccgtgagctggaagctcttgggcgttggttccatcagctatctgcggcatctgccttgccgccatggaggaacagatactctcctagtttcgctgagacattatagagtgcctatcttctgtgatttccctgaagatacacctaataagtttgtcaaaattaaagtgtgattgtgtccaccttcccttagctaagtgtcatcttctctttctttcctttctttcactaagctaaaagaaaaatacattaaaagccaattataattacttattctcttttttctttagaaattaaaattaatgttttgtgctgtatgcatagaataaatgcaaatctagaagtaggaaatctctcttgaatcagttagtgccaccattttctaaatgtaaatagagttttaaatggtcagaaatacacattcagtttcctataacaattaatattttaaattcctcccagaaaaaaaaaaatgatgcatttttccaaaagaatccattcttaacgtcaaacatcccggagtaaagggaatcaagaacccctgtcccatccagaacgaaaaatatctcagcagaaagatccctggtataattttgttaatttctacaaaggcattaatgtccaggataaacattcaaatctatgtccatcaaaaacattgcagaaataaatcttacctgaatacgacttccttaacaaagccatgcttctttataagctggtcctacccagacaattgctgtctacatttggagcagacacagagagagaggagatcagagaaagtttaaggcatatctaaagtattctccaaggtaatggccagaaacatcaagcccatactctcagtatagagagatcattaatgggcattagtgacagaccattatggctctcccagatcattaatgattcatcatgtagcagtattgttctggcagtaatcagaccattgcttggactcagacataagctttgcctatactatttgcttaaacttattatttccaagcataaaattttattttgccttctagaattatgaaaaacggtctgtaacaggatccctcagcacattagagaagtttttggagctggctgccttatttggtagacttctcccacagtcaggaatctgaaagtctccccgatagtgtttgggatgttgaaatgtgtcttttattttgaaattgaattattgatgaatagaaaacgctacaagcaaaatagacatttgtaagaattatagttgctcaatcctctgtaacaattacacgtaaaatgttgaaattctaccagaacttttagttctgtgccacaaaattatattttcatatcaaagtcccttgttaaaaattcagaaaatctatgagcagcctatgaaaaggcttttagctaattataacaaagagcaagaaacagactattttagcattacaccatactcgttactgaagcactcaatagtgttaatataggaatcaaaattttaagaaaaagcaaaccctgaaacaaaattgccatgctttttatttttgctttatggaagacccactatttttgttaaaaattcaaatagaaatggaaatgtaagttattctgggatcaaatgagtctttccttttgaacagactggattctccttctgtgtggctctgggaaaactgccctcgagtcagagagaaaggaaatctgtctcaagttctgaatattgtcactatcaatgaatattgaagaattaccaacacccacgaggagctatatttattaagccccagtacccatattcagtgctatatggaaaggaagataatgtatatccaaaagcattccataaacttacatattttttcataagcttctctgcataatcaaaattgccttgtgctctctccctccacttttccatccaacactaagcgtgtaacagacaacagctgcaaatgttagcccctcccaaagggatccagcctcaacaaaattgctttagctctgaggatgggatttcagcagtaggcagaggatggagaaaatttgttctgccctgaaatcaaacaccgtcccctataccccaatagccatccacagcccagggacctgaacaacaggagcctttagaacccaaaaaggcaaaatagctgttctttggtagggctacctcctggacacatgacctatgcagcggcaaagggccatgctctgagaagggccctgcactgggtttaatgatttgctgtcaccattttgaaactaacaattttttgaacaaggatctctacattttcgttttgcactaacccctgcaaattctgtagccagtcctgtttcccagaaaaccattattttaactagtcaatcatgcttagaagcacagatgatcagattcagaatgtggccatggggtattccccattgttctctggttgggaagctgagcaagtgctcaggccaccaggtaaaaagctgcatatattcagatccctgtttgcaaaccaaaatggctaatggaagaatttaggcttcagcaaactctttacacaggagaggtgccaacttccttcaaacaaaaatagaaaagcttaatatggaggcagtctctcttggccaatgtgggagctcttaaaaaggcatttctcaagggacaaaattaagtcatcttaatatgagtggtcttatcaggtctaatcaagagactcagtctttcagctgtgccatagcttcttataatggccctgcagggggctgcactggtcagtgtagtggggaagggggtccccagggatgggagcagctcaatctgttgatgtctagacagcacagaaataaacaaaatgagagccgacatggagccaaattgca

SEQ ID NO: 7697 - DNA, 1361 bp, artificial
  synthetic oligonucleotide
acaactattttgctgtgttttctgccatccttaaaatgtcagtcaaaggcctgaaggaagagctagctgctctgtgaattttttttctctgtgaatttttttttctgtgcctagaaatgtgtgtgaaccaatagtgagctggcagtatatgagacatggcaacggagcacaggaaggaagacaccaaaaaatgcccaacacaggatctctgaccttgaattgtttagacgaataaggaagacaatatactgagtgctacaatgagggacaggcaaggagatgtgggaccatcaggaaggcagaaaggaatagaaaatgaggaaagtttactgagaacctactatacaccagattctgtgacagctgctttacatggatgatctacttcagttcctttagcaaccctgtgaattggtagtattattacatccatgtctgacaaaacgaaaatcaaggataattgagttgcccagagctgcacatcaaaaaagtagtaagggtaggaattgaactcaggtcaattgtacttcagggactgtactgttagtcactgtgctgaactagcacatgcagtactgaaattcagctctaaatctgtggcaagttaacttttactaggcgggaataaggaagctgtgtctgctcctcaaagtcaagttggaaggggagaaacaaatgcaggggaagccagagtgatccctaaatgtccctactactacacttcttcctcccatctgagctcagggaacctagtcctctcctcctccctcaatgtacataccgggggaatgtactctggggaagagaaaaggacctgtcatgtgttcacacagcatgtctcctgatgctcagtgcacttcccttgcacccaggttttagtcccagaatgttaccttctcaaagcaaggaccgtacatttctatgcatggtcttttccagacacatcccagctagagcaatcaacagccaagacctcagcaaccggaccactgaaactgacaagaaaaacacagcaagttcctaggtcctcatgcttggcattgcagctctccactcatctctgctctggatcttcgaccctctcttctcagtgaccactagctagtggttgagatgagtccaatctggctcctctcacacaggaaatgcaaggcccttggcataccatgtgtcccctccttaaactgcttggctcctgcagcctaccctgaagctttctggtcccccagctctttttgcttttcagcaaaaaaagagttttgattacaaaaactgtcagaagtaagaaaatttatccttgttaaaggacacagccaaaatcaatatatacattctattccatataacagtcatttcattta

SEQ ID NO: 7698 - DNA, 1640 bp, artificial
  synthetic oligonucleotide
tgtcatatcatgtagatttatgttcctctccggccctgatctcagcagaatcaccatgttaaatgtgcctgaaagaacttcaggggtttaattcaagtcaacttaaaaggcctttgacgatacttttttatggttcttgagatttaatattctctacaatgctgcctgctctttctcttgcttgccattcagatcttgttaatgattactgatgaatttcacaaaggtcacagacacaattttttactctcattactatactcagtcaacacccttgaactgagtagtactgctctcccggagctctgagtgcttcaccactcctggaactgctttgggaatgtttaaggtcaaaggctttgaaaggaccactgaggcagcagataggtaaggagccatgctgccatccacagggttaaagccagtagtaagccagtggcaagtcagttgctcaaaaagcaaatcaatactgcacttcctcatgatgtctgccccattggacttgaaagcagcgactgtgactagggacctccactgtccagcacagtgccggtttaacaaagctgccccatcatcagtgtccatcatgtttgccccatatgtccacctccagaggatatttttgacctttaacttcaaaagactgcttgccagcactggacattgagaaccacactttattctttgatattcccataccttgactttcctgactctgcattatcctggttatctttccacgaaatccatcccctcctttgtctcctttactgcgtcgttttccactttctgactcctaattgcaggtggtgacagaggtctgtcaacacctcttttttctttctcttcttgccttttttctctaggtaagtgctatgcaatagcactttctgtgataatagaaaggttctatacctctgcagtccagtatagtggccactttctatatgtgaccattgataattaagtgtatctagtgtgactgaagaactgaaattttaatttcatttaattttaatgtttaaatttaactagctgcctgtggcaggtgcctatcttattggctaatgtagctctagacatttgcatgtggcaatctcatctcatcctatggtttcaggagcaactttatttatgactcctcaatgtcatttggcttgataccaacttcccaatggtgcctttgacctgataaccactgtatgtggaagaatttcatagccgttaactccactgaaatctctacttactgccctagcatatataataaatacttatttaatgaaaggatgaacaaaggataggtaattttaatttcatccatttttgtgagaactagattttttggactgagaggaagactgtttagacaaagaagaaattaattggctggttgttcaaagataaaatttacatctttcttcaaatttattatatttctccaccacatttaggacgttatgggcttcaattctgtcttatgaggaggaagcatagtgttagagttaagatcttggtattgacagtcaaattgtctgggtatgaaccctggctgtaccactaacaagctatgcaacaataggcaagtcacttaccctctctgtgcctaagttttcttatctgtaaaatgggaataatag

SEQ ID NO: 7699 - DNA, 2259 bp, artificial
  synthetic oligonucleotide
cctctatttttgtttgctacatctgaaaacccaacatgtgatacccctgcaacagctaaacagggaagattttcctggtacttcccctccagaaaaaggtatatttggggtagtaattaatagagacacatgagaacgctctccggtcattccctgactgcaagatagagtatacaaggaaaagaatacagtcatgattctggaagataaagaagctcttcttgcagaaaaaaaaggaggaaactcagtttagaaggatttagaacaccaaggtgtcactgctaaattctgtacagactgtgataacaaatccatttgaagtgaaaaagagtgccttcatttttgctgttgatttgttaggttttgttctctctgctttaagagagcatataaatttattttttctttaaaatgaagtttttaaaatattacattgaggagaataaaaatatttatatacaaggatttcataaaagcaaatattaagatacatatgtgtatatatatatatatatatatatatatatatatatatatagtaaaatcatctctatagtgggacaaatgaacatatccatcaccatgtcgtataccttaaatatgcacaaaatttattttaaaattaatatactgaatgtaaaaaataaaataagatttcaactggaaaaaaagcaagaattaaacgtgataatgcatattaggcatgtaaacatgcctaaacattaggctaaatgttccagaaattagacttgttaatattatcatctttattgttgttatgatttctacatctggagcaatctaatatgagcttcctttcttttagcacataacaggaggactgttatgtgcttatgtgttatgtccccttagaaaaggggacacccgtaccttgaactttaccctcaaggctgtgtttgtgctctcaaattatggcacactcaacagcaaatgttttacccagatacaattttgatgccatttgtcttcattccttatatattttgtatgtgagttcttcaatccatgctgttttcatccatttttttaaacattggcattgggcaaactttgctgagttttgttagtgagttgcaaagattggcagaggttgtacgttactttccattcaaaggcacgttctgctaacaagattatgaattagaaacctgaactctaccataagatgattcaccatggtttaggccaagccactttttcttttacctctgggacctatttaataggccattagctttgaaaaccgtcaaaatccaggaagtaccctaagtataaacagatcctacataaagctggtgttacctttcatatgattagctcctgatagcaatctggacaagtatcattcattgagtcttgctggcataactagctataaaagtatctatagtgggctcaaatcatagtagcatagaagaatatttctgcactattgaccgaactaactggtgtgtcagtttttaagttcaagttgatggctggtctatatttagtaaaaaaaaaaaaataaaaatatataaataatatatttaaaaatgccctcattgagaaatgatagaggtgattgaatgaatgatcagcaaaagcaaatgatagttgccacataaaattaaaagaggcatcaggattccaggagggaagtcaattcaaatacagccatgaaatcagttagtccacccatatggcctgtgaccccacaatgtatagtgtgcctgggaatccatcctgatgcacagtgctgctccttccagtggggtcacttgcagcccttccagaaaaatgctgatctcactgggtcctcagaggacaaaggagcaaaggtggacttgacaatgggtgaagttgatgagctttccagatttcagtgatcaagtcacagggagtgcaaacatgtcattattcccacttggacgtttttacaacatagtaaacactcatgactacagcccatcatgatcccactctgaaatactgaatttggatctccagactcaaatgatgaatgttatccatgtttcataaagtcatgctacaatatgttgtcaggtggttaaggcattaaaaacaaagtgaaattttagccgttcttagtccatagcagttaattttacagttttacttcttagctgtcaatacctttgccatggcacaaaattaatttatgattaaaaaatttattagagaataattttcaaggaggggtgattttacaacttggggacaaagagcattcagcat

SEQ ID NO: 7700 - DNA, 284 bp, artificial
  synthetic oligonucleotide
aagcatcagggaagtattggctttggcagcccagattttgctgcacagagaaagagtgctgctccccataacagacactggatgtcttagtcatttggggcagctataacaaattaccagaggctggatggcttaaaaacaagcatttatttctcatagttcttgaggctagaaattcaagatcaggatgccagcatagttgggttctggtgagagtagtcttctgcattgcaaagagccaacttccctttgtctcttcacatggcagaaagacagccagttag

SEQ ID NO: 7701 - DNA, 1491 bp, artificial
  synthetic oligonucleotide
agctgataatgttttggcccagagttctgatgaggccttcctctgttccacacaattccacagcatttcagaaaaatagcaacagcacagttttcacaaaaagcacaactttgtggtgacatttcttcctgtgaagcagagttggtcttttgatttgatgccaaatgcagtggcagcatagcgtgtggcttgaaagtaagaagcaaatgaaaaaaaaataaattcatactctaaccaataatgctcactttggtgcagtctgtgccatcatttctgaaaggagtcagctctccaggtgacccctccaaagtgaggaatgcattaccacatttagacttaatatgctttaaaaacctgacacactttgctcccacagaatttacattttctttttcattcacttaaaatatccttagctccctaacaaggaaaaggcactgaagttaaacagcaagcactctgcttctgatttatcctctcaaacccgttttcctgaccttatcagaaccattcactttattctcatggacagctaaattcttcaaatgtggcattatattttctcagaaaatgctctctatctcattgtcacagctcttcctgccaccatcattatctgtcatatgtcaccttcacctgaactgtgcaattcactgtgcaccagtttcccagggtatgtggccacaatcattatttggagccattaattgttcaatgaatgcacttttaaccataattcttcagcatgaattattccaatattatgtatgtttctgtgggatgtgtacacattcacacaaacacacatacacttgaaaccacatataatattgagatcttcctggtttataaatggggaatcattaacatgataggtcactatgcaatttgacttaggttatatttgtgtaagtacacacgtcctatttttagaaggccgccttgcgattcaagtctgtgctgtataagtatattaaaaaacagttcacattcaatctttctttgtactatgttgtggtaaacttggaaacatatgattatttgatttttcagactgtcttttccactaaactatacattaaaacaattttaatattagaaacagattctttacagtcttataacttcatttcagaatgtggggtctaaaagatcccatcttattttaaataaatattgaaatatcagattgatcatagggtgaagatggataatagcagttaatactaaatggtatcatgattcattcaggataaaactatcttataaaaattatttcttgacacgaatcaaattgaaaaggcagatgctttaagcaggtgaaatattaattgacctgggtttatccatgttttgtaaacacaaatttggagatgtataacttcctacacattcaactttatataaataccctcagatacggataacaaaaatcatctatatatggtaacttggggaaaataaatatacaaggtaatatcagatgctaag

SEQ ID NO: 7702 - DNA, 548 bp, artificial
  synthetic oligonucleotide
ttcactttagttttctaaccaaagtaggagagatgactcagtggagaaaaagatggctgtactgcttatggattatcaaattgactaatagtatttctttcaaaatgctgtctgaaatttcatgaaaatgttcaatatgtgactggcttcattgaaaaatgtttggtctcactcactttgctttaaatgtaaagtgcctctggccacagtgtcccaggaactgaattatctaggcagcctttaaagattatttacatatcgattccaggcattgtttttgcactaaattttgcctcttcctccatgcatacttatggaggtcactgccaacatttcaggcaaagtttctagaaaactcactgccctatgcatgttgttccagccagcggggcccagtgtgtgtgtgtgtgcgtgtgtgtgtgtgtttgcatgcacgtgtgtgtgaggctggacatatgtctttgacattagtaacaattagtagagaaactccagttaggctcacagagtgatgtcatagttactcatataaactttcttgcccgaaa

SEQ ID NO: 7703 - DNA, 1732 bp, artificial
  synthetic oligonucleotide
taactaaaaggaggcatctaatgggaccttcctgtggattcacttatcaatgtaaaaatgaatcaatcgctgcaacaccatgccattgagaccctagttaaaatgctcccctttactgagtgacagaattagaaagacattcacagatgtcgaaaatggcaccattagccatctagttcaaaaatatctttcctagctcctttagactggcaagaatgatctgccttaccatcagggtgcctagtttaataaaatataactcaaagttgacacttgcagagaaaaatacagcatattagcttctaaaattatgttgttgaaagtttgttgttttaggtcaggttccttaggtagaagcagatcctgagatggattatttggggtagaatgggattaagaaggaaggggaaatgaaggaactaaaaaagcaaggctgtggtctcacctggagtctagctctaactgaccccaggagaagctcaggaccatgaatggaaccataggattggtctcaccttgaggccaaggggttgagccagtcattggctgtgggctgcccccagtgcttctgctatagagaagggggtgactataagctttagcaaacaacgctccaagtagctaagggataggtacctctgcctggtaaaggggatcaacagtgtccactacacagttgaatatcaccagttactttgtaaacttctttccatgggtcagccaactcctggccacttctttgacttcatctcccattattctctgtcttgctcactctacttcagccacattggagtatatcatcattgcaaggtctctgcttggagctctctgtgagcatgtatctgcgttacatcctcccttaactcctttagttcattattcagatgtcatcttctccatgagggcttctctaaccccccccgccaatactaccacccattacggcccctcttgaatgttaactccaacagggcatgaattttcatctttattattattcttcaccaatgtatctccagtgtctagagcaatgccttgttcattaaatatgtgttaaatagatgaataaatatttccttaattttaatttcttctaccctaagcttgagctaactggaatataattccaatgttcatatatttccctgtacttcatctacaccacttccagtgcattcgtttccctttaaaaaaataactacggtaatggtattgtttattcccacttcgtattttcaaatgttcaccaaatcaagtacagtcattgcatccacatgggttatgagtcatgtttgttttgagaatgaaaatacttaaagctaccaattctgccggtcatgagggacaaggcactataagaaagaatgtactttcacttacgaagtgcaaaaatgacattcaaatggaatgaaggtgcgttctacattctaaaaaagaccaaagcccctacccccaccccaatgagctgcatctgaacagaaatccaagtagcttttattaactaaagacatccattatgtactatttattttgaaacctagaaaataatgcatgctacttttgtattcctatttataatacagtgttttatgaacaaagtcaatacttacggagtcagtcttttgaatctggaatgaaaaagaaatcctagtattttgaaaagccaaatgttttactaactgattcatttcaattgggacacaaaaacagaattgcaagctctggtaga

SEQ ID NO: 7704 - DNA, 1696 bp, artificial
  synthetic oligonucleotide
ttcatagaaggtttaaataatattgagaggtgattaaatgccccaagtttgttgggaagggggagattcgtgagagggagaggataaaaaagagaatcatttcttttaacatcttcataaaatattagagcaattttatagatggaaaggagagaatttgcgtcatctgcctttcctgtgcaattggcagtttgagggagaaataattgacaaaagctctttggtgatttattgttgcctcccttctcttctctcttattctctcttctatgcccctatcaaaggctcagaaggaggttgtcacactaaaatgcttggaacatctccttttactgaggaaaaatctttctggtgtttactttcacactggtgggactggcctcccctccctgctccatcacgattccagccgtcaagtccatggaattagaaaccagattcaatgctgtgtctctcatgttttctcaggttctctagcttttatttagtcttttattcaaggctaagtcagttgctgctttggcttgcatattggaaagactcagatgagaaaaaaagcttgtgttttttgggggggttgggttataagaacatgtagaaactcaacagttactggctataggctaaggttgatatgcatgagtaggagaaacatggggaaatggaagcttgtatttaaatacaaatttcaatgtcatggttgttaagccaattacaatccccctgtcatgtgcagcatagcaccctgtccagactataccctgcactcatatcccatggggcatccttccaggtgctgggtaaggtcactttatcatccctttccttagcacaaaaagccagccatatcggcacaattctctccatttcttggggagaatgcttgccaaagttgacattcttgaaatgcttgcaagatttcatgagaaactgaggctacttggtccacgatacacatacccagaaaagctttctggatctcaaaccaggaagctgccagaattagagaaagaagtttcaaaactatgtacatgatgggccaagacaagaatgaactgaatgataccagctcaggatgccctccatcttggatttctccaaaaaagaaccttctatgcagtgtatttaccccaaaaagaatatttttagcttttcttaaggtaattaataaatggataactagttcccaccgccctcaagaaattgcctgcaattagaagcatgaagcagacaactagctagtccacctccctaagtgaggtcactcatttttggtcagaaaattagaaatagcacagttatgtacgtatatgaatatgtaagtgtctatgcgtgtgagtatatgtgcatatgccctgggtttattctcatgaaaggagctcggttttggagataaaaaaaatgggagaagagaaaaggaaggagaattaaagctaaaaatgatgagatgtcctaccaggcctggtaagtcagtcaggttctttttactaattgaaaatgtaatgtgattcaagagcaccagtcaatattttgaggctcccactggactctcagctgcatttacataccataagctgaccatgtcacttactaatgtctaaaactccactaactcagggatccagacaggatcatgtccaaactcctcaacaaaccattcttacacagtatctccattctcatccctccatccctc

SEQ ID NO: 7705 - DNA, 1872 bp, artificial
  synthetic oligonucleotide
ctctctaaacttatgtattgagtgtccactatttgtctcatacagttttctttttaccagtttgaccttccacaaaagctgttggtcaccattgctctaaggactctgttcttcttggtggtagaaggagtgaggtgaggtgtcgagcatataaaagcagtctacactaggaggaggtcaaagtgcaactacaaggagcagcctagtaaaaggtagatactataattagaatctgcaggatcccatgatagacatgtagtataatggagggcttgaatttttgtttcctacatctttataaaccaaaatggtattcttcattgctatgaagactacgtgcgacatgcatttatccccttgtggtgcaaagttctaagtcctaaacgcatgggaaatcattaagatgatttatcttaggactgctcctctactcctcaagcacagttgctgtcctccacaatcttgagtaatgagggtgagtcacaggcagcaacaaaaaaaggtagtcaaatgtctactcgacagatgaaacagatagcaggactggttagttcggcactcctgcctgctccaatgaacagtgggggggtcattcctagaagaaaggatctactgccccagggctttttagtattaacaggggttgccaacagaacgaattaaccctttgtcagggaagtagccaataattgttaattatcttggtgagtatgtgttcaattaagtgactatgcatgaactaaaaagaataggtacatggaaaaacgattcagtggattagagacataggagaacagaaatagttttgtattagaaatgagcaaagaaggcatcctctgtgcacttacagtgactgtaggttaccctcagagaagcttgtcttataccacaagctttccaatcaactgtagaaaactattaccaaattagatgatatagataaattaacaatttagtttttttagttttttgcatttttttaactttatgattttttttgtcaacctatttcctaaggaatggattcctccaagctgtaacttccaaataactcagttaaaaagtcaatgtactgaatttaaagagttatggtggtttaaagcaatggtctgaagccagactggataagctgaagttctggctctgccactcaccatctctgtgatgttaagaaagttacctaacagctccaagcctcagtttccctatttgtaaggtaggtatgataatacctctcttgcagagttatcaattgtgacaattagaaataacacatagccagtatctagcacatgattgatttccaataaatgggggctctttgttaggaagtacaagcagcaggaggaaagcactgcgcattgaattcactgtgtgttctcttaaagaggctggggagaaaagagccgctggatctcaattgacatcccactggacatttgaaactagtaagcaattattaatggtcccaattcgacataatgtttttccaggaggacaaaatgtgcaccaatttaaagtgaatgaactcagtgtactggacttacaaagaataatttagcaagggagttgttggtgatcaaagatgtgggagtttgtcctgcctccatttaacctctttgaatctcaattattgcatatggaaagtggatataacaatccctgactgatcacttcaatatgtttttgtgaaaatcaagtgagatatagaagatccatgtaaactctaaatgatgcaacagcaggaagcattgctattatcaacaccatcatcatttttaaatggccctccaatactctgaaatatatttcctctgtcacaggacccaatacccactttctcagcaaataatctatccttacaaactgcac

SEQ ID NO: 7706 - DNA, 1499 bp, artificial
  synthetic oligonucleotide
aaggaagtgattggacagccccatgactaccttctttgaagatatctagcccaagcccttgcccagagaacatgtaccacaacacgtatcaatcaaatggaactgaaccatttgaaagacataggcatctaatttcagtgtttttctcctctccactgggaatgttatttggatacccagaatagaaatcttcactcacagagctactagtttcctatcacaattggacaccgtgcaaaattattacagggtttagtgtgatgagctggcaagaaatgtttgccaagtttcaaagttgtatggaaagatgttatagccctgaaaggcactttctttttaattctgtttggaagtgtttgtaactctcagaacaaaatgtagtccttgggctgtcttttctcagatagctggcgctaaatttctctttcctgttaccagtttcctaaataagtgtatctgtatttaattactgctgaatgctggggagtcttctattggtccttttgttcagtactttaggatgagaggaataacatgtgtggtggcatgtcagtgttcttttattcatttgaaagccaatttttattacaaaaatgtataactcatccagaccagcagcctaaaggaagtaatttaatacaattctgaataaattctaaagactccaagctagttctatgtttcattcataaatcaagtgtggacataaaacttttttttgaatagttaacacgtataagggaggttatgcgcagcagataatctgagaggcaaaacccagtgtattcattagatatgttaggccaaacctgaaagaaaataagcttaattaggctcagagaggtgaagctacttgttcaaggtcacacaatccattcatttttctccttgattctaccttagtccaagaaaccatcataccttgtccagactgctgctaacagctgcctaaatagtcaccatgccttcagtgtggtgtctactttaatccattgtccaccttacacttccagaaacatctatttaaaacaccatcttccataaaacctgccaatggcttcccattgtccttacactaatgttcaagtgctttaccatggacaggtagacctggaagtctccgcccccttctcaactcctcagcctcagctttctccacttttatgtgctgtgctccagacatgctggctttcatgcagtgcattagaacatactgtattctcttgttatgccttaggaatcttaagcctgctcttccttccttcaggaattttcccttcacatacccttgtctaaataactcttcatttttcatattccttgtttatacctcaactcgagtttcactgtctcagaatgtgaagctccatcagtgaagttcgctgatgccccagactagatcaggtctctcgtgacatgtactttttcctcatagcacctaccatgtttgtaatatagtaagttcaatagctatttggtgaacatatgaataacttgat

SEQ ID NO: 7707 - DNA, 1723 bp, artificial
  synthetic oligonucleotide
aataaaatattgtagtattccatttaaaagtctagaagaaaagaagagtgtctactactctgattcaacattggactacaggtcttaaccagtgcagtaaggcaaaacaatggagtaaatggcatagggatcagaaagcaagcaataaaagtgtcattatttgtagatgatatcattgactatatagaataaaagaatgttacaaattattagaattttattaagagaatttaacaaggttgccagagccaggcttttaagtataggtaacactctatttctcaagctatatggtaaatacatgggagttcattttattttttcattataattatttttaatcttcatggatgtgtcatatgcactttttgaatgcatctttcaccataaacattagaaacacacacacacacaaacaaaaagtttggaggcagaaagatgagtgttatgctctactatttcaggcgagggagaaaagggtgtgaaacagatcagtgacagcgagcatgggccaggttagggctcttagaagaagcccatgacccccacctctgagctcagaaggggatggagagagcgagagggatctgaatagggtagcacatctgttttgttttgttttttgactttttaataatggtcattctgactggtgagatttctgaaagaactaaaaatcgaactaccatttgacccagtaatccccctactgggtatatacccaaggaaaaataaataattctaccaaaaagacacatgcacttgtatatttctcacagcactattcataatagtaaagacgtggaatcaaactagatgcccttcaatggtggattggtacatatatatcatgtatatattggtacatatacaccatggaatactacacaaccgtaaaaagaaatgaaatcatgcctgttgtagcaacatggatgcagctggaggccatcatcctaagcaaattaatgtccaaacagaaaaccaatactgcatgttgtcacttgtaagtggaagctaaacgctgggtacgcagaaacacagagatgggaacaataggcactggagactccaaaagtaggggaggaagggagagggacaaagattgaaaaattacctattaagtactatgttcactatttgggtgatgggttcaatagaaccccaaatctcaacatcatgcaatatacccatgtaacaaatctgcacatgtacccactgaatctaaaatttaaaaagaaaagaatgaacagcaaaaataaacaaaaataaggcaagacagagccactcttcacctatctagcaatgaggactcccctgagttagcaacctttgccacagagcgtcattcctgacagcctgctccctctgtacccctgctaggagaaaatgggagctgatctcttatggcccccatggctacaaatgatggtctcatctcacctcggtttgcttcctctggccactccctgcctatggacacacgcatcttagccatggcctaaaataacgtagccaaatgaatcaaacaaatatgcatttactgggtctgactaacctagcctcacatagaataaaagttagaaataacaacctaattataagaacagaacttacttaaactatctattaaaagcatggcaacctgtcgagttgctatccacaactggttctgtctgaggcttgtggctgcagagaatagtggtgaagaggtttctatctcaaa

SEQ ID NO: 7708 - DNA, 280 bp, artificial
  synthetic oligonucleotide
tcacctatgaattgaaagaaaagagaaccaatccaagggtatatcaaagtctgctccaaagaactgtagctgaggtggggaggaggaaggaaaactctgaattctccatcaacatctcaagcacagcaactacaatttgacctgtttgaaacactaaactttacataagatttcagagagaatttttttaattactgttagaagaaaacaaagcaaaacaaaccttaaaaggtgtgaaaactgctacattagtagacttctggtcataaaaatggcgatt

SEQ ID NO: 7709 - DNA, 380 bp, artificial
  synthetic oligonucleotide
gcagtcttataaatgccttagtcaggcatctgatgcaaccctaatgtctcgaaaccccagctctgcccgggcagctgacatagaagagtgctgtgtctgattgactgggaggcagaggcacagaggaaaaaacgtaagagactcagctataagaagataccaattaagaccatggtcaacattttactttatcattcttacaaaagtcatacaagcccatgacagaaaaatctcagaatatacatgagaaaataaaatcaactaaaatatgtcgtagctgtactacctatagacaaccatggttaataccctctagtgtgtattcgaagttctcattctgtgttgtatgcatggatttttatatatatattttttttaat

SEQ ID NO: 7710 - DNA, 1544 bp, artificial
  synthetic oligonucleotide
aatctgggttcaaatccccactctatcacttatttgctgagggattcaggcaagccatttaacctttctgagcctattagatcagctgtaaactggttttactaatggtacccatatataattgttgtatggattagaatatagaggggtgtgtgtgtgtgtgtgtgtgtgtgtgtgtgtgtgtgtgtgcaaaggattaaatttacagtaggcagtcaaaaatgatgaacagagctaggtgcagtggctcacacacttcgggaggccgagattggaggatctcttgagaccaggagttcaagaccaactggggcaatatagggagaccctgtctctacagaaaattttaaaaattagctgagcatggtggcatatgcctgtattcccagctactcaggaggctgaagtaggaggactgtttgagcccaggagatcaagactgcggtgagccataatcatgccagtgcactccagcctgggtgacagagcatgaccctgtctcaaaaaataaaaataaaaaagatcaacgttgctctagaagtctgaattctttctattaatctattggagccaaaaacccatggtttgtgtggattttatgataggactttaattatttttcttattccttcctttgctaccagtctattcatgttttctgtttaagcttgcacgagttttatataattttgcaggaggtcattcatttctgctctggttcatctgatttattagcacatacagaaggttattgtttctctgcaaatttctaaatctttcacattcatcatctgatctcctgtctcagtactaatgtaatgaatttgtgttttctctttttttagttagctaaacagttgttcatttttttcaaagacaagatgtagtatttaatagctttttctctagtttatttctggttttacgtttactacttcctctgcccaccatttctggcttctgacattcttcctattagaaagcatctaggtgcaagcttaattcattatatttggccttcctttctttaagacataaacatctagagtaatgtatcttcctccaagcaccactttggcaacatacaacactattttgttatgttcatatttatgcttgttttgctttttaaaatgtctaggttattaggatctgcacttctatcaaaatcaaggtgttatgtaagagagcatgttggtaatttcccttaattttttctcattttattgtagtttcacaaaatgctttcttagtacttttgtcttttaacatttacaaagtatgtatctaagtccaagtatgtcatttttatgaatgatatgcacacatctgtgaagaaatcttatcactaccttaagagcaaataatgtgattagtttgaaatctatgctgtcatttttaattaaaataagagcaagaggactttgaaaaatgtatattttcattttaagattctaatcttgactatgggaattcttccaaaggaaaatgaaatgctcttagttaatttcctaatattgccacttaaacataagaatgacaga

SEQ ID NO: 7711 - DNA, 6207 bp, artificial
  synthetic oligonucleotide
ttattctaattacagccataatttcaagtgctaattactcaattcctacagaggtatgtggtttcaaatgtggtgagtcaacacaagaaaatgttatgacacatgcctagtacaaatttgtattattgaattacagaaacctgtcctgtttccagatgcgttaatccattctggacaactgcaaattataaacagaacagaaactcattttctgtgaatgaatttggtttcagggtctcccaacggtagcctgaaataaacctgaagtaaccacctgatggaaatcaggaaccaaagttccagaaacaaacgagaaatactcccagattcaacaggggaatgacgtgcctagatcaatctggtgctacattctttaattacatttacttctctgggccctcagtggaaaacaaaacgatttaatgaccctgaagtcattttcctttatcatataaatgcctgtttgagactcaacaattaggggagctctggaaacctacagctgtcgttctactttccaaagttactctttcacttgggattgaatgctagccttgagccagaccgggggcaacaatgacccgtatgacaacggatctaacccctccacaaacttccggaaccttcagtcaccctttcgcctatttgggggagaaatggctccacttagaaacaaggataaaggccttgagctgaagactttgacaactttccgcgggggagggctggtgctgccctagaatctcccgggaaagaaagctctgagagatggggagaggcgagaaggaggagaggagaacaaggaatagagaaaggagtgggagtgaagggggcctgagggctcaggaaggaactggggcccccatgaacaaaagctgggactccctgcgctgcaacctcacttctgcagtggggactcggcgtgggtcgctgcggtccagtgtgcttggggccctcagggctagtccagcccactccagcgtctgctccgtggccattcggacacttgcacctaaggcacctgctgttccccactgctcttccatattccctctctgtgcctctccgcaccccggtctccaaggctgctgtctccagtttacattctggagctaatcccggtcctgagaaaggcaacggctagaaccggcaaagggtgggggggcgtcccctgcctttgccttagttctccccagcctgagcaccgctttgctgcgcctccccaacccgccgatgggaggccctgggcagaggcgcgcactccagggggaccagtggtcgggtgccccgggcgcggtggctgaaccccagcaaacagaggaagaggactgccccctcccgcggaggcccactcacgctgggcactagtgacaaggggacatcagcctttgttctcctggggcttggcgaggctgcgctgccaaagcgcagcgcgggcggcgccagggcaccagggttgctcacctttgcacgcggcgtgtcgaagggtgcaaactcctgccttcccggagggttggggtggataaggagtttaggattaggaggtgtcgggtggcggggggggggaaggaggtggtgggaaaggaggggggaggggttctgcgtctcgaccaggctctttgtttgcattgggggcggggagagggggctgaaggtgggttcaagcttgggttctgacagcagggcagattcctgagtatgtcaccatgttgcacgcgcgcagcacacatatgcacactcgcgcacacgcacacacatgcactcatacagacaggcggccggctgtcagcagacagcgcggttcccggcgctccaggctgcagcagcttcgtctgcccgcagcgccaccaccgtgcgtccagaggggaagtggaggaggctggaggcactcgagggtcgacaattccgcgaggaaggagggaaagtggtgcaaacctagatccaccccctagcgacctctgcccccccttttctcccggggtcgcagaggtcatgggcagcttaggctccgggaaggaggcaaggagccgccggagggcggcgcgcacgcgagggggcgagggaaacgaaggaaaggaaagcaggcggactcggcgggcgggcttacccttagaagcatctttctcctctttgggcttggtcacctttccactcatagatcccagcttgcttgacaaggttcgctcagaagacggaagtcctcgccgagcgggtcggacttgggagagtgcttagggcggcaagtctcgaccacgagctcccctcggtgtggttcggggcggaatccgcttttccccaccgctgccgccgccgccgctgcctacgagagagtggggaggaaaggaaaggggtgaaggaggagccgccgtcgccgccgccgccgccgcgatcccgagcggccggccgcgggaggagccgctcgccgcgctcaagaagtgaagagacaaagcggcgcggcgcttcctccgcgccccgcgccctcagcttctgcccgcctgcggagagccacgctcgcaacccccggggcggccgagaggagcggccgggactccccggcttcactgccggcctccctgggctccgcgcgggccgctcgctgggagttgcctgggtgggctgcccgcgcactggcaggctgctttcccccgcctctcccaatccgctgcgggccgccaactcgatcaaaataaaaccccgaggaaggctttttaaaaaatcaaaacaaagataaaaatattcacttaaaaataacaagcctccctgaaagggaaatgtttgaacatgtgatgagcaacgtgtgagcctgttacaccgcagagtcgcgcagcttctcgcccgcggggaatggggaggagagggtcgcctcttttctttctttctatttaatccatttccaggttcctattattttgccaaaaagggggccggagttgctcgccggcggaggagtgggagacgatggcccttacctgctctctttctctctctccctacacccacaccccctcggagctcgcccgctccctcgctcgcgctctccttccaaagaactctccggtcctagagagccacgaatcaacaccgcggcgcattctatataaacggcaaggtgtgggcacgcggagggtgggggctggcgaaggcggggcctcacaaagccgcctgcccgctgtagtaaaaggagagctcggcaggggcgcgccgacgtcagccgccggttggcaaaaccccggcgagccccgcgtagtgcgggcgagcgtgtctgctgggcgtaccctggcccctccggggcagggagggcccgcgggtgccactgtagcgggctcccaccgttggccaaggagatggaaggccggcgctccccccaccccggcccctgtaactcctctactcctagcgcctgctttcccaggcccgtgctggtcgccacctacactttggggactcccctgttggcaactgctcgcaccgagcagtggaatctcagtccgggagtcgacgacttttcgcttctggctagctgctcaagttgagacagtccggctctcagtggggagagaagggctctctgggatctgggtgtcagtaggtcagagagtgaaactgaccgcggcggctgccacctcccacccccacccccacacgcaggcccctcctcctagggctggtcgctcttgttggtaaactggaagcaaagagtgcccaccgcccaggatggccaatcccaggcaaacgggtgaggtgggactgggggcgagtgctgaagaggaataagtaggattgaaacgttgcctgaggaatacttgtgacaaaacccagagaaggtccctgaagattagaactagaaggaaaactgctcaagaattgttctacagagggcagatgaggaaggaaagagagagagagagagagagagaaagagagagagagaaagagagaaagaaagaaagaaaggaagagagagagagaaagaaagaaagaaagaaagaaagaaagaaagaaagaaagaaagaaagaaaagagagaaggagggagggagggaaagaagagagaaagaaagaaagaaaaagaaagaaagaaagaaagaaagaaagagaaataaagaaaaagaaagagaaagaaggaaaagaaaaagggagagaaaaggaaggaagggagggagggaagggaagggaagggaagggaagggaagaaaatgaacgaactagggaaggagggtgagatagtagtcaggaaatagcccctggggcgtcctggaaaaccttttctgcgatggccttttttttgtgcatgcgagtccctggtagcctcgcgctctgttgagggactggggtggtgactagcaggacttggtcctcagaacagtccattaatcagaccttaggcttcatcctggccatgaaggcgcggtagcgactcccatgcagaaaattcgttttccctcgtcctactcagctccacccccttcttaattcggttttgttaatggcattaaaccaggcgaagaaatcatatagatggattagtcttactgcatcccaggcggtaactcaattacaagagcctgctgtggctttcaagaccaggagtgtgggctgcccctgctcccagtccaggtctaaaggtcggcaaccctctaaactcaatttgcagcctccatcctcagtctgagaggaactccaggcccatttttcttgtaaataatatctaataatctgaggcttgatgacacgatgtgattatccaagccaatgttagaccattagttcatatcagttgtctgggaaggaaaacatttctcttcaaatgatcgaattcaaaagggttggaggtttagatgggtttagaggaaaggtcgaggggaaggggagtcctaccccaaatctcagcattatgcagtatacccatgtgatgaacctgcacatgcacttcctgaatctaaaataaaagtcaacattttttaaataataacaatttataccccaaaacagtaaacatcaatttagcacctaacctgtgccaagcagcatgctaaatgcttttacatcattatcttattccatcttcacaacaaccccaaggacgtgttggttttgttattttcgtttcacaaatgaggaaaatgaagctcagagaggtaaagtaacttgccaggaggtcacacagctggtacatggtgcagcatggatcacaaagatgggcagcaggctaggatgccaggtgggtctgtctctaaaaccagtgatcatctgttataccacgtggtctctcaaaactcctagcagcctcttaaagagaggtgggaggcacattttcactggtcctgtctgccaattctaaactcctaggtcttttaaaacttccctagctcagcacattcaatcaaaagcatacacacacatactcctccgttgtgtacataccatttaatttgtccacatccctccagtaagcaacaataccttattttgggaaaagggtcagtttctgtcttggaagatatcaagcatggcattgatgtggacactgggtgtctcagctttcctgccacgttaagatttccaggaaagttctctccacagataagacccctctctaagccctatcaacaatgacacctctagcaagggtaacttccaactggaagctagatatcattctgttccttaaaggagactaatcttcaatatatgactaaacctaggttagttaatatgatcaaggtgagttgagatgtctgctttggaaaattagtggagtctgtctgtccatgaacacaaacaggtaaaatacagtgttttgcttcactgtaaaccaccttggaaaggaaatatcagaagataaaggaaatacacacttcatgcaagaacagtatggtggtttgtgtccatacagagacaaatcaatgacatcataaggacactcatgtcagagaccaaggattatgaatagtcaagtgcagggacaaacattcttatctaaaccaagcttctgaagattctgctaaagaggtcactggcagcttgttctgtgaaaggaatgggggactttctctcttcaaagccccatgacaaatttagtatgaaaaaagtgttgttgcaattgactcagaaaaaggcatggtccagtgtccagcccccaagctacttggtaatgcaggatggtcagctggaagatctgacatctgtgtgaggatggtccgtaggt

SEQ ID NO: 7712 - DNA, 1862 bp, artificial
  synthetic oligonucleotide
agatttaaactttaccacccccattgacacagaccagattcatgcctaagtttacagcgacaaataagcagagatctcctatctcaaagagtttaagttcttgaaggaaagatatgcctttgatatccaataaatatgtgttgagtgaggaaaatgatgacatacatgaataaatcaaatacaaggtaaagagcgaagtgttaaatcatagagctacaaacaaaatactataagagttgtagtagggaagggcaaacatttccagaaatggttttgtaaagagatggcatttgagctaaatgcagtgtttctgaatgcgtggtcagcatcagattctctgaggttcttaagagctccagatctactgaatcagaaaccccagaagtgaaacccaggagttggcattttaaagaagccttccacatcaatcttatgcaccctatagtatagaccatgagaaatggggtagatttgggtgtgcagagaagtggggaaggacacgtagtcaagggcaatagcatgagtaaagtttccaggcataaaagcaaaatagaagacagtggccagttcaattcgaccatgagtgttggaagtggtgaagaggaacaatgaggaataagatttgaaagataggttagggctagatcatggagggcttgggggatgctgagttaaagaatttgaactttatcccaaagggaaaaaaaattaagagatatgagacaaaacaaaaatatgacagcctagactttcacagtgcttcccaaacttagccatgcctcagaatgattcctgctaagtctagcttctggggctccaccccagactttctgaatcagaatttccagggatgtggatcagaaatgacatctttaaacaaccttgttaggtgattcctggatagccagcctggcattggttcataaaatggagtttgggaaccactcctttactgacaaatgcattcctaaaaagttgtttgtatgtagaaattttattagtggagtcactatgcaaagtactaagcaagtagactattcagaggcaacctcctgcaaatctctttgttcagcagaagaaaaagaagtcactttctttggagtgtttctattaaataaacacccaatttaaatgtaaaacccctgacaactttccataacatgtgacaaaacaatttaatgccggtattagtgatgatatatggttgtacaaatagaacatgggaaaaataattcaaaatatttaagtttcctctagatttatagcaaaatgaatgaccgtaaggtaatattggaaaagagatagtgctagtaggatgtgatgctgatagagcatggcttcaggatggacatatctaccaggtagcccttttgaggttgcaggggaaattgaggcaccaatataggtagaaaccagatggtcactcatctcaactcaagctccaataaggattagactatatgacttccaagatttcttctagctttaagattttaagtttgtgttatttgcacaccatctaccttgaagatgggcaaaaggaaaaaagtgggcaggggaaacgaagttcaaggatcagtctaattcatctttctaaaaaatgcacagacacagatgattctgaggctgaaggtttgtttcctaaagccatgtgatattttaagattgtcattttcctttaagtaaagtatatctgttactaaagtgtctcttcattttcatgaaaacacctcagtttggctagttggaatgttggcatagtaatttgttagcaaatgctcaaaagtcaactttgagcaagaaattgctagtgtttaaccttccaacagccaagcttgcttcttttcctctcagagggtgtc

SEQ ID NO: 7713 - DNA, 1257 bp, artificial
  synthetic oligonucleotide
gaaaaaaatcatagttattccacttccaaaataagcttctctttttgggtacacagaaagctcagaaaaggctgaaactttcaaacttcccacttcacatatggggactactaggtcctcattactttcaaatttactttaaaaattcctagtgatttgctcattttgcaaactcctatgttctgttgtcatttttgtaatttcatggcacatactctgcgtgcatgcccaatatgttatagaccagaggtactggtttccatgaactggtttcatgtggaaagtgtgtttgtggggagagggagaaaggttaagtaagaggaaaatattgaatacagcctcctgcagagcccctgtgggagtgcaggttagatgaacgatgccccaaagggaagtgtttcctggctgcttgtgtggatcagagctacaccacatggctactggcttcagaacggtattttctccaaaccagggaaagctgaaacctgacctaactggtgattagcttctctgtagtagatcctggcctctcatcagagcttctctgatcttctttgtttggaatgaaaactaattgactcgtaaacacatgcggaatttccaggcaagaagttctccattgttaccagtgacatggccagacgctggggtcacaggtgctgtcaggaatccagcccaaatctcagctccccaccatgcaggccctgcagcttcctggctgggcttggctcttaggggcagacattaacccccacctgtagccacatccttccgatgcttttcaaaacaggaacagttgtctcagtcctcgcattctcctggctattctatttttgccgggatggaataggatattgcagggcttctccggccagagctgggcagacttgtctaaagggagcccagtactccctgccccagggttccccaccccagggcatgctcctggctgtatctgttccagtcaccacattcatggaagcagtgtggaaaggggctctacttagcaacctcaccactctgctgaaagcttcgatgaacaaaaggacatttaataatagaattcctcctctagtatttatagcaccaattgctcaaagctgttttcggttttattttttaaattcaagcctttgtcacaacctccccaggaactgcagcagaagccaggtattagcagctccacttcgcagaccaggagactgagggatcaatggagagagactcttccaagtatggacaacatgcagagacagc

SEQ ID NO: 7714 - DNA, 309 bp, artificial
  synthetic oligonucleotide
tttgttggagtttttcaaaacaccccacgggcatcccatttcccagttttgcctctaaaggttttggctggcttcttttttctcaaattgatatttctgtatcaggcagctgcactattaagcaattgttgctgatcgtttttaccaaacaccttgtggatagggttatttgccgtggacaagatgtgagtcaggtcaaagaaagaaaagccctgagaatggcacttttctgcatgctgccaactaactaggtccaatagtgacacttctctagggatgggctttgggggagctccaatccattcttcc

SEQ ID NO: 7715 - DNA, 1517 bp, artificial
  synthetic oligonucleotide
tgtccttgctacttctagttatctttaaaaatgccctctcatttatgaaaaatgccaacttcacgggaatcactagctcacttataatgtctactcatgaagagacatacccctttctttataaaatccctcttactctgctattactggcattcaatgaaacatacctctaatcagttagagtggccaatgctgtaggccagacttactgtatttccaatcccacttgaaaattgagaacattctttttcagaagactgcaccgtaaatctccacaggcttctccagccccttgtttatgtctcggttatctggaagagaccatggaagcataagaaaattagccaagtaataatcaaagaggccccaacaacagtcaaaggtttaaaggtatttttaaacggcagactttctgattttgaccaatttctttattaaaagatttcagtgccctaactccagtttaagaaatgaaaaagaggaaactcttctcacactatttggaaagcacagggccaactctttattttagaaagaacaaaacaagtgtcattatcttgatatttgacacgtggcttcccttttatttcaaggtccacttgatttttatcattattagttttaaagatcttctgcaaattttccagagcttgatggtataaggttcagtggctctaaagtcaagtcagtaattcccaagactcattaacaatgaagagaaacaatgggatatgaatttctaggtgagctgtgctctaaaatgagtagcttataaataagcaatatgcttgtgatttatggcattactaatacaccctctttaagaaaatcctacccacagaacttagaaacaataaagataaattagggaaagactatttacattacaaaaggcctcttcactttacaaaaagattcaccacaaggcctctttaactaatgagagagcattggtatgagatttttgtttacaaaaatgaaaacatcagttggtaccagagttacaggaactctcaaatgggtaatatgagatccaccctctgttagatgatttatcttggggcagctggaatcgaaggccacactggggaatgtgctggctgactccttcaggaccctgaaatccactgagtaactctaaacttgtatttcccaaatgccccactctccttatctgttttctgagtgcacctatgtggaagaatgccccaagaaaacaaactttggagacatttcaactcagagttaaaatctgccctgatcctgtgttatctatcccaagcttgaggaattataccactattatcttcccactttccagctttctgaccaccaaaaatcgggaagtttggtagtcaggtgccccctagatccatgaggcttgaccttaattcctatctgcagagacagggctctttattctctgctctgatgttgaacttggatgaaactgctttaagtctccatttagaaaaattttgttaatgattggcttaaaacatccatgaaggttcttt

SEQ ID NO: 7716 - DNA, 207 bp, artificial
  synthetic oligonucleotide
tttttaaagtgagtcttctcccacttgcgactttccaaaggtcactacttcaataatttcttatgtttccttccagcaatttcccatgccaatatacaactatgtagatatgcatccattcaaataataaatgagaacatactgtacaaattatcctgcatcttgttttaccaaagtcaaatttcctcatctgttctctagacttct

SEQ ID NO: 7717 - DNA, 563 bp, artificial
  synthetic oligonucleotide
atactactgataaacatgcctgctcacttttctccaggggtatgacatagccagatgaatgttggtttcactttcattcatttgaacaaaagggtgatttggtccacaacataattagcaagagtagaatcagttgactggggggaaaatggctcaattttcacctggggaaatgataaattactagggggcaataggctgtgaaacccagagtgccgtggagatgagagccaaactcctcctgctacttcatggggtccatggtaaggcctggttgccagtcaaaggatagttcttagatgccacctactgagtctccccacaaaaatggacaaacaacaatcagactggtgaagaagcaaatctaggcatcttctgggatcttctgagagtcttatattgtggccaagcagtctccacatagcttagtgtttaacatatgaactatgaagctagacaaagctaggtgtgaatcctgagtctgcaactacttgccatgtgaccctggacaagttatttaatatacctgtgcctcagtttactcgtctttaaaataagatagt

SEQ ID NO: 7718 - DNA, 914 bp, artificial
  synthetic oligonucleotide
tttggaatcaaagatgtcagtggggatgtaacaacttatataaaaaatttcttctgtaaacactcgtattggtgcaatcatcactttttttttaacctttcaattttttatcttatttgactagcctgtaaaaagtgttcagataggggcaacctcatttatcctgaagaaaaagcatttactattaaagagtttattaggcaacgagccctgggacttttaaaatggaagaactgatgacacgttcttattttctgggtaatttgttttctctttgctgtgttctaacctctatctcagaagtgttttcttagtaagctaaaaagatcgtaggtctctatgtggttgtggcacttcattatagttgtaaacacttttaaagactccaaactctttcacatacacaagaaatatttctctctgaaaactcaaggaaaatgccatgatcatgttaaataggaatcaggttagagaattatgatctatttttctcagcaaagagttgcaagcatatatgtgttagtcttggaagattccatgattacttcctttcctatgctccttcgttccactcccaaatccagtaagtcatctatccaaaatctttcctaatgatagcttttacacaaatcaactcctttttgttcctaataccttattcttatgggttgaattgtgtcctaccccgcaaaaagatatgtttaagtcctaacccccagtacttttgaatgtgaccttatttgaaaatagggtcttttcagatttaatgaagttaagataacgttcttgtaagaaaagagacacagacatacatagaggaaagacagtcatgtgaagacagaggcagagattggagttatgctgccacataactccaggggacaggggcggaagatgggagaacagtggggaat

SEQ ID NO: 7719 - DNA, 549 bp, artificial
  synthetic oligonucleotide
ccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttc

SEQ ID NO: 7720 - DNA, 1427 bp, artificial
  synthetic oligonucleotide
aacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatgccaaccatgccaccattttaacagctgattagtgtattcagaacatctccactccatgttc

SEQ ID NO: 7721 - DNA, 682 bp, artificial
  synthetic oligonucleotide
agccaagaggaatgaaaatatatgtctacagaaaaacttatgcaaaagcattctcagcagcattgttcataataatcaaaaggtagaaacaagccaaatgtgcatcaatcaatgaatggataaataaaatgctatacatccatataatggaatattattcaaccataaataggaataaaaaactaatacatgctacaacatggacgaaccactaaactattatgctaaatgaaagaaagaagtcaaacacaaaagaccacatattgtatgattccatttatatgaaatgtccagaataggcaaatctattgaagacaggatgcagattagtgattgcctagggctgcttagattggggaaaaaagggagggtaagactggtttctttttagtgataaaaacatggttgtacaaccttgtgaatctagtaaaaccactgaattgtatactttaaaagggcgaactgatggcattttagttatagctcaataaagctgttacaagaagaaaataaatggcatgaaaatctaaacaaaagcaataaggctctcagataaccacaccactttgcacagctgggtgccttctcttcccttcctttggcagaaaaatggatgtttatctagaaagagtaaaacacaggccctatggaccaaaggatacaaggttcaacttagggcaga

SEQ ID NO: 7722 - DNA, 1244 bp, artificial
  synthetic oligonucleotide
aatagaattaggtggcagtttcctaggataaccctaaaagtcaaagggtttttgtctgtgtatttacactaaacaatgaaagaaaactttattatgggattatatttttattttaatccaatcaatatttactgaacatcttctatgtgtctacttcatgtatttaaatgaatatcaagctctgttaggcattgaatgttcacaaattaagaaaacacaatctctacccaacagttcaactgcagagtccattactaatcagcaattctttaactaaattgataagtaatcaaaggaattagaataatatacaaggggaaatgatagcacaaactctccgagacataggaaggtcaaaaagatcttgaagcataacgaggagttaactggatcagaatgttgttctagttcaccaatgtttccccagcgtctagaacttgctggcacatagtatgcagtcaaaaataactgctacactaaagaattcaaaagacaaagaaggaggacacattgcaaaataagtggagaacggagtaacatatcccaattttaataacaaatcaccacgtactaaatgcttactctgtgcaaagcattttgccaatattatcataaattcttttcataataattctatgaaggagttaggttactcacttttacaaataaagaaagtgagactcagagagtttaaggataccttcccccagctggcaaagccttcatttgcccctaagtctgtgctcttaatcactaaactactccacctcctgaaaaggccctagtcaagagagctagatgaaatgacactgggggacaatgggagatggtgttgggaaaacgggccagaaccacatcagaaaggatcatgggtttttttttcctggaggtaaggggagtctctaaaaggttttgagcatcagaacaacatggtcaaatttgcattttagaaagatcactttggctttgggaagaactggatttgaacaagagtagaagcagacagatgagctaggaggctggtacagtaatccaagccaggaatgatgagtttctgaactaaagtaatgataccaggaataagagtagaatttaggaggcacaatcagcaagacataactacttgatgtacttgccgagaaaggaggtactaggaggatcaaactccagatttggggcttgagtaactggttgaatagtacaaccttcactgagatgggaaacacaagagaaacaggttttaa

SEQ ID NO: 7723 - DNA, 9120 bp, artificial
  synthetic oligonucleotide
actccagtcatttaaaaggaatttacaattccccaaacctactctgctctcctctctctgcttgtctttgcatatcttatttccttgcctggaataccattcacccacctatccctaccacgttcaatccccacccgctgtccagctggacatttgtgtgcatctctcaagattcaactcatgcatcactctctccatcaagtcttcccctaactccctaagtgaagccaatcattttctcttctggttgccccagggaagattctgcacacacatatgtcattagcttattactctgtagtataatttctgggcctgagcaatccacaaatggtcatttttgacgtgattgttcagaaagttatttaccacaatgaaaaactttgtaaacatattttaatatataaatagcttcgaagtatatggaaatccattttacatttaaaattgttgtactatagtgtgtactctaatcacatggctacaaatcccttccagggcaaatgctgaaaaggtacaaaagtattgcaagcccaggtaaaaacacagcacagcaactggtgtcatttaggtgttatgacacattgtaatgccacaggaatgggggcctgtcaacatgtaggagccttcaaaagtgtgaacagatgacacatcacacaactctagaaataagagaaatcactagcagcaaaaatatcaacttacatttcatagcataactaatttaacctttgtgattaagcatgcattcctccaaaggagttttttttttttttttttttttagctcccaagatgatgcagaaggtaaatgagaacaaaacgcaaagtactttccactgtactgcacggaatgtttcagcaagatttttttttgtagtctccaaaaactatttaaattgctcttaagaccggaactagtttgtgccccatcaccacattgcccttaatgatttattacatctagaaaataatatagaccagctcaaaacaaaacaagcaagaccaaagagttctgtgtgatgaagatgcacagaccacagccttgaattaattcctctggtctaactgaagatgtttgcatggcctcctttagatttgtggatagcactgaatagggaggtatatttggaacatgtgttgtggctatctgatttgtgggaaattgccaccaagtctattttttgaataccaaaacttccactgcaaggcttagaacctactaagtcaaaactaccttgggtgcacaggaaggcgcgcacatcaattgcagcaccttgcagacttctctgaaaagctctggctgaacttcaggtctcagagttgcactctgttctgaggcagccccggtgccccagtcagaatggccccataggaacgcagccccacagcctgcagcatcctccctgctacatcaaccccaaagctgggcaacttcagcttgctaaatgtgagtgtatcacgactggcaagtgaccaagtccatgttaccccacttactccccttaatcaaaccatggcagcggccgtaaagactttgtgagttacttgtctttgcttttgtttgtccttccagacaaacaagagcttttgcctttgtagggaagcaacaagctcatggaccaagatgaaaagatgcgcttttctgggtgcaaagcccaagtcagtggcagcagctgtttccctacaactcctcccccacctgccctgccacggccctgctgctggtttccgaacctgagtgcctttttgacttggtttcctccacatgcgttatgggaaaaacaaaaacaaaaaaaaattgctttttcaacttcagggaatattacaagggaagtgcactcctcaaagaggctgggttctggtgtgtgagatgcagtgtgggaagatacactctattcccacttctccggggacgcaccaaagtgggtgagaaggggataggagacctgaaccagcaatggcagagacagtttcatactgcttcctgcactttcccacggtcctcctgcgggaccagagctcctgatctcacctcctgcgagctgagaccagagctgcacgcctgcagcgcggcagctggccagaggaacggagaacggatgacccagcgagttcgtggctgggagcgccactgcagcaggaaagtgtgtgtgtgcgcggcgggcgggcgggcgggcgaggtgggggggttgtatagactggaaaataaagtgcgcgcggggaggggtgtggactggaaaataaagaaaagccggccgggctggggaggcagcggctgagaagaagggcaagccagcccgaggccgccggggaggagatgagaggaggggacttacctgccacgaagactgcttgcaggaggcagaggtagttcttcccgtacttctcggcaatcctcacgcgctgcagggccatggccatgtccacctgcagagggatcgcctgggctatcggcatgaaagtgcagccatctgggttctggggcaggcctgggatcctgccgcaggacactgaggtccacggcgccgaagcggcagcttggggcatgtgcctggccgcccgccttggcgaacccaggtagggccgggcccctgccgctgccatcctcacgctggagagccgggcagggccgctactccagccagcagctgcccagctctgacccgcgcgccgccgctgggcactcaggcactgccggaggggtacagcccctggccccgctcagcccagctgcgccgcggccgccagtcctccggagcccccctagtagggacagaggcgcagaggcccgagagctccgcgcgcgcggagtccaggaacttgttaagagtttggggctctggcggagcgctctggcccccgccgctgcgagggcaactctccctgggtgcgcacacccacgcccccgcttagccaccggtggatgaaaggaggcgggggctgtggaggagggacgcaaggagctaaaagagagaatttctgcagagattcccattttcgagggacgaaaggccaacctaggctagcacttgtggtgggaggagacagcccagcctcgcactctcatggcaactcatgcaagtcttggcggtttcttagcattctggccagtatccacctgggcaaagactcggcgcaagggagttacactgtgtgagcacatgcaggtggccctgtcagggctgctgtctttgcccgaagagaatactagccctgaatagtctgagaggtcctgtgctgaagccgaaatatgtcctccgaggatgcaaacaaacacacagacatactctgatctcagtctttggatatgccaagtcccacgcccttcaggtcccaaacgccaagcctcctgtatagacacttgagctgccatctgccatgggcatgggagacttgacacgctttagagaggacacgagaaaacggaaaggcaagaggaggcaacccgtttaagaagccaaatggaaaatgaaaggagctagagctccttccttgccctgaacccaaagcactcagggactgggccgagggaagatggagctccgcagtgcctggaaggaaaagggtatgcaggacctgagggagccctgcttgtgaagcagtagctggctgaggagaggccaggggtgttagcatttaaaaaaaatgtgtgtctgaagctgagctaatgccatagggattcgccccaattttgctctaatgcttagaagtcctgatgtgaattgcaaatgccacatcccacttttttctttaatacttatccttttcaaaattttctggcaggagagtggattaatattatacaggccaatcattccaagtagatctcttatgaggaatcgccaatttatacctgaggaaagtggggataggcaagtgcaaaaggcagagtgagtaggggaggaacacacacacacacacacacacacacacacatgtcccccctacaagcacacacctcttcccctagccttgctttttcaacttctcggagttgatttacatatttttatctgaatgtgtaagctatttgaatgtgttaagtcaaccaggcagaatgtttgccagcctctctcttgaatatgtgcacagggtagaggagcaaatagttaaaatttccgcactactgtgggtagtatgacattaagaattctaccaatgtggcagttgttgtaaaataagttaaaaataaataagacacaaatgaggggtagtctataaaagtactaaataacaacctaggaagacatttttaaaatctaacaatgggaaagagtttccatagcataatttaaaaatgagattgatctgcatatggacagatgccctgctatgttgtcaagtgtaaaaaagtaagatgcaaaacaatatttattgtttgatcccttattttaaacactatacatgtgtatggggatagaaaatgattgggaaggatacaaactgctaccagtgttgatctctgtaaagtgaaattggaaagcacttggttataggagaaatctcatgttttttgcccaataagtaattatgttaaactttttacagtgagcaactgttatttttgtaattccattttttaaaaaagaaggaaataaatggaaaaataactttaggtttagaaagctattagaaacttaacaatataaaagaatgttttctacgtatgtgaaaaatacaaaaatcaaagaagaaaaaatttaaacttctgtataattaaaaacataaacaaaagtcaaatcacaaatgggaggttatttacaaagaaataaggtaaccaaaaaaataatatccttcaagggatcgagaatagccaaaacaatcttgaaaaaaaaaaaaaacaaagaggactcacacttcctgatttcaaaccttactacaaagctgcaataatcaaatcagtgtgatactaatataaggatagacttatagatcaatagaatagaactgtgaatccagagaaaacccttgcatctaaggtaaattatttttgaccatggtgccaagacaattcaatggagaaagaatagtcttttcaacaaattgtgaaccttaaaatatacataccctttaacttgaggatctctcctacagaaataatcagaggtttttgacaaaagtttgtatgcaaagcattattaattatagccccaaattggaagcaacccacatgacaaacaatagcagataataaattatgatacatccataaatggatatccataaatccattatccataatggattttatggattttttatccataaatgcataaaatggattgttaagcatatcagttatcaaaaatgccattccttgtagtgatggaactgttctgtatttaattctatcaatgccaatattctgcttgtgatattgtactgtagttttgcaagatgttaccattgggggaaacttggtaaagggtatacaggatctctctgtattctttctttttttttttttttattgagttggagtctgctcttcacccaggctggagtgcagtggcacgatttcagctcactgcaacctctgcctcctgggttcaagcaattctgctgcctcagcctcctgagtagctgggattacaggcacgtgccaccacactggctaatttttgtatttttagtagagatggggttttgccatgttggccaagctggtctcaaactcctgacctaaggtgatctgcccgcctcggcctcccaaagtgttgagattacaggcgtgagccatcgcgcccagcctctgtgtattatttcttacagctgcttatgaatctagaattatctttaaaagtctaatttttaaaatgaaattattgaaggatttttaagaacatgagaaaatgatcatgaccttatgttgattgacttatctgcatgcaagatgaatatgtagtataatttcaactacatgccatctataagcattgaaagaatgctggaaaaaacatggagtggatggatagatgacagccaaatatgagagagggagagaaagcctaagctcacatgagctccttctgtgtcatccataaaatcattaattatgcagtcattgaaaataattacctcttctctgaagttttgctagactccctgaaccaaacaccttctttcatgcccgttcatcctacctttctcaagctgattcttatcatgtgttgcaattgtttgcaggtctatcactcagaaatattctgaggcccttgatgccagaagaaatgtcttattaagcactgtcttccagggcttggcatatagtgggccctcaaaatgtgggttacctgaatgggtgaataaagtaacaatgagtgaacatcagtcttaattttactgccaacccttattggaaagaacactaacctcagggtttttcaggtctgaagaaaaagatgcatagctgtaactcagtctctaatttgcatagcacattcagattcatctacactactctataatacagtttttggggccttacaatgtaactaactcttttggaaataaggccctttggtattatttcattaatgcccttggatgaagtctaaggataaaccagccttataccaaattcctctctctaatgtgatgtggtaaggtgttacaccatctgcctaaatcttaccactcctgagtaggacacagggaatttgagtaagagggaataccctccctcccttccctccctccctcccttccttccttcctttctttttctttcttttctttctttccttccttccttctttctcttctctcctctcctctcctctcctctcctctcctctcctctcttctcatctcgtctcctcttcttttctttttgtttgagacagagtcttttgtttttgtttgagacagagtcttgctctgtcacccaggctggagcgcagtggcgcaatctcagctcactgcaacctccaccacccgggctcaagcgattctcatgcctcagcctcccaagtaggtgagattacagttgcatgccaccatgcctggctaatttttctattttttttttagtagagacggggtttcgccatgttggccaggctagtccccaactcctgtcctcaagtgatctgcccaccgtggcctggaatattatttcattatagtaaattaggcataggttttgagaaaccagaacctctgaaatgctgaaaatggagataggcaataaaagtaaaaatatccttactacctttgattttgagaggttctacagaattcaggaagtctattgacatgtgagggggttaccaaatgaaaactcctcatttatagaataaggataatagcaacctcacaatttatataaattacttaagattatataaaggactatatcaagtttcaaacattaggttctttgccatgtatgcaggggacattggtagtttttgcctgcctagttggcatctatgtacttcaacattcccatggagagtctccctattccattctaaatccatgtgacacagatgagacttccagcaaacccctgcttcagggcaggagggtagtccaggccaaataaatgagtgtattctgtccccatggccactgtgataagtttgaagcaatgatacacaatcccagtaatttctggaaccaatgaaaggtagagattatcttcactgaattgttagttacaaagatgaggtaaacctaaggccgcaaagacaggctgcctgaaaatgaaaccaatatcatgaaaacagggctgatacatgtaaagagacagattcctaatgatattatttgaacatctggatccagccatgactgaagaaatatccacccactagatttttcagttacatagatcaataaattttcttttgtgcttaaactagcttacagttggggttctatcatttgcaaccaaaaaaatccaaactaatacgttatgatgaatacattataatctaactccagattggcatcatggaggcttcttagatgtatgtaaaaatcctgaaaagtatgttaaatgcaagggagtcactttgacaccctcagctaagtaagcccaaagagattggtcaatgaattgacctgaatccaggccctgacattgacttgatgtttaccccttctcaggaaattcctcagaaattttattcttatatgttgccatttatagatcttcaatttgttgccattttaaaggccaaaactttcctttcagaagaaaatattgtttcagaggtaaatatgatttctgttgtgctttaaaagaagtagcccctttaaaacttgctttgggtcagacgcggtggctcacgcctgtaatcccagtactttggaaggtcaaggtaggaggattacttgagcccagaagttcaagaccagcctgagcaacaaagggagaccctgtctctataaaaaatacaaaaattagccgggtgtagtggtgcatccctgtagtcccagctactctggggtctgaagtgggaggctcacctgagcctggttggaggtcagggattgaggctgcagtgagccacgattgtgccactgcactctagccttggtgacaaagtgagaccctgtctcaaaataaaaataaaaataaaaatccttgctctgttctgatggccaaaggctgtgtaaaaagtttaagaatatttccaatgcaattatacttgtaatagagcaaacaactacttctgtaaatgaaatgctttgagtacttgctcaaacgatgatgatatattggaaatgtaaatgttaactgcttggggcaaaattagagtcaggaataggagtttggaatcataacttcccaactctttctttaatttttagctagaactgcctctttccacattaggcatgatgagtttaggctcagtgaaatgggaatagcttgtttctttctgaatttctgtgccacccaatcaaatatttactgacatgaattgggactgaagactgccatctgaaaagatgaccaagttaaacagctagatgaccaagttaaacagcttgacctaacaaaactagttttaccagactggttatataggtcacatgaagataaaagtataggtaatagactcacgctaaggtccataattgtacatatgacctggttatttct

SEQ ID NO: 7724 - DNA, 350 bp, artificial
  synthetic oligonucleotide
catccccctactcccatatgctccatccactgaattttgttcgttcatagcaatgacaacttccttaaataatattatttatttgtatatttactagttttttctgtgacaagaaaaaaatgtctacaacaggaaccctttacgtctttttttcccttcatgtcagacaggtaatgtgccaatgttgtaacaagttttgagggaggcacatctcacacatgtacatgaaaacccaatcatcatgcttatgaactaaagaaggatctattcgtgtcttgttcactattgtgtccccatcacctaacacagtgcctggtcctttaagagttgaagagatgatatatggaagg

SEQ ID NO: 7725 - DNA, 1973 bp, artificial
  synthetic oligonucleotide
tctatgaatttttaagtctataaaagtgggaaatctaggccctcttccactcaccagttgtatatcatttataggataattttaattatatatagtatttgtcatatttcgtcttagtttaccacgttataaattcccaacacctaaatgtaggtttaaattaaatggcaaacctgccatgtttactttttaatatgcactatttattcacagcctttacaaagcatattttttgataggtgtatcttaaaaattgttcaccatatatcttctcggtattttttagcgtagctcctttcagcaagagattttcaggtcccaaagacctaaataaaaaatgaacacagcttatccaaacaagccaatagcatcaacaactctggggacagattttgccctgacacacacctatctccaaggggttcagaatgttatctgtctacttataccatatgcttactccccaggacaagctgaaaggtccttcactctgaagttacttgagggtacagcacagatggaagcacagtacgggagtagccagcaacacacataggcaaaaaaaatacatggggggggataaaaggattatgaatcatggatagcaagacgagaacagaacagagcagcagatcgcaagacacaaaagcagacagccatcaataaaagacagggaatgcaaacgtcaaggtgggaaaaatatactgacatatttggagagaataaaccctccttttgggggatcactggggaccctgtatttctttaactttttgagtgtggctgtaaaggccaagtggaaaagttgcggtaattaatatgatgatagaagaggaaagaaagcatccctttttgtatgaactgcttgataaattgtatgaaggctgatacatacaattcgtatacataaaacaattcgttttaatgaagcctttcattttacgtaagtccaggtagttcttccagcattttacccactgcttactttctcaattactctcccactgttctccagttataattccaatgttgtcagccacttcacaaccgaggataataaataacatggctagaacaggtttgggaatataatccaaaatgtctggagctctgctattttggaaaccataagcattacttctaacagccccctccccacaacacagagaccctatcaccacaactctaccaatcacaaggttagttgcttattcacctttatattcctttttttttttttttttttttttttgagatggagtcttgctcttgttgcccagggtacagtgcaatggctcaatcttggctcactgcgaccttcgcctcccgggttcaagagattctcctgcctcagcctcctgagtagttgggattacagatgtgtgccaccacgcccagctaaatttgtatttttaatagagattgggtttcaccccgttggccaggctggcttcaaactcctgacctcaggtgatccacccacctcagcctcccaaagtgctgggattacaggcgtgagctaccgcacccggcctatattcctttctataatagaaaggtatttggctattttagttgatttaacagaaaaatagacccccccccccaaccaaaggacaaattaaagaaacagcaaacttacctggcaacagcctcaagactattactgtagatattgattcgcccaacaaatctgtaaaaagaacaaaattgcaaatgtgttttctacatccaggtgaaatccatgtaccagaaatatgagaatgaatgaaaatacaaataataaaacagagatagataaaactgtgaatgaactacaaaagcctattatatttctgggggaaaaaaagttatgttgaattgataaggtgtataacattttcatataatttttaaataacatgatgggattataggagcagaaacaaaggttctcaattgattttcaagttctgtttaacatcatgcatgca

SEQ ID NO: 7726 - DNA, 2104 bp, artificial
  synthetic oligonucleotide
ctgccgcaaggagggtttcaaagacaattaaaaacctaaaagctcttcttgacatggacagctgagagaattctattcacaacatgcatataattaactaaaaccacgtgaaaaagttaatacatttattttttttcctatttacagaactgagacttattattttgctcactatagtgtatggcaatggagatatacacatatgaattgaacataacctttttggtcacaaaaatgctaaaattttgccaacagcaagaaaaaaatcattaatagttccattacacaaatagcttaattaatgatcttgaaaatgttcaatatggatacattttgtacaaggggcagggagatgacgtgtcttgcattagtcagataattagaatattctactagtgtatattatgcacttgattcatccagaactcaaggcaggcgccaatgaacccacttataaatcatcaaacaagggttaaagcagactcaaagagcgcaccacttaggcagaagggaaagctgttgtcgtcatcttgggggaaatattacggcaatgtctgaactatatttaaaactatctcctgattttgaaaacctctgtacttttagctgatttgatcagaacaacttaactgaaaaaagaaactatctgaaagttttcttactccaaacaactttttcactatcaggaaatctttatgtagatttcttgatttatatcttgacattccctaaattataactttgtttttgaaaaggttaaaagcaggtcattaccatgcttttgaaatacagaattagtcatccaacaggtaaaggttcttttttacatactgagtcgtagtcctcaactccagatggaataaacaaacagaggagccctccaaggacatacccagaggtgagccacatgagtaaccctccttaaaggcagcatagagaggatacatcttcatgccctgtggagctctggaccatggccaagaaaaccgactgtgccagaaagtgtatgagggaaataagttacccccatttggccaaatttactttaagtcacttgcaattataaatgagttataatttgttatatgtacataaaatgttgctttataacttacttataaagcaaacattttccaaactacaccctatctttttttttttttttttttttttttttttttgagatggagactcaccctgtcacctaggctggagtgcagtggcgtgatcttggctcactgcaacctccatctcccgggctcaagcaattctattgcctcagcctcccgagtagctggaattacaggcgcccaccactatgcccggctaatttttttgtatttttagtagagacagggtttcaccatgttggccaggctggtttcgaactgctgaactcaaatgatccgtctacctcagcctcccaaagtgctaggattacaggcgtgagccaccgcacccagccctaagtattatttttaaatagcaatcaaattactccaggttgggtttcctacatcccaagaatatacatttttaatgaaaatatacattttagaaaaaaatagatcaaattgtaaggttagcatacatgaagttatttgtatagtcacacagtttaagcctatgattactcccattttagagtctaaatattaaataggctgtgtcaatattaaattcaagcagtgctataaaaattgtggtagcttttacttggggctcagtttttccacacgtaattaccacccttttacccaaacacgagtgtttgcttagaagttaaaaaacaattacataacagctcttttcaaatataaaacctaagaaaaaataaaaataagaaaaaataaaagattagagggtgatgggaggcagtattgtatgattaactatcctgagatcaaaatgtttaggcaaggtttagtctgttaccttgcaattggattccccatcaagactggctgtagtgacataacaggttccatcagtggtgcaagatgatagaagaataagatcacagggaaaggtttcatctgcctgtacttctactacatcaccaacctggaattgagaaataaatataaatattttaaattccaaa

SEQ ID NO: 7727 - DNA, 500 bp, artificial
  synthetic oligonucleotide
atccattaagctcttacttgctgacatagtaaagattagtaaaagtgctgtttgaaccaactgttctgaggtcaacagtgcaattctaaaatgattaaagaaagtaccctagagaaacaatatttttactgccaatcatttttctttcatccacagcccaaatgaatcttaaccataaccttcactagcaacacactaactcacgaaagaatggactgggaatatttcatttattatgcaactactgaggacaacctttcaactaccttactagagaacagaaagcataatgcagattacttctaaacacaaaataattgtgtataagtgtaaaggtcagaaatagaatggctgcctctattgaagaaatgatcgactttttctaaaaagaaactagttatttggctttacaggatagtttattttgcaatctctcagagcctcattgttgtaaagttccaattcacacaatatatttctcatgccccttttacattttt

SEQ ID NO: 7728 - DNA, 554 bp, artificial
  synthetic oligonucleotide
cagctttctaaatattagtaacctgtaggcaattcaacttaaaaaaaattgacaggaggaaaagtggggcttcagctttcaaaatcagcccttttaatatgtattgctttgctctgtccaaagcatcccaaaatgtacaatctcattaaagttactgagcataatggatttttagcctgatgcagcaatttgcattaattcatgtgatcacaaatgtatttattttccaaagaaactgctttctcaagcataaaggaaccacccagcaatagggcttgtttttcctttcagtgcagctttcttatgtgtaagttatcaaatattaatctagttgtattacatagtggagcagacttcaagtcctttaaaagatacaattacacatttttaaagacatgctaaattctatttaaaatgtctatggcttcttgtttcaatactgagtatatgtttataaatcctggtttgacttgtaaatttttttatctaaaaaattcaatagaaagctactggctgtagagattaatggtatacacttaacacaaaaattgatt

SEQ ID NO: 7729 - DNA, 2075 bp, artificial
  synthetic oligonucleotide
aacactcttaactgtgtgtggcagaagaatcttagtccctcccttctttgggagctaagctttccatctaagaaaaagccaaggctgggcatagtggctcatgcctataatctcagcactttgggaggctgaggcaggtggacatgagttacttaaagcatatgtagcttgagcccaggagttcaagaccaacctgtagagtgagaccccatctctacaaaaaaaaaaaaattagctggggtcatggcatatacctgtagtcctagctacttgggaggctgaggtgggagaatcgcttgagcccgggaggttgaggttgcagtgggctgtggttgcaccattgtactccagccttggtgacagggcaagacactgtctccaaaaaaaacgaaaaaaaaaaagtcaagaaaaaatcagatacctcagtccaggtcctagcataactcattaatttaacattcattggccgggcatggtggctcacagccgtaatcccagcactttgggaagccaaggcgggtagatcacgaggtcaggagttcaagaccagcctggccaagatggtaaaaccccgtctctactaaaaatacaaaaattagcccggtgccgtagcaggcacctgtaatcccagctactcaggaggctgaggcaggagaatcacttgaacccggggagcagaggttgcagtgagccgagatcataccactgcactccagcctgggcaacagagtgagactctgtctcaaaaaaaaaaacaaaacaaacaacaacaacaacaacaaaaattcattaaggccttgtattgcttgcagtaggtgaatatgtggcacaatggtgtctttccacgctaactactttctgatggggtctgataaggtcctagactcaagcatgttaaaaccaaccatgcattcttataggcttcataacaacccaaaatggtatttcttgctcacaaaacttcatttggggatttattcaaatgacaccttctcagtgaggccttcttcaccctttgaaaaactgcaaccctcacccctgacactttctatcatcattctctgctttatctttcctttatcactcatcacaggagatattacaattatgttgtttactgcctgtctccctgtccactggattgtcctcccaaatctgttcttcctttcttcctgaacacctcactttccaaccagaaactacatttccctgtctcccttgtggctagggagggccacatgactaagatttctccaatggcatgtgcgcaaaagtaatatgtgaaagtttctgtcaccttcctaaagaagcttctcctggactccctttccttcatgctggctggaactttaaaaatcaaatgctgtgaaagacagaattgaccaacacagcctggaatggtggatggcctcatagaaaagaagctgctggccgggcacggtggctcacacctgtaatcccagcactttgggaggctgagcggggcacatcacgaggtcaggagatcgagaccatcctggctaacacggtgaaaccccgtttctactaaaaatacaaaaaattagccgggcatggtggtgggtgcctgtagtcccagctacttgagaggctaaggcaggagaatcgcttgaacccaggaggcggaggttacagtgagccgagattgcgccactgcactccggcctgggagacagagcgacactctgtctcaaaaaaaaaagaaaagaaaaagaaaagagactgcttaccttctctgggttgttacacgccagagaaccaaacgtctataattttttggccactgtattttggagctctttgttacattattttaccctgtaccctaacaacagcttcctacattagaatgtagagacaaaaaggtcagagattcctgtctgttttgctcatcagtccatccctaccaagtagaacagtgtctggcatgtgataggatactcaataaatatgtgtgaatggattaaatagacaactttattatcatcgccctccccatctccagatcaccttcatggctaccagaaattagattacaaaatccaaatgctccccag

SEQ ID NO: 7730 - DNA, 4966 bp, artificial
  synthetic oligonucleotide
aagaaccttccagcttaccgcactggtacaaattcctgatacttaccacagtcatggctgcgcaggaaaatgtgaacagctgaatattccagctgcaacaataaggtcaaagctcatttcagtattagcaaaagtgattctctgctgagatcttggtcggggatgcaaagtactagcctcaaacctgcaggctggcacctcaacaactgctgcaaattctactgcatgccctggcttcctgggccagcactgcttaattactagactctgatacgatgcagatcacttttcgcaaaagggaagcaatgggcttttagaccaatacttgagttgttcggtttcaaatgttcaaatccttaaaaaaaaaaaaaaaggatttcaacaacttaagtttaatgattttattatgattcagagcccagttgttttccaccataagagtgccacgtgaaaagattatccttttcctaaatacaattagctttcattgccacctttccctttttgtcacccccacgcaacactccaagatcacaagaatctatgtgaaacagctattaagaacaatacccgcttgcattctcaggctaaatgtgagaaaccaattttagtcacttgcttcagcaaagctatcagtacaagccatcacctacggatttcaagatgattgatatgtacaacctctactgctctatgccacaggtaataatctgttccaatttcatactgcatgttcctgggtggggtcaacatttagaaaaccattaacacagcactattctaaaaagggatgtgcaagtattacttttagccagtgtacacttgtgaaagtttcaaatgaaggaaaaatgagagcaaatatatccgatgtatgaaaaatgttagcaacgttttgattaggaataattgcatgaataaaaccaaatcgacatgttctcaaaagatatattttaaggcaggtagaggaaagcactcagctttcaaccctttttcctaactacagaaaaatcaaaatttgcagatgaaccctttcttccacatcattggcagaaataaaatcctattcccgccaccacctcttgcaattaaggaagttgctacaaatagcagcacggaacgtaaatggtcctgtttcgctccattcttaatgtaccctctaggagtaaacaggttactcaaaaaagtcagtagccagaaagcgattttccctatggctaactcccatgaaaatgaaattcccttttctggggattctgaagggggtaaacgtggacggaggagtccagtcacagtccgccttctcccatgggttcaaggtctggagtgctcagtcctccgcgaggcttcagaccagagatcggcagcacgggcagtggcggcgcagcctcctcgcggctgcacatccacccggcccaccctgacaatcacgctcgcctttcaaacaccctaaaggtgagctttgtaggctgggtctccaaagtttgcccggcctccggtcagaagccgcccgctggctgagccctaggcaaggctgagtcttgccctagtctccggctccctcagcccccagctcttcttttgggccaccgtgacaggtctaggtttacctccatgtgctcgtggcagaggaaacaaaagaaagcaacctccctgagaataaaacgccatcttcgactaattggcaaactgaggggtccccgggtcggtccccccacgagtcccccccaccacccagcccgaaggcggcccccagtttcaggcagagtttgtaacagctccgggaagccctggtcgaattgtcctgggggcgagggtgggataccccgagagccctacctgcctcccctccccggccgcctgggcaccgtgtttcggtgaaaaggaagaagaggggtggtggtgtctcccagagacgtaactgccccctcagaaaattgttgtgagggacccggcgaaggggctggcgagcaagcaaaccggcacgcgcggagccgcagcgagtgtacttacaaaacgattcaagctccggcggaacatcgcgtcgaaggctgccgggcgctgagctgggctctaccgggctgtctgggaaggcgccgtccacaaaacacactgcggcgtgggccggcggcgccaagcggagcagcgaggcgggcggccgggccacccgctcgccgcctgcccccctcggctctccgcgctcccccgccccccagccgcccgcagcctagccgccgccccgcctcactcgcggcccgcccccggcctgcctgacccgggggcggcggccccgcggatcgcccttatctggccccggcaccccgggccggcagctcgcgcagcacccactgagaaggcgagcccgccgcgcgggggaaggatggcggaggagcgcgaggctcctcctgtggggagggggcgcccccgtctctccgccagcgccgggctcggcaccccgcgggatgcgctcttccccgacgcggcaccaccgcccgcctccccgctggactccgcggccgcccccctcggggcacggggaaccctcccgaggcaccccgcgcctcacctcgcctcagcccgacactactcccctgtctctgtcgggagccacagcctccctcgccccggccctaactcgtccgccgtgccgcgccgcgccgtttcgctcgcagcccctcctcggtccgcggctgccgcgccgccccgcgctctggtcccgcactcgggccagggagcctgggtacagccaaccggcccgccctgagccagccgacggccagactccctcttccgggcgtggtggagccgggctctgaggcagggcaccgtgaagaccccagcgcgggaggggcggggcggggtgcgaggggggactagttctgaaagcccaccctcctcatctgcaccgacgagggttccccctcgaccctcgcgccgctgtactcccacctacgcggctttccctcctctcagtctttctctcgtcctgcctgcccacctaagccttcttacttccactttctctgaggttgtaaagtcaggctttgtgtcgttgctgctgcgcagcggggcgggatttccctgacccccaccccgccccacccaggcccctcccgctcgccccctccccctccttgctcccggggcagcctgggagttgtagtccaaccgtccccctacttcgcctggtaccgcgggctgggagctcccccacacgctagtcccgggtttgcccagagggttgaagaaggaagcgcgggctgaacagcgggttctccacgccggccggctgggtgtggaggccgggcgcactcggtagccttcctagcggtgggacatgtgagaaggctaaattaggcaaagctccgaatcctgggagctttccctggaacgcaaaatgtgcgcatcaggaaaccctctacaccctcggcccccagcttagagctggaatttgcgaaactttaaaaattacaaaagaaaagcgagtccagaattgccacgaggctgggcatccctcccaactaccacaaccccaccccttttcaccgccccttaaggcggggcccaaggctgttggagaagaacttgcagattcttctataaaagtcaaaaagaaggaaagggagttcagagactcttacacgagtcttccgcctcgccgcgttctcctgccagtttagagctggggacagggcccagccacaccacaggccttcccaaaggtcgcgaataggcctttactactaggcataggcgcttctcctttaccctccggagttcggattcatttcaacaaacctttgctgggaattttctttgtaccaggcactgtgccagggctggacacagcgatttcttaaaagacctccccaacagggtggtcgcaatctggttgggggatacaaacaagcgaaaatgccacgttagaatttaataatagctagagttcaaagtgctagagaaataggggagagcgacattgcatctgaaaatggggtttgggaagttttcctaaaagccctggagattaaactagcccttgaaacgtgggaaggctttagagggacctgactgagcccaaggggacaaagtccagggtagagggagaggtcggtgaaaaagcgcaggacaaactaagaaagagatcacgctgtagtggcagacgcccaggacgtgtaggtaagggcggctcgaacgaaagctaaaatctaaaactcttcaaaaacatgttacgaagtttgaacttcattctgcgatcaacgagaagcccatctcccaataaaatgcaaatgcaggagacctaaggtttgttcccaaactgtcctaactgccaagaagtaaaaccaaccgttttcaattcttcccctcttatgattccttctctgctcacagttgagcctgtatctaatgatttttaagatttatgttaaatttatatttatattaatcagatattatgatattttattgacaaaagagatctaaagttttgctctctactgctttaaagattttcaaatagagttattttctagctttctagctttaccttttttttttttttttttttgagacagtctcactctgtcacccaggctggagtgcagtggcgcgatcttggctcactgcagcctctgcctcctgggttcaagtgattctcgtgcctcagcctcccaagtagctgggattacagatgcctgccaccacacccggctaatttttgtatttttagtagagacggggtttcaccatcttgcccaggtctcgatctcctgacctcaggtgatccacccgcctcggcctcccaaagtgctaggattacaggcgtgagccaccatgcccggcctctagctttacttttattgaacacagcaaatactgtaatttcttcactagtttatttgttgaacgactgctatgtggcagacattattctagatactggaattgggaggtggaggaggttatt

SEQ ID NO: 7731 - DNA, 1301 bp, artificial
  synthetic oligonucleotide
ccttccacaagatgatgaaatatcactgagcataccagcctgtgtggccagccagatcagataacactcagtttgtgaccagcagctgtgtcatcctacctgggtagacatttcatctccactagaattcatcagcaaaccaggagattcttcttaaaaagagagctcccatcaaaacaggaaatagaggtgagcaagccgtccatcacaataggtatctactagagcttctcaaactcctgcctccctccttttatcactgcctttttctagctactgcctcaagtgtacagggctcttctgcaatcccctctgcccttatgagttgaggaatgagatctgataaacctcttcaatttaagaatttgaggacttctaaaagtgtgtgaatgtttataagaaccacagggaatgagcaatgctgggtctatgatgatgagacctcaagtatcaataagtaagctttttgagtgtgttcactgacctactgcctcttgaatgacacctcgtaagtgactgccaagtattctgtgcaataccttctgttttacatttgtgggaaggtctctgccccagtgggctcacctttcaattttcaacacctccttcttactccacccacccccccactctggactactgcaccagtggcttatgagaatcttcctaatcaatcctgaggggaacagagaacacccaacaacaaaagaaacccatcaaatgagtacttacattgtacgtttcattaaaattcagagtaaagctacttccttgactgtgtgtgtacataaatacatatagattgcccacaatcgcccaggcaaccagatagaatattggactttaaaggcacaatggtcatgtcattcttcacaagaagttaattagcttctctcttacagaacactacgaagactatgattggtaatgtctgaactcctgctcagctataagtcataataaataattaggctatttctctggtaactgtcattccttgactgctgaacaatcttctatcattaatgactgttgtattttaccacagggcaggcatgtttccaatggcacccaggtatccacaggaagttttagctaggtctaattactgtaaatctcttgcagacccactcacctccccatcccaatattgctatccaaatgaaattaagcttaaaagaatagacaggtcacaaaagggtggaatagtttatggaccaagtgcatgtgtgttcatcatgcaacagttttctatttctctttaagcactggatcattaggtttcttatctctttggggct

SEQ ID NO: 7732 - DNA, 460 bp, artificial
  synthetic oligonucleotide
ttaataattatgaagtaagtgaagtttgcctttggccctctgtgatagctagagtctgatgatagcccccagggaatcacacgacctggcatttgcacccttgtgtaatctctgcccacattaaatacgggctggcctgtgactggtgttaactaatagactgctgtagaagggacactgtgtcagttctagatctagcctttaagaggactggcagtttctgcttcctatctcttggaatactcacttttgggaaccctgagccactgtgtgaaatgtctagccactcttctgcagagaccacagggagaggtcatgtggagggtagaggccctgagaccatatggagagacatagcagtccagctgtaccagtgtcccagtcaagcctccagatgactccagcctcagctatcatgtgactgcaactgtaggagggctcccaagatagaccagcagag

SEQ ID NO: 7733 - DNA, 4220 bp, artificial
  synthetic oligonucleotide
ctcttcttctcttctaaatttaacttagaaacatgtatttcttttaagggagatgataaaacttaatgataattttattttatgtactaattttcattcttgggaattattagacatattttgctagaagagttagctttatttatgtctgtaaggctttctggatacttagcaattattccacaacaaaaactgcaaaattctaacttttttctctaaatcttaaaaatgattacgttagttcctccaacttttgatgttatttttagctcagtgattttttttttgtttgtttgtttttaacacagtttgctctggaattgtctgcactgaaaaaacattgcattattacaagggatttgttattgaacccaaggaaatgacgttagtgttccataccgttttagcttaattttggtattattatgatgttttaactagctagaatttttagggttttggaaattagtttttttttttccttttttttcctaaaagggactgaactttatattagaacagaaaatctcgtgtttgagcattcatttttatttccttttttctttccccttgctccttcatcttgggattttcaatagttgagagtagtccacacagaatccactctccaccccatttttcttaatgacaaaaacctttgcaagaatgaaggggggatcaataccatttctgaccgttactcttgtaatttgataagtatgaaactaaccccgaagtagtgctttgcagggacagcaggaaagttctcaatcaggactggagcactttccggagacctagtttaacaacttcaacgggcacttggggaaactgaggcccaagaagacgaggcaggcactttccctgtgattttttttcttctacaaaatactactttcgtccacggaaaacacttttctcgggcacctagtgtggggaggacattgctagggtccagactgcctgcctacccacgagggccgcgctctttccacttttattcccccggcctccccggatcggcgccctggatgtgatcgacaccatgaagttgccccataatcctctctggcaacataggatgtaaaatttgatcagctcattggatgaagccgacaagtcccaaaaatgtgtgaaaagggggctaagaggtaggcaggcgccgcgttgaggcagcgctcctgccagccccgctccgagttatcggtgctgcagccgcggcgcaagcgggggctgggaccgagctgcggggccgcagcggcggcggcgaccgaggcggcggcggcggcggcggctgggaggccgcggcgccatgggggggccgtaggagcggaccgtggggccggaagggggcatcgcggcggcgccggcggctgcggggttatctccgcggccgcgaaggcagcatccacgccgttgcgggtggctgagccggcgggcggggcggggcgtgcaccagggccgcgggcgactagcgctgtagcagttggcctcagggccccgccgcccgcgcgcccgcccgcccgcagggcggcgcacgcgaaggaggcggcggccgcagaaggaggcggggagctcggagcaggaggtgaggaggtggaggaccaagagtaggcagcagcggcggcggcggaggaggaggcggtggtggaggtgcgcggcctgaagaggaggatggaggagcagcagaaggagggcgaggccgaggtcgcggagcactggttttccaagtgggagcgccagtgcctggctgaggccgagcaggaggagcagctgccccccgagctgcaggaggaggcggctgcagagttggcagggctcaagagcgagaagcagaagctgtggcacctcttccagatctcggccaccgccgttgctcagctttacaaggattctgggtgccaacagcaaggactttccatgtgggaccccttccagaatgcggccatggccgtgaccagcctctacaaagagagcggggatgcccaccaacgaagttttgacttgggtgtccaggttggccaccagcgtcgcatcaaagatgtgctggagtgggtgaaaaagggccggagcaccattcgtcgcgaagacttgattagcttcctgtgtggcaaagtgccccccgctcctcctccacctcgcactcctaggacacccccgaagccacccactggggtcaccagccaggctgtggcaactgagtccagctcatcggtggacgtcgacctgcagcccttccaggaggcgatcgccctgcatggcctcagtggtgctatggccggcatcagcatgcgatcgggcgactcgcctcaagacagcggtgtcgccagcagtgggcgccgaaaaactagcttcttggaggacgacttgaatcccttcgactcagaggaactggccctccacctggacagtggggggatccgcaagcgcacctcggcccaatgcagtgatggcatcacagactccccaatccaaaagcgcaaccgaatggtctaaactgcctcattggttgcctgccgccatattgcttgagagtgaactcaaccgtcgacatgcttgtctaaaggttactggagaccatttttcttcccttctctaagttaaacaaagatttctaacaattttgccataaagaaactttaaaagtattccagaagaggcttcatatgactctgactttccaaaaaatataatcctagcagagaacaaatatgtagtagttagcaggatcatttaaagcaaacgtatctggtcaaggcaggagtctgatttatcttgttcacagttatattcctcagcacctagcacagttccaggtgctcaataaatgttcattgaatgaataaatgtgaccttatttattcttaaagggaagtcatagcaggtgtttacttggttatagaatacttttttctttgataattgttggctttaatggtctttgccaattcaattgcattgtatcaaaatgtaaaacttgacatctttgtgaaatctggagtcttccatttttacctcactataccatgcacctaatttctagaaagaaactgcaagtaatacatattaggctgtgatttttttaattttgaaaaattgttgattttggtgattatgtgatgctgcaaagaggtgctgtggtggttacgcaggtattacttaatattgagtcaattcagtgcttttttggggaaaactaaaccatcaactgagaccctgatgagatggtggcccagtggtgctctttttttttaggaatgtaaaaattcctttttctgaggttacatcttttttatgatctctgttttgaagtggaagaccaagtagtcagaatgaacttctgggtttttttttttttttcttttttttttttttttaagacagagcctcgcactgttgcccgggctggagtgcaatggcgtgatctcggctcactgcaacctccgcctcccgggttcaagggattctcctgcctcagcctcccgagaagctgggattgcaggtgcctgccaccacgcccggctaattttttgtgtttttagtagagacggggtttcactatgttggccaggctggtctcgaactcctgaccttgtgatccgcccaccttggcctcccaaagtgctgggattacaggcgtgagccaccgtgcccagccttttgaacttctgggttttaattaagggtacagcatggtataaccaaaagagtgtgaacttcgttttaaaaggaccaacagcagaatcctagctctataaattagctgcatgattttgaacaagttacttaatgtctattgacctcagtttttcatctgtaaaatggaactgtgtgtctcctaaggtggttgtgaggatcaggtgaaatttatatttcaagtgtccagcacaatcttggcacataaaatactcaataaaggttctcccttctctataaataaaaatcaataaaacattaaaatcattttattttagaaaaagcagaaaagtagatcagctttaaaatcagcaagtagaatctctgtgtttgaactggaaattactgtttcacattagaaacttgcctaaatatcacagatcttgtgtaagtgtgttgagctcatgagcactcagggtcaccaatctggatactagggcaaccttggagttcctgaagttgcctgaaggatgcactttgcaattaggggtaatgaaacatctaccacctctggcctgaaaaaa

SEQ ID NO: 7734 - DNA, 764 bp, artificial
  synthetic oligonucleotide
gggagtttctgttctagcacatagagggtttgagtaccattttgatctattgttagccttccctagcacgtccatttctcatatttagagtttctggaatggttttaactgaaattatagcatttctctgcccatgaaaaaagcaacatgtttaacacagaggtgctgtgaatttaagttagactaagtccccatgatgaaccctaagataatatgattcacttccacttcaaggcatatatttattgccaaaggaaattcacataaactaaaacatatgcataaatttttgcaggggagggaaccctgaaccaggagtcaggaactgggttctcaaccatgttctggccccaactagctctgtaatttgttttcttaggacttttgttaccgaatatgtaaaatgaggatagaattggactcagtgatcactttctttttatctctaaattctacctcttctttgttttgcttccactctcctactacttgtgatccatgctactttatatgttggtcatgtgattaataatccttcaggttcacagttggagtaaaaatgttactttggggaaacttgccatagtaactaaatggccattgagaacacagaaccgtgaaagggcaacatttcctatgtagttttaccccccagatgcccttgaactgtacagcacttgcatatattagtgatgcaaatctgagagaagaacaagaccaagatgttatgaccaagacactcaatttgcattggaatgccccat

SEQ ID NO: 7735 - DNA, 2311 bp, artificial
  synthetic oligonucleotide
gaggggagggagggagaagaagaagagggagagagagagaaagaggcttatgtgtagagtgtggatttaaaaaaaaatggttcttcactcggaaacaatatttatctaaaagtagttgtctatagttaaggatttattatttgaaatttacagcatcactttttcctttttgctgaaacagttacctcctaatttatgaatcccacaacagcaacatgcaaattgaggttgaaatataatgtgaaaggtctgacattaaggaagccagtttttttttttttacccgaacagaccttcataaaattttaaataatagtgaaacagaagctgtctttattaaaagagtatattattgggagagtattatgtttttatttgtctgataaaaattaatatgttaagagtactgaaaaaagtgtacatgtaggtgaagttctctcaattatcatttaccagtttataagtattctcagaagttgatgattaaaaaaatatagaattaaaaaaactatttttgctccaaggaactctcagttgctggggttttcctttccagatgcaagcatattttgttttgttttgttttgtttttgttttgagacggagttttgctcttgctgcccaggctggagtgcagtggcgccatctcggctcaccacaacctccgcctgccaggttcaagcaagtctcctgcctcagcctcctgagtagctgggattacaggcaggcgccatcacactcggctaattttttttttttttttttttttttgtatttttagtagagacggggtttctccatgttggtcaggctggcctcgaactcctgacctcaggtgatctacctgcttcggcctcccaaagtgctgggattacaggtgtgagccactgcacctggcctaagcacatggtttttaaaaaatacatttggaaacagaaaattatggaaaactgccagaggggctcaagattgatttgctataccaactccagcctcaatcccagagttatagactttctatacaatttatgaattatatgcaatacttctgtattttatcaccgatcatctagaatttttgtcaccaagctatggaattatagcattttagcgttggaactaatcttagagatcacctgcttctaccttctcattgaacagaaagaaatcagaggcccagataggggaagggacttgtttaaggtcatatggaaaatttcctggctaggcctggagcaggtcttcagattcccagtcctgtgttcttttctttcttccagacttcttcttatatgataccaaaggccagagggcacatatcagccactatattctgttagagatcatgttaatgtaaaatttgctgcactccaagtctggttatgttcattttaaaaccattcctcaggctgggtgcagtggctcacccctgtaatcccagcactgtgggaggccgaggtgggccaatcacaaggtcaagagtttgagaccagcctggccagcatggtgaaactccatctctactaaaaatacaaaaaattagctgggcgtagtggtgtgctcctgtaatcccagctactcgggaggctgaggcaggagaatcgcttgaacccgggaggcagaggttgcagtgaaccgagattgagccactgcactccagctcaggtgacagagtgacactccatctcaaaaataaataagtaagtaaataaataaataaaaccattcctcaatggccagctcagaaggcatatgtcttagttttattcttatgagtcccatctttctttcactaatgtattattaatgtgtcttctttctgttctgcaaagttctcaggggaatagctgtgtcctgaatttggaaatggaaatgactgtaggatctattccttttaatctcatggctaggaaatgctgccgtttcaactctccaagattctgcttaaagggattatttaaaatagattttttctagtgctattataaactccacttggctctacaaagtacatgtaccttgatttttatttgccttttttgggagcagtggggtgtttgttttctctgttttttgttttgttttgttttcaatctgcaggctttaaaatttatttgtatagagactcccttatttttcttactaggagctagtttcccttgagcttggagggttcatcacaaattgcttgtaaatcaagatctgattaggaagtaatatattcatctgtaactcctgcataaaagttattcaagtattgtgacaaaataagtgttgtttactttatacattttctgcaaattctaaagat

SEQ ID NO: 7736 - DNA, 1137 bp, artificial
  synthetic oligonucleotide
gagggctccttacacacacctgtggaagggcggtgtggtgcagtgggcttaatactgagcaggggtctggggagcttgtattctctcctgcctttgtcactaagaagctgtgtgactgcagcaagtcattaactgctgttgtgagtttcctcggttgtagaatgaacataatcaggcccatcctgcttaatgagcatggttcctatttggctaacacttatattttctctatagagccaagcacagtgctttacctgtagtagcagcaccaaaaagtacttagggaatgaataaatgaaagtgttttggaaatgagaaagtggtctatgaatgtaagctatgattaataacaaattcaaaagctactgctacagtcgctcagccttaatggtaacttgattcaaaatggttccttacaaaatggaacaaaccgccctaacagacctttgtcttcaaatataagaaaagaaaaacttacactgaccagtcatgtctataagatgtctaaagagccaggtaatttggtcgattcattgaaaaagccaggccaacagtactgggccttgtgcttcaaaggaagctaagtggctcagagccttttgcattgctgctcattggcttgacgttatgtacacacagctatcctttcagtttctacaaaatggcttattttcatttctgaaatggtagccacgtgggagcccctgggttgctgtggagaaggccaggagaggcccagctggttgacagtcattgggctccttgagccctccgctttgccttagccactgttgggaggtgggagtccaaggtttttatagttcttctctcgaattagtgcctgcagactctacagctatgaacatgcaattagtctttgtttgtgcacaaaagggagcttgacccttgcctgtctttgattggcatgcacaactcttgtagctacttacctaaggccctctccaaggagcacagcgtcttgttcctgcacctgccttcagcttttctcttttgtgacttgcttcacataatattcagcccaagtcacagcaagattgcagggatgaagacatcatgcaggcacagtaagatttcctgtttttcagggaggtgggggagtgggtgggagggaggttt

SEQ ID NO: 7737 - DNA, 706 bp, artificial
  synthetic oligonucleotide
ttctctcccttgaaaagtgttattaggaaaaagaaaaactttgttgttctgatattttagaaatctaaaactcgcttctatttggagaaaataaactagatttcatcacctttagctgaaaataataataatattaataatagtaaaacatatgcaacttgaaaagttctttgaagttttcactatgaaaatccactagaacatctttcctcccacacctccccatcgttttaaggctagcaagctgttaatttgtttctccagtttttttctgaagtgggtcttcaccttattcctaaagccatctgggctggtttagctcggtcagagcccaaagctaatgaggccaaggtcagggctgcatccccatggggagcagttagcttggctcccttctttggccataccctgcttccctaaccctaccagctggctttccaccacgtgtttgttttaaaggggggtgagaaagaagaagtgtggccgtggaccctcgctaccagcaacagctgaaagtctgagtctttgtatgaaaaaggcggcacatgaaaaccaatccccaattccactgggccttgaagacagataatcagcactggtggtcatataaaggcaatgatcacagtacagattataattattttctttctaatttatcccctttttcctgagtgtccggccccatcagagagtggcagccacttcc

SEQ ID NO: 7738 - DNA, 1061 bp, artificial
  synthetic oligonucleotide
tgcaatttggggataataattgtacctgcctccagggttattctgaggatttaattaattaatccatgcaaagcacttagcacaaggcctggcatataacagtggatcaatgcagtttttgctgttattatcagtgattaaccgagagctgagggggttggaagagacaggctcattaactgtggatgagcagtgacagctgacagccagatgtggaaagaaagggaattcagaataatgcaaaagcagatgaggcacaataaaggatattaatatagatcaccctgagtcatcaggaaaaggttaaattatgcccaggatgttccatcgaataagacaaatttgtaatacatttagaagggtttccaataaaaataatctaaataaaaagaatttgaacacttaacagaaaataccagttaattggataaattaatttatatggaagttttggttctactgcaagtccagttaaacgaggtactccagtctgaaatatttcctgcaagcaatcttgactctcatgtaggttgcagcctctctgagggcagagactgaatgttttatttcttctgtatctcctgcagagtcagtttggggccaagcacacagctgttagtcctagggtcctcattccccaggttaaaatctgggggcccctccccctgtctccagtacagaacacgtctgccaactgtatcaggtactagcccaacactgagcatggaggggtggtggtcttcccttcatcttgctcctagctgtctttgggagatgagagatgggagcagcatgagagagtttgcaatctcctttcatagcctgttgctgcttactaatacttgccaggtgctcgtgtgtgtgtgtgtgtgtgtgtgtgtgtgaaagagagagagaatatgaatgcattcatcttatggctccagagcattattaggctgttggttcagaattctttggagtatgaagattcctttaaaaataaccatcattttttactgagcaaatcaaacagctgatcttggaagagcttgataaagacatttagatatcaataatca

SEQ ID NO: 7739 - DNA, 1907 bp, artificial
  synthetic oligonucleotide
aatcccattcacagatccttgcttcatagtcaggtgtaagtggccaacagcataaaatattattactctcagtgggatttgcattttccaagcgactaaaatcctaaattgaaaggaggaaactctagtggggcaaatccagccctgatttagagcagagtttctcagtctcagcactgtggacattttgggctggatagttaatttgggggacttgtgcattgtaggatgtttagcaccacctctggcctcaacttactaaatgccagtagtgcaacaatgctttccccagttaagacaaaaatgtctaagcactgctaaatatcccctggggagagaaatcacgcataattatgatccattggtttagaggattctgcagggaagtggggccttccaggatatcttaaatgacacaggggttataagtgcaaatgccttcagggaccaggcagaaatggaaatgcagaaagcagaagagtataatatgataaggagtggtggggcttgtggcaaaatggagggtgtatgccctatttaaaggcattcaaagtaaacatttaaagaaaagctctctggccgggcatggtggctcacacctgtaattccaacactttaggaggctgaggaaggaggattgcttgaggccaggagtttaagataagcttaggaaacatagtgagacctcatctctgcataaatattttaaaattttagctgggaatgagtagtatgtgcctgtagtcccacctactctggaggctgaggcaggaagataagttgaaccctggagttgaacgttgaaatgagctgtgatgatgttactgcactccagcccaggcaacagagcaagaccctgtctcttaaaagaaaagaaataaattaaaaagctctgtaagccagacaaagcatatatgaggactgaaatgggctgccagtttcaagccccaggtgtaggctgtccctcaggatggttcaactgtggtacgtgctctcctcatttgggccagtgattcccccaacccagtttctgcttttcccccctctgccttctgccttcaaaataaggatgcttttaaatagtcaaggcatattttattatcctagaatgtagacttaattttaaagttcactaaaactttcaaacatatatgtgttattcaaatgggcacatttcaaatgtaataatttaaaactgtctatatgttgtgttaaaaatggacaataacttgtaagaacagtaaaggcagggggaaaaatcaacaaaaaccagaaaaacatagatgaaaatattagcaggggttgtgcccaggtgaatttttctctattttttggtttcctatatatttttgtaaagcttaatgttatactggggaaagcatacacttgaaagaagagctctgtgtcatccagtacttgtccagatgggaaaagtgtcatgaaatcaaataaataacaaaaattctaatggctgagctagtcctcctaatccctgcactgtcagaggcttcatgtctgatgaacaagagaacctggagttccctgcgtgtggttattaacattgataataattggaacactaatctctgcccaccacattctgttctctggtcgctttctgctgctttttaatgacgcgcttttgctttttcccatgtattccgcattatacacatgctgtactgctctaccttccctcgatttatgcatgtctctagcagatggttgggccagtccacctcgggtgcttgtttagcataacagagagctcaacaactggggccccactcacaatgttcagcttgcatttctggatactggtggggtaaacacagggttaaggccagcacttgccatttccgacctacctttactgcagctaggggtgggttttcctatttgctttt

SEQ ID NO: 7740 - DNA, 305 bp, artificial
  synthetic oligonucleotide
gatattatcaatctttaaatattttcctacctattaggcaatgtggtatctatctccttaggttataatttgcatttctctgatcactattgaggttgagcatcttttcatatgtatatcggtcatttgcatttcctcttctgtgaattgcttgctcaagtccttttctgtgagtcattttcttttttatttatacttttctgtttttaaaaagaaagagaaatattttgtattttttaagtaaacttgtgatctattgttgatcaaccatattagcagtggaaagcatttactcagttcaaaag

SEQ ID NO: 7741 - DNA, 3216 bp, artificial
  synthetic oligonucleotide
ctctactcttttgaccttcatatgacaaaaaacaaagggaatgtggtcagcatagagagtaggaattgaacacaggaaaaacaagcagccactttcatgagacgaattctggggtcctgagaaaaatctattactcccaatatgtggtagcttccttagctgctggcagaatcctctgatcattcctgccccaccccgctttttttttgagatggagttttgctcttgtagcccaggctgaagtgcaatggcgtagtcttggctcactgtaacctctgcctcctgggttcaagtgattctcctgcttcagcctcccgagtagctaggattacaggcatgcactaccacacctggctaattttgtgtttttagtagagacggggtttcaccatgttggtcagcctggtcttgaactcttgacctcaggtgatccacctgccttggcctcccgaagtgctgggattagaggtatgagtccctgcgcctggctttttttttttttttttttttttgagactgagtctcactctgctgcacaggctggagtgcagtggtgtgatctctgctcactgcaacctctgcctcccggattcaagcaattctcctgcctcagcctcccgagtagctggaattacaggcacatgccaccactcctggctaatttgagtaatttttttttttttggtagagatgcgttttcaccatgttggccaggctgatctcaaactcctgacctcaggtgatccgctcgcctcggcctctcaaagtgctgggcttacaggtgtgagccaccgcactcggccttctgatcatttctttattaagctggaagtggagaacttttgttgttgttgaacattcataacctctagaggggagattttgcaggccactacacacacacacacacacacacacacacacacacacacacaaacacacacatacacacaacactttaaagaaaataaactattcaactaatctacttttaaattgaggaaacattgacggttaaccacagaaagtattaaaattatgcttcactcccatataatggctggttttagaggggagagaggggaaagaaggaacagggacatccctgttcccccgcccccgccccaccccccactccccacagacacagcagaagaaaaggtgaggaagtcatattgtattcctattttatacagtgtagtgtgctaggccttgtacattaattaggtcaataatcctcacaacaattctatcattggacccagtttacagatgaggaagttaaggctcaaagagtttaagttacttgcccaaattatcatgcaagtcgcagagccagtaatccagcccggggttcctctaggctttaaagcccatatgctgccaaacaaggtagagaggtacaggaggtgagagtgttcatcagaggccacatcctggggctctgggattcacagtatttattacttgttacccccctctttgaaatgctaattagctgttgttccctgcttgttaagtgctttcatccttaaagcttgacaggttttttccttttttctttttttactaaatgaggcaaccatcatttcccacaaagctgcaaactattttctacccttaggccaaataagcagagtcatcccaggtttaggtaaagcccagcccaaggaccttatctgaccccccattctcccaatggtaaaggtttgaattcccattaaaatgcagatgcctctaaaaggagttaacactagcactgtcaggtctctgcagtccgagggtatatgagtatatgaccttttccaagggcaggtttgaatggggatgaagtcatatttgcaaaagaaccctggacagtgagctggccccagccaggagagcatatgtacacacctcccccgtctccccacacaccaggtggatttaaggccgtttaagaggaggtggcttcaatttagcaataaaaagccagtatcatcgcttacaaactgtgtgactatttggctagtggttaggaatcagggagtcaggacaggatctgtgtcctgaagggtaaagcagaactgttcattctaggatttgttgggcctgaaggagcttctttctaccaattaaccgcattaaagtggaacttgggcttccaagacaatgcaggggccccatctatgtacagccagaatagtctaaagtcttaatggcatttattttcctctcaagttgttagaataaaacagtgtgccatatttatcccttcttctgccaagaaagctctcctgatgttctcggttgaaattaattttcccctccccatattcccatagccttttgcttgcacttctattccagcgtttcccagtgtcatccttattagtgttatttatgtgcgcatctgtctcctcttccagattatgagctcctggagggcagaaactgcagtttattcatctctatcccccatgggctgcacacagggccccgcacatcgtaagcactcaataactgcttgttgaattgaattattactctctaccgctgttgttgtgattggcattcattcatttagtccatttgccccttaaaaatctcctgccaagactcaaaagtaaagatgcacaagtacaaagagacatgtttttaacagttgatgttttttacttgtttcatttaaaatggacccaaatgaaaagaaatgttttcttaggtcttgccggctagacagaaaaggttatcagcagattaagaggagtgttctcaaacagcatcaagtgtctttcagtgtgaccaatgggtgaagacctttgtgtggccgtaaaagctggcttaaaggctacttggattcattctgacatatgtcatattttcaagagaggtgttgaaagcagagtcaaacaaacagccagtcaaagtgccgctcagcgcactggaattggcattacatgaaagcgttagtgagcacctcggtgaacaaggttgcccccaggtcttccccgggagctacttgaaaagttgagaagtgtactgggggttctcatcacatagtcacattccctccattccacgccatgtagctggcctcacggacactttgtagtgactacattctagctgtcaggttgtgtttgtcttcagtgcattgatgctatcagttgaaaacagcacatctttatagacggacacattttaggaaactccatggcatataaagtacagatt

SEQ ID NO: 7742 - DNA, 1786 bp, artificial
  synthetic oligonucleotide
actatgaattgggcacaaaataggagtggttagttacccaaaagatagctgtcatttttgtagataggaaaacagaagtgtccatgatcagccattagaagagagtaattagagctcagtgaacacctctgctttccagaaggtacactctcacattggttcctggccagagagccaaaggaagctgggccatgataagaattacaagctaactgcccatccaggtgttagggggacaatgccatcacttatgagcctctatggtcccttggcctcttctgagggcagcctccatctattaaatttcaacagttttcataatagtcacctaattaggggattgagagtgaaatcagggggaaatctatgcctcattcactggaaagcagtgactttcctgtactgtggatgagagacaaaagatcataactgattttctgcccttcccaagggaacagtttgtaatagtctaaagcaatcaagcagaaaaatgaattggctttcccactctgcagtcctaggggaaagtattataaaaggtcaccaaattgctatatttgtgtaattaaatccaacactttgatcaatttgatgaggacagcattctctgttgcctttgagatctgtaaaccaactctctcttctctggctttgctgactttctagctgatgttcataagtaacatcaaaggcttgcttttgatgagagcccatatcttgctttcataccaacagaattgtccatggaaataataaaatgacaagactaaaattgaaggaagtgataggaatacagagggaatggcttcaaatgaatgagtttctgaattataggcactctaaaacaagtctgctacttggggaatatttcccatgtgccgtttgatgaaatcaatgttcatttgaagaaatagaccttctgctcctctaagttctctttgctgttaagttagcaatgaatgcaaccaaaaagggtatgactggacaagaccagacaagaccaccatctgttcccaatggaaggttgcacaaacagtctctgttctgccactgagatgctctctgtgtaactttgacttaactgacttaacttctaggagctgtgctccctcttcccccagcccacattctgtttagaacataactaactgcaccttttgtatttcttggtctctccttctggtcttccttctgaccatcaggaggatgccaaagaaagagcgctcatcacacttgcagtgaataccaaaagttaagagtcagaacttggcagaagatgaaccacttactggtatgatgaccttgggcaagttactaaaaccgtacaccttcgtttcttcatttccaaaattaggataatagaaacaacctcacaggattgttgtgagattaaaagtagtttgaaacctgtaaagtactgaaaacattgcctatatcacagtaattgtacattcttcattaaagcaaccactggattgaatacctagtatgtgtagaaagtgctgtggggcatatggtacattacgtgaagattatacgagtgtgtgaaaggcaacatagtatagtggaaagaacatgaacttggactcagaaatctggtttaaatcaccactctgactcttgctctgtgacctcaagcagataacccaaactctctgattctgtctccccatctgtagcatggggtcgatgacaacttacatggttctgctgataattaaataacataatgcacatgagaggttcacaaatctacagggggagcacctacagcctagtacatgag

SEQ ID NO: 7743 - DNA, 2278 bp, artificial
  synthetic oligonucleotide
aaacatctagaatagaagtatctgagctgggctttgttgctcctttgcaagcagagagttaaaatttaaccaaggcactcatgcctcactgcagctggcagggattcagtgggaacctgccggcacccacatgataactcacaatccccctcctgcgcttaaacaactctttcctcctcctcttatttggaatcccagtaaaggtcataggggaatacatccattatcaggaatttaaacctaaaatctaagtatgttctcttttgtcatgaataatcaaagttctaaactgatattttagaaatcaggtgcagttcatgagtagtgaattgagtgtgtctaattacattttatagtcatttaacagctgttaataatgtaattttgtgttatgcccaatttgcactgaattactttaatagcacacattgtatttattttccttttggtgaaacagtaatcaaacactagggactcaagttggacatggaaataaatgatttattatttttacaggtttgaagaacagggatttttaaaaagaaaagagtaaatcctattataaaactaagagtagttgaacacacccaaatgcatttgttttctcaggcattccttttcgtaaaaataataatactaataatttaatgagcacaatacatttgtttcctatccaagtctgtatcgtttgatgtgcaccaagtgtttgcaaatatacatttgactgacaagctaatgagatttcccctcccacccccaaatatccttctgaaatgaaaagtccagatttctaagtttttggtgtatgagtgaaagagacacagcattcatttaaatagactccgcaaaggaaactttccaaggtgaggctagagcagaaaagcagtgtaaagacaggagggaatacagctttaatagaagaaaaaggcaaacaaggtaagcaggtatttctcccacaagttagaagaaacttctacgtgagaccttaattagggtaaaaagaagggtcaatcctggacccccctgcccccaaaatggtgggataattggaatggtacattatgaaaggcctgctgtacatttcccattcactttaagcacttgaagacccaagcatctaatactgtgcccatatggaagtgttttctgcagcccacatggatcaatgccctttgtatttgaagcaagctacaagagtagaacagaaaggaattctctctagctgtgggacactggctgccatcactccatccaagacttgacttagcattttctgcctttgcccacttgcttcctagggcctatgtgggaagaactacaaatggatggccttccctccaggagagccagagttattttgcaatctgtcgatagtaggaggctaatttcatctccactatttctcaggccctagtgattggggcaatgttgtgtcaagtgggggagagtggtgggagagttccaccccaggtgcaggcaataaggaggagaggatggcactgcctgtggtgaatttaaaaacaataataaaactgactcaaagtctgtctgcttttcatgctcatcatgtgctagccatcctaaacaatgtcagtgataaaatccttcttcctgcggggttgcctgctcccactgctgctgttctcacgtgggtattccattgggttgtgggtgggggtggggctctgagccctcacactatgggagagttactggcccccaacccctccaggctgtacccctttcttgtaatggtgggcattattatgttattctgcaactagcatcaaagtcactctcctctaggcctcctgctggtcctgattagcagctgccacttctgtacccatgttctttagcctttgcagggctcttctcatcactgctgttgctcttgccagtgtgtgggtgggttctcttcctgccaatgtttgcagctctttattagcttcgtaaagggtgttgtggctcttttagttgacagagctttctgttgaaaaatttgggacaagttgccaagggctggcttgagggcatttaagtgacaccacccgatgtcttacttctgccaacaatcagccactgtccccagccaaagcacatggcctttggatctttcgtgcttcagggtgaattctttccttacccagagcactagtctcagaagttggtggataaagggatagacttgaggcttaatcctgggatcctggagactaactccaaaggtacagttctcttcacctgaccaatctttcagggctgttaggacagagtt

SEQ ID NO: 7744 - DNA, 10822 bp, artificial
  synthetic oligonucleotide
attagcatgacaatcccagactggaagcattagtgatggaaaccactctgaagtgagtggcatgtctactcttgctgttgatgaaggtcacagatccccaggataatgaagaaaaggatgactctggaaggaatggctagagatacaaacccacaatccaattcaggtaactgagtataaatgtgattgtaaagtagcaaagctaactttcagacagaggtaacactttttgaatcttatctaaataaatgctgttcttctaagtattcatcctgaatggttatacactattcctacccatgctagctgtcaaataactttaataactcttttgggaattgtcttcaggtctagattataaactccatgcaaaaattattgtcatatataaaactggatttaaaattggaagatctagtttcatgcttcagctctgttgctaatcagactggatcaaaacaaaaacaaaaacaaaaaccagacacatgagctggaagctgcccactgacaaggccatttcttttcagctcgtataggccctgatccacctctttgatttctgtgtagtcttaaagacctatcaatttactttgtgacctagagagtgagcagggctggtagcagcagcggcggcagcagcagcagcaactaccgtcaagggcttaaaatcatgggaaagagcaggagttgctctatttatatcagaaaaaaaatagcttttaaggcgaaaactataagaagggacaaagaaggtcactatgtaatgataaaggggtcaattcagcaagagaatataacaatttttaaatatatatgcacaaaacactggagcacccagatatataaaacaaatattattagagctaaacagagacatggacaccaatacaataatagctgaagatttcaacaccccactttcagcactggacagatcttccagatagaaaatcaacaaagacacatcagactcaatctgcactacagaccaaatggatttaatagatatttacaggacatttcatccaagggaggcagaatacacattcttttcctcagcacatggatcattctcaaggatacaccatgttaggtcacaaaacaagttataaaatgttgaaaaaatagaaataggccaggtgcagtcacacacacctgcaatcccagcactttggaaggcccaggcactcagatcacttgagctcaggagtttgagacaagcctggacaacatagcaaaacctcatatctacaaagaaatgcaaaaaattagccaggtgtgatagtgcacacctgtagtctgcactatctgggaggctgaggtgggcagatgacctgagcctgggaagttgaagctgcagtaagtcatgattgcactgttgcactgcagcctgggtgacatagtgagaccctgtcttaaaagaaaaattgaaataatatcaagcgtcttctctgaccacaatggaataaaactagaaattagtaatgagaggaattttggaaactacacaggcacatggaaattaaacaatatgctcgtgaatgaccagtgggtcaatgaagaagttaataaggaaattgaaaaaatttttgaaacaaatgataatgcaaacatgacataccaaaacctatggcatagagcaaaagcagtactaagagggaagttcatagctagaaatgcctacatcaacaaagagaaaaaatttcaaatgggcaatctaataacgcaacttaaagaactagaaaagcaagagcaaatcaaacccaaaattagtagaagaaaataaaaaataaagatcagagcagaaataaataaaattgaaatttttaagaaagtgcaaaatatcaatgaaacaaaagttgattttttgaaacgttaaacaaaattgacaaacatttagccagactaagaaaaaaaagaagatccaagtaaatagaatcagaaatgaaaaaggagacattacaactgatactgcagaaattcgaaggatcattagtggctactatgagctactgtatgccaataaattggaaaatctagaagaaatggacacatttctagacacatacaacctatcaagattgaactatgaagaaataccaaacctgaacagatcaataacaagtaatgcgattgaagctataataaaaagtctcccagtaaaaaaaaaaaaaaaaaaaaaaaaaaaaagcctggaaactgatggcttcactgctgaattttaccaaacatttaaagaagaattaataccactcctattcaaactattctgaaaaatagaggaggaggagggaattcttccaaactcattctacaaggccagtattaccctcataccaaaaccaggcaaagacacatcaaataaagaaaattacagcccaatatctctgaagaatattgatgcaaaagtcctcaacaaaatactagcaagccgaattcaacaatacattagaaatatcacataccatgaccaagtggggtttgaccctgggatgcaaagatggttcaacatatgcaaatcaattaatgtgatacatcgcatcaacaaaatgatgggtaaaaacaaaatgatcatttcaattgatgctgaaaaagcatttaataaaattcaatatccattcataataaaaaccctcaaaaaactgaggatagagagaacttaacataatgaaaaccatatatggcaagctcacagatagtaccatactgcttggggaaaaatgggaagcctttcctctaagatctggaaaatgccaaggatgcctactgtaaccattgttattcaacataatactggaagtcttagctacagcaatcagacaaaaaaaaagatataaagggcatccaaattggcaaggaagaagtgaaattatccttgtttgctgatgatatgatcatatatttggaaaaacctaaagactccacaagaagactattagaactgataaataaattcactaaagttgtaggatacacaatcaacatacaaaaatcagtaggatttctatatgccaacagggaacaatgtgaaaaagaaacaaaaaagcaattgcatttacaatagccacacatagaattgaaaacctagaaattaatttaaccaaagaagtaaaagatgtctataatgaaaactgtaaaacactgatgaaagacattgaagaagacaccaaaaaatggaaaaatattccatgttcatggattggaagaatcaatattgttaaaatattcatagtacccagagcaatctatagattcaatgtaatccccatgacattcttcacagaaataaaaaagaaaatcctaaaatttttatggaaccacaaaagactcagaatagtcaaagttatcctaagcaaaaagaacaaagctggaggaatcacattaccttacttcaaattatactacagagccacattaactataacaacatggtactggcataaaaacagacacatagaccaatggagcagaatagagaaactagaaacaaatccatacacctacagtgaactcatttttgacaaaagtgtcaagaacatacactggggaaaagacagtcttttcaataaatggtgatgggaaaactggatatccatatgcagaagaatgaaactggaccctttctcttgccatatacaaaaataaaataaacatggattaataaaataaacatggattaaagacttcagtctgagaccttaaactatgaaactagtacaagaaaacattggggacaatgtccttttcccaggacattggtctgggcaaagatttcttgagcaatacctcacaagcataggcaatcaaagcaaacatggacaaatgggatcacatcaagttaaaaagcttctgcatagcaaaggatacaatcagcaaagtgaagagacaacccacaaaatgggagaaaatatttgcaaactacccatctgacaaggcattagtaaccagaatatataaggagctcaaacaagtctataggaaaaagtctaataatgttatcaaaaaatgggcaaaagatttgaatagacatttctcaaaagaagatgtacaaatggcaaacaggcatacgaaaaggtgctcaacatcacgattatcagagaaatgcaaatcaaaactacaatgagatatcatctaatcccagttaaaacggattatatccaaaagacaagcaatagcaaatgcaggcgagggtgtggagaaaagggaactcttgtacactgttggtggcaatgtaaattagtgcaaccactatggagaacagtgtggaggtccttcaaacaaccaaaaagagagggaaatgtcaactgtgctggtgggattagacacgcctgcagtgaagaagcagaagctgagcagtgacgagaccagcaaccctcacctctctggagaggagaatgatgatgctgtcagtagaaagtggtacaatcactgaacaccctgatatacctacaaacatgccaaatgcacctggaaggcaaagttggggaaagggaaaatggaagtcaaagaaatgcaaatgtgctttcaaatgtgtaaatagtctcaaggaacatcataaccaaccactgtttggagttcaatttaattagcacagtaaagaagaagatccattactgtttgcaactgtaggaagcaacagagttaccttgtatgaatgtcattgacaaggagaaattcggttgttgcaatcttgtgtggacgctgatgctgacgaaacttttacacttgtgcatggacctatgatagcaatagaagcataattgggatgattaatcccacaacaacgcagtgtaaaaagcactatattggccacggaaatgctatcaatgagctgaaattccaccttagagatccaaatctactcctatcagtaagtaaagatcatgctttatgattatggaataatggacacactggtggcaatatttggaagcatagaagggcacagagttgaagttctaagcgctggttgtgatcttttgcgtgaaaaaataatgtcctgtggtatggatcactcaaactttggtggatcaattcaaagagaatgatgaattcaattaggaaatcttatgattataacccaagtaaaacttacaggccatttaattctcagaaaatccattttctgatttttctatcagagacatacacaggaattatgttgatcgtctgtgatggttaggtgatttgatactttctaagtcttgtgaaaatgcagttgtgttggaaacctggcaaaacggaaggtgatatagatacaattcaacctggtgactctaatgtgactattcttaggtgatttgattgtagccagtgtgatatttggtacatgagattttctatgaatttctggcaaaagatgcttacattgggcaatcaagttggaaaactttatgtttgaaattcagaagtttaagatcctcataaagccaaatgtacaacactaactcatcgtaaatgtgatgctgctattcaacaaaccagttttagcagggatagcagcattcttatagttgtttgtgatgatgccagtatttggctctgggtttgactttgataaaacactttcacctaatcaaaattagagtgtattgtctgtataaaatagaattcatgtagtttgctagtaagggcacatagagcatttagagttgtctttcggcattcaatcaggttgagctgaatgtagtgatgtttacaccgtttacattctttgtactgtcttcctgctcagattctactgctttctaataaaaatttgtttttgtaaagctgtgtgttgcttttgttattttcattgtgatggaaaaaagttgaaagtgtcactataaagcaaccacacaaacaagccaacatcataaccagctaacaacaaaatgacaaaatcaaatccacacatatcaatactaaccttgaatgtaaatgaaataaatgcctcacttagaaggaacagactggcaagctggattaaaaacaaacaaacaaacacaagacccaatgctatgctatcttcaaaagacctatttcacatgtaatgacacccaggggctcaaaatgaaggaatggaggaaaatctacctagcaaatggaaaacagaaaaaggcagggatagcaatcttaatttcagacaaaacagacttcaaaccaacaaagatcaaagaggggcattacataatggtaaaggtttcaattcaacacaaagacgtaactatcttaaaaatatattatatatgcacccaacacatgagtacccagatttataaagcaagttcttagagatgtacaaagaaacatagactcccactcaataataatgggagacttcaacactccagtgacagtattagatcattcaggcaaaaaaattaacaaagatattcaggacctgaactcaaccttggaccaagtgaatctgatagacctctacagaactctccaccccaaaacaacagaatatacattcttctcatcaccacatggcacatactctaaaattaaccacataatttgacataaaacaattctcagcaaatgcaaaagaactgaaataataccaaatacatgctcggaccatggtacaataaaaatagaagtcaagactaagaaaatcactcaaaaccatacaattacatggaaattaaacaacatggttctcaaggacttttgggtaaataatgaaattaaggcagaaatcaagaagttctttgaaactaatgagaacaaagagacaatgtgccagaatctctggggtgcagcaaaaccagtgttaaaaaggaaatttttagcactaaatacccacatcaaaaagccattagaaaaaccccaaattaacaacctaacatcacaactaaaagaactatagaaccaagagcaaaccccaaagccagcagaagacaagaaataaccaagatcagagtggaactgaaggagatagagacacaaaaaaaccttcaaaaaatcaccgaatcgaggagttgcttttttctggaaaaaaaaaaaagaattaaaatatatagaccactaactagactaataaagaagaaaagagagaagaatcaaatagacataattagaaatgataaggaggatatcatcactgaccccacagaaatacaaacaaccatcagagaatactataaacaactctatgcacgtacactagaaaatctagaaaaaaaggatagattcctgggcacatacatgctccctagactgaaccaagaagaattgaatgcctgaatagatcaataatgagttctgaaattgaggcagtaataaatagtttaccaaccaaaaaaagcccaggaccaaatggatttacagctgaattctaccagtggtacaaagaagatctggtacaattcctacagaaactattacaaaaaactaaggaggagtgactcttccctaacttattctatgaggccagcatcatcctgataccaaaacctggcggagacacaacggaaaaacaaaactccaatatccctgatgaacatcaatgcaaaatgctcaacaaaacacttgcaaactgcatcaagccacatatcaaaaagctaatctactgtgatcaagtaggcttcataccagggatgcaagtttggttcaatatatgcaaatcaataaatgtgattcatcacataaacagaactaaaagcaaaaaccacaagacaaagctttcgataaaattcaacattccttcatgttaaaaactctcaacaaactaggtcttaaaggaatatacctcaaaataataagaaccatctgtgataaacccacagtcaacagcatattgaatgggctggaagcattccccttgaaaataggcacaagacaaggatgccctctctcaccactcgtactcaacatagtattggaagtcttagccagagcaatcaggcaagagaaagacgtaaagtgcacccaaataggaagagaggaagtaaaagtatctttgtttgcagatgacatgattctacatctagaaaatcccatagtcctagctcaaagtctccttcagctgataaacaacttcagcagtttcagaatacaaaacaatgtgcaaaaatcactagcatttctgtacactaacaacagccaagctgagagccaaatcagaaaggcaatcaatctcattcacaattgccacaaaagaataaaatacctaggaatacagctaaccagggaggtgaaatatctctacaatcagaagtacaagacactgctcaaagaaatcagagaagacacaaacaaatggaaaaacattccatgctcatgtatagaatgaattaatatcattaaaatggccatactgcccaaagcaaattacagattcaatgctattcctataaaactaccaatgacattcttcacagaactagaaaaaaaactattgtaaaattcatatggaaccaaaaaagagccctaatagccaaggcagtcctaagcaaaaataacaaagctggaggcatcaagttatccaacctcaaactataccgcagagctacagtaaccaaaacagcatagtactggtataaaaacatgcacttagaccaagggaacagaatagagagcccagaaataaggtgacacatatatgaccatctgatttttgacaaagctgacaaaaacaagcaatggggaaaatactccccattcaataaatggtgctgggataactggctaaccatatgcagaagattgaaactgagccctttccttacaccatatacaaaaatcaactcaagatggattaaagacttaaacataaaggccaagtttataaaaaccttggaagacaacctaggcaataccatcctggacagaggaatgggcaaagattttttgacaaagataccgaaagcaattatgacaaaagcaaaaactgacagatgggatctaattaagctaaagagcttctacacagcaagaaactatcaacagtgtaaacagacaacctacagaatgggagaaaatattggcaaaccatgcatgtgacaaaggtctaatatccagtatccatgaggggcttagaataatttacaagagaaaatcaaaaaaacagcctcattaaaaattgggcaaaggacatgaacagacactttcataaagaagacatacataggaaaaacaagcacatgcaaaaagctcaatatcactgatcattagagaaattcaaatcaaaaccaaaatgagatagcaactcacaccagtcagaacggctattattataaaatcaaaaaataacagatgctggcaatgttgcagagaatagggaacacttacacactgttagtgggagtataaattagtttcaccattgtggaaagcagtatggcaatgtctcaaagagctaaaaacaggactaccatttgacccagcagtctcattactgggtatatacccagaagaatacaaatcattctaccataaagatgcatgcacacgaatgttcattacagcactatttacaacaacaaagacatggaatcaacctgaatgtcatgaatgacagactggatagagaaactgtggtacatatataccatggaatactatgcagccatgaaaaagaatgagatcatgtcttttgtgggaatgtggatggatctggaggctattatccttagcaaactaacacaggaacagaaaaccaaatacccccatgttctgacttataagtgggagctaaatgatgacaacttatgaacacaaagaagagaacaacagacactggggtctatttgagggtggagggtggaaggggggacaggttcagaaaagataactattgagtactgggttaatacctgggtgatgaaataatctgtacaacaaatccccatgacacaagtttacctatgtaataaatctttacatctacccccacacctaaaagttttaaaaagaaaggaagaaaaataaataaataaaataaaaattgagctaccacatgatccaacaatcccacttctgggtacatacccaaaagaaaggaagtcagtatatcaaagagatatctgcactcctatgtctgttgcagcactgtttacaatagctaagatttggaagcaacctaaatgtttataaacagatgaatggataaataaaacatggtacatatacacaatggagtactattcagccataaaaaagagtgagatgctgtcatttgcaaccacatggatggaactagagatcattatgttaagtgaaataaagtaggcacagaaagacatacatctcatgttctcacttatttgtggcatccagaaatccaagcaattaaacccatggagatagagagaagaacagaggctgggaagggcagtggggggttggagagggaggtgggaatggttaacaggtacaaaaaaatagaaagaatgagtaagacttactattttatagcacaatagagtgactatagtcaataaaaacttaattgtacatttaaaaataactaaaagagtgtatttagattatttgtaactcaaaggataaatgcttgaggggatggatacccaattctccatggtgtgattattacacattgtatgaccatatcaaaacatcacatatagcccataaatatacacacctactatgtatccacaagaaataaaaataaaataataaaaacaataatacataaaatcatgagcagcttttgttttggcagaactggtaccccactttcagctgtgcaaagacaacaaccactactttaattccaagtagtggtaaaggagtgcttcattttgggactgcctgctaaccagtcacaagtacatattttgccaggctggataccaacaacctt

SEQ ID NO: 7745 - DNA, 1464 bp, artificial
  synthetic oligonucleotide
ttatctggagtcttgagttttatagatgccaagtcctacctgttctattttcttaagctgttgggcctgcccctataccacacagctggcacccctaaggaagtacgtgagggagttcatctcagtcaaccaggcaccattcagatctttggtcctgagccattttttgctctgcactaatttccagtatttctgacttctaccctcatttttcattggcagtctcacctttatcctacattcctcatgttcagtattgcttccccagaaaacatcattggctcccttttttttactagtatctaaactcccttatcctgtggagatggggcttgatgaggctctcatagtgccaagagttgtttgtgagagtatcctgtgtatagctacaaaggatgctcaaattgagatggtgtgcagagaggagaggcaagtgggaactcaaggtcaataaagcagagaaaggcatgaaaatgtgtcaggaagctgggtaggccatgaggggcagttattgaaagtcaagctatgcagttagggaatagaggcacagtgaaatgagagtaaacattagcatattgaaaggtcaagcgagcaagaggacaagtctagctggatatctgaaatgagcattatgattattattattattgagacagggtctcactctgtcaccaaggctggaatacagtggtgccatcacagctcactgcagcctctatttcctgggctcaagtgatcctcccatctcagtccctcgagtagctaggaccacaagcaggcaccaccatgccaggctaatttttttattattattatttttgtagtgatggggtcttgccatgttgcccaggttagtcttgaattcctgggctcaagtgaccctcttatcttggcctcccaaagtgctggatttataggtatgagcaccacaccaagcctacccaggcatattattcatggccaatctaatacctcctccatctatggcatggtacacaggaggacctgatggatttagactgccaaatggcaaacaccactgtataaggtaggctagcctacattgtgctaactacccacaattttagtaatacacatttctatttcattcttgctacatgtcttacatgggttgccatctagaaagaggttgcttacattaatggcttaccagtcattaaatgctctggcctaggagtaactcacatcacttctgctcatggtccattggcctgagctaatcctatggtcctgcccatcaatactccatgagcgctaatttagccacaggcagcactcagatgatatccatggctacaccagggccttgacattgacatagcccctccatgaatggcactttgtccaggttcactccagctccacacttgggtcttggacagtaaaatttccaatacaacagcccatctgctggccacatataacattactctatgggaaaac

SEQ ID NO: 7746 - DNA, 1680 bp, artificial
  synthetic oligonucleotide
aataacaataacattaagtatcatttattgagtgcttatcatttaaggtgccaaactccttgctaagagctttgcatgcattgcctcatttaatcttaacaacagtatgagttccttcctctccatggcctcagtttctcctgcaagtaagcaagacacaacccaatggcagagagcagagagctgagaaggcaatagccaagagctgcagcagaaagattctctgctccccaggagctggtgaccgattcctttgtctggctttgttaatgaattccttaatgctgaaagtattaaaaatacattgtcaatctattcagtgctgccaaaaggaaatacgtccatttcccacttaccatattggagttacttcaaacataattcctatatattccactgggaaactatttattgaataaattcagaaattaacagttgggctatttatgcctccctggcaggagataattgtacattgacaggtagatgatttctagaggcctatggacctagtgggcagattttaagtaaatggccaaccttcccttccctcccccctcaggctctttctggagagaaaggtgtgctagatgtgtcatggaaacttcccgcttgaacctgcctgtgtttgcccacctgagcctcagaggtgtttaccatattgtgagagctgttattgtgctgtacacaaatggagccctcttgtcttccactttcagcatttgatgaatttgtttttgaggcaccatccttcagtacatttcatttgattacttttccctttgacttaccttttttccaaagctttctcattagtcctcataggaaccaagacaaggtgtacaatttggcagcgaggaaattgggatttaataagtcccctgcacaatccagcatgtctacaaataatttgtaggattaggctccccagcctcatttggaactggatgcagctgacctgaataatgaaagttatgaatcccctcccagcattgcttcattagaatccccttacaaaataagaaataagactcatctcatcagctcgattttatggcatctgattagaccactattttctcagcaggtcccttttctttaaactgttgactatggatggcctgctgaatagaatgaactttggaccactaaattgcagcattatggttattttgtgtaatttatgaaaagcgggagaagccatgatcacttacttcttgttgctaatgatatcaccatttatctgaacaggtgtgggtttggaatattcctcccactcccgatactcaacctggaacactgcccaagtagagaccccaaaaatgatatttggaggtactgactctacagatggcaaattaaaaattaatggcacctgcacaagtcttcatgaatgtctactatcagcagcctttcaggaagctatgcattttaactgtgtttacctaataagtccctctatttgttgtttgacttacaattcaacaaatttggtgaaagcctaagtgggctgtcagtgtaacaacctctgttagtacatcatcatctccctattttgagatataaggcaaggtgttgaaattatgtagtaattatttcaagcattatgattaaagtggtacaacatgccaatcttttctggttagtgggaaatccacagtcacaaccacattgcaaatg

SEQ ID NO: 7747 - DNA, 16546 bp, artificial
  synthetic oligonucleotide
cagtgttggaaaggcacccagagctataacagcttataacaaggagatccatcctattctgaagaagggcaacatgaaaacctctctaaaagaagtggtgctagggccaggcatcgtgcctcatgcctgtaatcccagaactttggaaggctgaggttggaagactgcttgaggccaagaggtggagaccagcctgggccacatagcaagaccctgtctctccaaaaataagaaaagaaaaagtggctgagtgtggtggctcacacctgtaatttcagcactttgcgaagctgaggcaggaggattgcttgagcctaggagttcaagaccaccctggacaacatagtgaagccccatctctatgaaaaaaaaagtgatgcttgaactgggatgttcagaaggacactggactatttgagaagcaagcttggaaaagaactttctaggcagaggaaatagcaagttcaaaagccctgaggcaagaaagaaacagtgcctttttgtcaatggatgtaattgttaggaaatctgtgcttgatgtgtggatttgggggaaatcctacagatgcaaaaaataaaatatgtactgtgcataataatctttatttaagacaattactagactttaaaatgtgttgagatatgaaactaacacaaaccataatctattcattcaacaaacatttctcaaaaggaatcctggctgaggttgagcgaaggaagactaagaggtccaaggagttgaacccagagaggtaggtaagagctggatcaggcaatgcttttgagagttgggatattttttaaagagcaatcaataggaagccaccagaaagttctttaaaaagtaacaatgaaaggatttatgttgggcaagtggagtgaatgttctagggataatgggttgaagcgggcagagtagaagcagtgagaacaggtagaagaaggccatggcagaggtccaacaagaaatgacagtagtggtgtggatgaggatggtgacgatggaaaggagagacacagcatgttgtatgtattccactcagctggttggtgctcacctaacctctcctctgcctgacctgggaacccacccctgggcttgctctctgcccccttctcaagagggcagtgagggttgattgggcccctgcatttaagcgccttctggttcctcagcggccccagctccccgcagcccaggctgttcagcttggctcccaaggaggtctttttctccagtgagtgggtctgaagaatgacggagccgctcactaatctgatcctgctcctgcttactgaggaggggaattggcagggggttgctctggtgtgcttgtcctgcttgtgttaactgcaggccccaacctggagaaaagctagaggattactgctcctggggctccctgccccctccccatcccaaaacagctgaaggaaaggcttgaacttttctctttcacaaggagacacaattttgtatttgtgatagggagagaatatattttaaacctgccttttctagtgataacaggaatgcaatcctattagagaaaattggaaagtatgagaaggatgactaaccagtattcataacactaccctgcatttttgcatgtttctccagtcgaatatacttattttaaatagtcaaggtcatatacactgaatatagttctgtgtatcttgctgtttatgctttgtgctttaagcttttccttgtgtcattaaaaatttctctgtaaacgattttcatgtctgcaaagcagactttttaaaacattttacctaacctttctccatttgttggacatttggtctgtttggaacttttttgcataagaagggctgtgatgagtatctttgttataaatctttggctgcattttggatgcgcttcttcagccccaaccctcacccactcctagatttctagaagggggattaatgaaggaagttgtatagtcagaagataggaaagcaaaactctacctagggtaattcccaccaaaaagtagctctgcacctatcatagaagctaaaaaatggactagccattttccctcggtaaggacttgatgcttcccacatcacatcattcacgaagaggtggctagtaggagtctctgtgtcaggaattgcctttctctagaggccccgctggattatggctttgaggggcagctggggctgtgatttcactggtttatctcttggttttgtggccggcagaggagagagtaccctcccaggcctgggagtgtggttccactgcgccgcggtagaaccagctacgcaaccttgagcaccgtcatttccccttttggggccagtttcctcctatgtaaaacaaggaagaggagggaggaggaattggagtttgaccagatttcattattgttgctgtttaagcagcagaacccttattacaaattaaaccttatcagaaccccaatctataaaatggattaaggttcggttgccctgatagacgtgagtggggaggagtgggggaggggccccagtttgaaaactctggcctagaagatgaaagtttcattctagttcagttccgttctcttccctattgctgaaggaaagaaaaaaaaatcatttttcatctgtatttaaatcctcctaatgtgctgattgatgaaatcttttcccttaagggcaatttggaaatcagacaaagtgaagcacaaagccatggatgtttagagagagagtgagcggtatgtgagacacactgaaagggtgaccctggcacttctaagaaggcagcagcacaatggactcttcgaaagaagcagtgtcagagtttattcccctgttggcaccgcctcccacagtgggggcgaattgcttgtttttaccctccctttcctggagtcatttcagaccaaatttgagtccacaattgctagcaattggaaacccagagtaacctacggacaggtattttattgaaggccaaacacggtaaaaatatggtggggggatagatgggacaaaagagtttcctctcgcccctgggtttttggagcacccgggttgaggggccaggggagatgaggctcactgaccaggcagcttgcaggtttgctccaatcacagcagcaaggattgaagcaccaaccagccgggaggggggcgaggtctgtggccctgggattgggagaagggggagtggtaccaaggctaagactgaacccgaacccgagcctggacgcgcggcaggaccaggaggaggactgggtggagggcaaagcgtatgggtctgtaaatcaacgccggccccctcccaccccatgctgcacagtgggggatggaatgcggggggtgagggttggcagtggaaatgtcttagggggctggtgctgccttcccagggagacccgacctttcttgaagaggcggagtgggtttagtctccaggatccgcagtgatgtgtaaaaagcgggcacgacccccgaagcctcagaaagccccctccccacccccccaccaggccctccccggcccgcaggtgaatgactggcccacacaaaggaagccggctggaaatgtggaattcggaccaatttacgggagactctgtcgcctagggtcccagcggacctcaagcaaagaaacctgtggtcagtagtggatgaggataaaaacagtgcaccaggccaagcttattggaaaggctgagtttagttattctgggatagcgaggtaacaggattaaagggattaaggaaatcacctcaaacagctgaggagggggtaaaaaaacactggttctatttgttttcttcctaggccccaaacagatacactggggccgtgtggctgggcgcgaaactaaaggcccttcggggggcacagtggaatggccaagggtcagggactggaggaaagtggggagggggatggagtggggagggggatggagtagaaagcgggctcgagactctggatgaaaaggagccttctctggaaaacaaataggtggactgagttgacatgttaaaaacaaaacgcctgggaggagtttcggagatctttgaaaatctaaggagtactttttaataccaaatcttccagcgctgaatgttgactccggcggttcagctaccagggttgaaacgtatttgtttcctgctggggatccctgtaaccatttatttttaataggatcatcgagatttccgaagggttttcgttttgtaaatatttcagctaggctcaaatgtcttcccgccccagtgcacaaaggtaaaagtgccccgtttttggtcggtttcagcggccgcgcctttccagccccgcctcgcgtggctgcggcagcagacactttcagcagacgctcactgcgatcaacaagtgcgcggccgcgggctctgcgcattagctactactgtgtgcccgctctcgggagacgctcctggaagactcggaactctgttccgagtttcagttgagaatattggaagctggtgtatggtggatcaccagtagttaaaaggaaaccatttcagattatgcttgcctccccccaggtcccaccccgcccctaggatgggatctcagttgtaaaaccgagtgttggttcctccccaacctgcaaaaaagtttcagggccgcaaaattatcaggactccatcatgttggttataaaatttattgatctcatttaggaattaagagtaaaagcttgaaaaccctgaaacaaagtagcccctccccactacccaaacgaaatctgaacacattagcgcgaagaaatatcaaacagatcacggcagaaatcaccaactcaacatgattggacagaagctgtcccgcggccaggggcggcgaggcgggagacacacgcacacctggctataaattaacattggctttagctgccgcgctgcttggagcggtcagcgccccaaaaaaccacgaggaaaacagacgcgacacgactgggggcgtaggcgttgcagttctccagctggcctcacccgatactatgtttctcccattcactccttggctaactgcaaactaacaagacaacattttcaaatgtaacagaataaccctggaactcaggaggaggagtgggggctgttttttctttgcaaataacacagcgattcccagcctacaaaggtgaaaggagcagcggcgtggggcaagagagctctctagaagtcccattttcgctgctcctgacttatttttgcttttgtacaaaacccgacagctacagcaaaactttcagccctccccatcatcggtacaaggcaacagtcccaggcaagcaaagctaaacaaggcgtcccaacttgggggtgcggggcgggagtgggggtgggggtggggaacaagggtggacgagcgcaggccggtgctcagatgtgggtcagcggcaccgttccgttgactgcagtcccggcgccctggtagtgctggtgcacgccgtgcaggcgaccgccgggcagcggagaggcggcgtcggccgcgtccccgccgggtggcaggtacatgctgatcatgtcgcgcaggtcgccgaggcacgcgcgctgagagtgcgatgcgatggcgggcggcggcgagctgggctcagacttcactaccgagcccatggggcccaggctcatggcggctgcggccgcagctgcggccgcggcggtggcgggctgctgcccgtaggcggcggccgcggctgctgtggctgagggcgccatgcccccgtagcccgaggcggcggcggccgcggcagcgacgttcatgtagctctgagcgccgggcggcatcattgggctgtactgcaggccggccatgtcgtagcggtgcatcggcggcagcgcgggcggcggcggcgggctgctcatgctcgggggctgcgcgtagcccagctgctcctgcaccagcgagtacgcgccgttggcccagccgttcacgtgcgtgtacgtgtccaggcgctggcccacgcccaccggactgctggcggcagcggctgcggccgcggcagcggcggcggcggccgcggcaccgggaggcaggaggccgctgggcagggagtacttatctttcttgagcagcgtcttggtcttgcggcgcggtcggtacttgtagtccggatactccttcatgtgcacggcgcgaagtcgcttggcctcgtcgatgaatggtcgcttctcggcgtcggtcagcagtttccagtcggcgcccaagcgcttgctgatctcagaattgtgcatcttggggttctccagggccattttgcgccgctgcccgcgggaccataccatgaaggcgttcatgggccgtttcacacggtcctggtctgtacccccgccacctccgctcgcaccaccgctgctgccgccgcccgagttcgcgccgccggctgcgttcgcactactcttgcctgcgcctcccggggctgcggggccgccggtgcccgccgcttgtgtgggtgtccctacggggttcttgagttcagtctccagaaggctgtacattgccggggcgggaagaaggtgcgccagcgtggcgggaggagaaggcgctcccggggctggagcggccacggtgaaaaggccctgggactccgtcggagcggagcttgggggcctgtgggccagcgagtccggcgggaagggtaggcttatcaaaatgctccgcgccaaatcagcaggaacccgcgggcttctcgcacctgatgagttctctcgaacaggtcgcattcacagtctgcctgggctctagctgggccccttatatacctgctcggattccccggggttggggcttggtccgcccctcgcaacccggaggacccgtgattgacaggttcgcagtgatgcgccctggccaatcattaccgagcccccgttcggcctggctggaaaaaaaaaagttcggggagccctttcgttcaccccacgcccctctttggcctagtgacgtggtaagagttacttaggaggcgggagtccacgaggcccactcagaggccaccaattagggtttcaaaaagtttgaaagaacgaaacctgaggaggtgacggggggaggggggagggggcacgcaagcagattggggggagggggcagaggggcgccttcggaatttagaaaacaactttgcaaccctgtcaaggcagaccggcgccccatcccccggccagcccgcaaagcttcccgttgtctgcacggaggttttctggccgcttctgctgccagcgctaggaacgcagggcaccaccagctacccaggccggcttagggactccaggctcattggaagtgctcctggctgcgtctccaagaagctctccctggaattggccgctggttgtccagatctttctctaggagggccagtgcgtccaggacgcagcgtgggtcaggggcccgggcatgggagacaggcttcaggactgcggggtgcattcggctgtgaggctcttgggggtttgcaggagggcgggcaagcagtcagtcgcccgtctcctgagcctgtcggaggcgctcgcacaaggtggtgtggaaagtatgtgtgggacgtagggggtgaactggcctccgctctctcgatcctggcccccgcttagcggcccctttttgtctctgctctgtggccatttcggtttttccagtccgatgcccctgagggggagggtcgggccccttggaaaatccgttttcatggcaacacggagcctctcagagtgaaagaaaagtttcttggaggggggaacgttggccggagcggagccgaggccgtcctccgggcgaaccgccgggccccctccactgcccccgcacctgccgggaccgctgagcgctactctgggcgcgcagcctcgccgcctcccccgggagcaggctctgctaacggattccgtccgtctcttttattgttttagagacttcctgagattcggagcgggacattcacttgcttgttgggttatctgccaaagactagcggcgcgggaactctggctgcggggagaggaaaccccgataatcgccactgccagctgaagcgagtggcacagcgtttgaaactctcggagcagcccgaggtagcgagtgggaatgagaagccatcccggcagatttggcagaaactaaaataaggtgtccatacggtgtggggtctcgcccccccatcatccctagccccgtggaaaggtggggaactaaacggaaagcataatcttaagtgggtggggggcgcatgggggaatcccaggtttctagcgtcttagcgttaatgcaagaccaggcgatcccgggacttctgcatgctgggctcttccccctttctctccacgaattaaaaagtacgcctcttcggcttgttagtggggtcagggggggagtggaggctcagggcaggccagccccctctcggccaggcggacctctggcaaaagaatcccggctcccagtcggcatcatctctcggaagtttggggtctggaaacttgccccttaagtttgtgttccacttgatctgagtattctgcagccaagggctgcagtcaactggatgggtatacggatttagggttttaaatgtaagtaaactctctggaaggcttctgtgtgtagatacagtgtgtgtgtgtgtgtgtgtgtgtgtgtgtgtgtgcgcgcgcgcgcgcgcgcgcgtagcgaacgtgagctgataagtacgtctcagaaaacataatgattaggcaatccctacctgcacctgttttcttggcgaagtggccgacaaggtcaaactttcttaggcaaatccatcctctcctacagaagccaatgtgcaatatctctgccctcctgccgtctttcccgcatgccctctctgggcttttctgggccctggaggctgttgctaagtgaagcgcgttttaggaaactacccaaccgacgcgcggcctggcgtccagtagcttcacagatgtcaggtttctttccaagttttaggacccaagtaaacgttgcagtgacagcgcctgggctgcatatttcccaaggcaggggatacggtgctgggccgacaccctccccgcagcagattaccaggggaaactagtcactgctcccagctgtctgacatttgatcacacttagcccgaggcttaggtgagctcatttttgccctacatcctcctgccagatttacagcagtcttttgccaggaccaggcacactctcccaattctcccggcttctcgctgaggccagctccctctcggggggtagatacataaaatctccgtatctggtggttctggggtgatctgcacattctcaagtaagagccacgccagatttccttggaaactcttgccaggacactttctaaatacaagctatcatttcaatagacaagcaaggttaccattgcgggcgtggggagatgggggaaggctggaaataaatcagttcttagcccacctgcagcgcaggcttagccaccagcccagcggcgcaaccttcgctaagggtcgggagaggtgtcgcgacaggtaccacagcgcaggaggcctcggttccggctggggctgcgggaaggcagggcagctggcggagccccaactccagtgtctccgacgcgcaccctgcacccagcgaggaaagcagaggaacgcagtgggaaccaggaccgatccttcaacctcttcaggagaagagagcgcgctcagcagctctctcgccctctccagcctccaagtgcccttgggcggttcacagagctccggatctggcgctgggaacccgaccaaggcctcctccccattcccccgcccttcctagagagctcccgctccctccgactggagccagccctggggctcccagaacccagggcgcgacaatagcgccgtttgttggcttcggttggaaacttcacccagcgtagcctcttgccgcttcgccctgcggggcttggaggtcgccccaaccttcgaaagagaccaagcggatttgcggcggagcagatgtgatgcctatccttagagggcgggttatagcaaaactccgggaccaagactctagcgtgactggcccaatgggctttgggtacatagggcacccctgctctgccttcttcctatttctaggcttggccgacatcaggtgtcccaagtgccttatatctgcaaagaacactcagcaattgtgccttagagctactggtggaaagagcaggaaaggagctgtcccacgactcgcgcggaggtatctgcattgattcctcttcagtaactgctcataggggacctttttcaaggtccctggcatgattaggacccaacttattagaagaggtgccctcagccgggcgcggtggctcaagcctgtaataccagcactttgggaggccgaggcgggtggattacctaaggtcaggagctcgagaccagactggcctacatggcgaaaccccgtctctactaaaagtacaaaaattagcctggcttggtggcgtgcgcctgtaatcccagctactcaggaggctgaggcaggagaatcccttgaacccgggaggcggaggttgcagtgagccgagattgcgccactgcactccagccagggcgacaagagcgagagactccgtctcaaaaaaaaaaaaaaaaaagaaaagaaaagaaggagaagaagaagaagggtgtcctctgcgtgctgggtggtttggggccgatgtgtgtctgtgtcgcttgggggacggagagtcggagagtggggtggggtgggcggtatttgggctcgcctgggcccgctgaagcctgacaatagggtcagcaaaggttgccctccggctgtggcctagcgttcgcctttcaggtttctcaagtgtagccaagcccagctcggggtctggcttttaggaagtgagaacaacttatcctggggactctcggagacgccttgattttcaacagacaaacaaaaccaaaaacaaacccgcaacagtttgcgtttcttaaagcagtcatttctatcttttcccttgagaacaccccttgtctgtttactctggcttctagccaagattgtgtatttaggccgctgatcgagagccttgatcaaaaaatcataggcttaggtctattgtagaaccatcccttgtaaaaaaaaaaaaaaaaaaaggtcagaaaggtcaccatcatttcaacggggtggtagagacagcaccttccagttcctggagcattcagtaggaaccccagccccactccgccaacgcgtagcaccgtctccagcggaagtactctttcttacaggtcacagaagcagctgaagaccctaggctggtgggtgtagattgtaataacttagtcgatggtctctaaagaaaggttgctaggagctgcgaggtatgggaaaacaaggtcctcgaggtaccataaagtctcctgcgggctgtacaactgtattctatcgtagtttggtgttgctcttttttgggagggtgcgggggtacttttaaaaaagtttccgcattcaattcacttggttggctgagctgtacttggaaaatacactgggagtcccctcggcccacacgttggcgctcagtttccttccacccacagagtattcaggtgttaatcaccagctctcttttccctatgtgcgcagcaactccaaggaatttgacaacctttgccttctgcttttactcgctgacctcaccacccgaaagttgccattttcccggaggaaggaaggctctgcccatgcactgggtcccatttccagcgggctttgctgagccatcgctgtcagcctctttgcctctcacccccctcctacacccgtctttgcccatccccacaactctcctcacgcgctcagctccgcagactgccaaacccccacccctgcggagcaactcggggaactcggccccctacgtccaggcctgccctcccactgggcctgttgccctttccacttccttttgtgactgcagaggcacagcgctcacctgtacagaggcgaggtgacctgcaggaagccggggccaataaagtaatcttaaaatcgttatcagtatgcaatgctgtttgagtttttccatgtctccacaattccattcgggtccaccaggcaaggcagcgcttctcgggaaagggtgcctggaaaatcagtggacctccaggcacttccagcgtgaccaagcaaagctatcgccccaaccacagggggcgcaggatggcagggggttgggtagagcatcctggagaaaattttaaattcgaaggcagcactcagcggttccttttccactcttttatttatttctttgtttttctttttatttatcattttcttttaagagagtggaaagccgtggaatttggtgcgcagaatttctatgttctcttttcatctcttcaacgccctcattttttttttttttttttcatttcactaacctttgtcatccacctgctatgtgctgagttgtgcaccaagtacgggacggagaccctgcactttcccattccgtatcagatagtggcaatggcttgggaaagtctcaagaggactccggattcggagagaaagaaattttcgcctgatgctaccccatccccctagttgatctacggagaaatcgggcctcgcgagaagcgcaacatcttggacaaggacctggcgtgagcggggtcgctacgccccgacctgcaggggccacgctcattccccagcgcgcgcgcgctttcccacggcggcgcagagtccagctagcggagaggcggagggggaagcgcccgcgtgcctggagccctggcggtccagcgtcccggcgttgccgtctgagtggcctaaaagggaggctctggggccgctgctcgcgacggagagcggggacgcggcccaggaacagctaacgtgccgcttgctgcttgccaggtatggaggatgcctatcctcaggcagacccgtttccccgcgggctggcggccagacggcgcgacaaaatgagatctgtcgagaggtctggccgtgatggctttttggcgtctaggccgctgtcatcccaattccatttctccgaaaagcatcgccgagttaggacgtcggggctttgctaatgtgatgtttgtgtaattaacaccatctccccttgtttctgaacatatttcctcccgcagcacagaccagctttcatttgaaaaagcaacgggaagaacgtcccaataaccctttctaatgggaaaaaactgccccttttgtggaatggtttctttacaaagccaacaaccaaccttattttctagttccaatggctatccctttatgagttatattattaaagaaatccgacactaattgtgccgatttaacttgttaattagttgcaaataaactattcattagtggtaaaataaaataaaacccatgtgtctagatatcattccacattcacatattgtagtgtctgcataacataggcatactaaattaagttcctaaaaggtttctcctcaggataaataattaaaatatattctactttaattgacattatagaggacataaatgagcttttccttttagaaagaaatagccatttctaaataaagcttgcagtctggagaatggaggcttcagccaaatgaatagtcattactaccttttcaacgacgtgggccttttgatcagaaaagaaattagctctaaaaaacagacaatggaagcctgccctgcaataggaagaaaattagacggccaaggctcttcacaacacctatttctataaaccatagagctccttgcttttcaattacagctgttcatttcatataaggaaaggggaaaaacaggcctctaatgtaaactcgctttcaccataaagccttgttcctggctcacagccaggctgcctacttactattgtttttagtcctgtcatcaattagctaatactatatattttaaatgactctgggggtattcacagactccctccccacttccccactcagacaaaacccaagctggactttcatgaaaggactaccattcggtacacagacacttatatacataaagtttaatgtttttattgtttccaaaaaaaaaaaaaaaccatattgaaaaccctgctttgtttttttttctatatttctcagtccatcattgaaagacccagacgagatgatgacagagggacataaatgagcagctttcagtattgtttctaattgttcacagagctcaatccatctctagataattttgctatgccctttagaccataatttggtttgtacatctttgtgttttaaaaataaaatttttgaaatttgctaaccccattggtttggtgtcattagatataatttcattttagaaatattaattctttaccattttggtgaaattatctagcctgcaagaaaaaaaattatgtttttatggtgtgctacaaaataaaacctttcaatacacataaagtaataatatgagaaaaaaattcagtaataatagcagtgagtcttagtaagcctgtagatatatgttctagaaacatcaaaatagagttataggctgggaaggctttacttcctttgaaagtaaaatgcttatctatctgatctttataaatcactgtataaattccttgaataactaaacaatagtgcaattcaatggggttggttggcgattttcctgtttagggttgtgctaataaaattgcttagaatctttttaaaatacagttaaggataattgatttgttcacaaaacaaagaacattttaacaaaactataaattcacttaaaccaaataacataataaccatggacgggtccctgagaggtgtcattcccttgatgctttaaataaagttaaacagaggtagatggccagtttagaaaggatggacggagtagagccactaggatgactattcaaagtatgcatttctgaagaacaatgacaaaaaagttgctaccaaaatgcttcttatgggccagatgtggtggcccacatctgtaatcctagcactttgggagactgaaatgtgaggattgcttgaggctaggggttcaagaccagcctatgcaacatggtgagaccccgtctctacaaaaaataaatttagccaggcatggtggcatgcgcatgtagtcccagctactcacgaagctgaggtaggaggattgcttgagcccaggaggtcgaggctgcagtgagccatgatcatgtcactgcactccagcctgggtgacagagcgacactgtctcaacaaaacaaaacaaaatgaaacaaaaatacttcgtatgctcctgtattcagcatgtatttcttgttgaaaattgatgcttccatttgatggcttcttgtcacatttttatcaaaaatatggatgaattggtatgtttgctttttgcttttgagcattaacttctttgttgctttgttcaaatggatgtcagagtggagttcttaaaagcattttgccaaagagtatgacattgccatatctgatttccttggcaactggaagaaggtgcttttccttggcaatcaagtcccttgactcttcctacccttgggttcctataataaagggcatcatcttaccagtatgcaagggtgagacggtccctcttgtctattgcattatgatggtgcctgctttcacagagaattctgcaggagccagaggaaaactgccacgttcccaaggtgaagtttagtggtaggagttagcaatgtgtggttgctaatcagtagcctggaagttgtccagactgagagctatgcgagtattttggtgagtctgatcttatgtactatagcacttggttttctttttggaaagaggtatcaatatgtgatgttgtggtcaaccgagaaggagtttgagggagtcccaaaactgctgtcaaagaaaactgaagctttaactgcagctttggaaggggacaacatatgtagcagaactatttctcaggatgctgacgtaaaatagagcctgggtgtttccttgttttaaaattaaggaaacgaagggatcctaatgcttgagaagaaatcccccagggcagaatccttgtacagaagccttgaattgcgccagtcgatttttgttagatcttggtgaataagagcacaggctcaagggtcacatggacataagtaagcaaggtcaataaaaatgtgtcacacttacattctaggggaagacgggaacaataaacataaacaaatgaataaagagaattagtgagtgtctggaagtaataagtgctaggaagacaaagtaggatatgggtctagagtgtgatgggagttgatgttttaaatagaatgttcaggaaatgcctctttgggaggtgatgcatgtgccaaaatctgaagtgagtaagcactcaaataatgccattcatcatcatcatcatcatcatcatcatcatcatcatcatcatgaccatcaccaccaccattaccactggctggcagtgatttgtaatctccaacccagccctaaaactctaagattgtaggaagaagagggtga

SEQ ID NO: 7748 - DNA, 2622 bp, artificial
  synthetic oligonucleotide
cttcattacagtctgtagagcctgcagacccttgggagaatcctcaggcctttccaccaagtcttcaacaggaacagccctgcttgtctcttattgttgggatttttgtagaagcttttggaggcagagggcggtggggcagcaaaggcaaaaaaccaaaaaggtagttacttagataccactattttaaagtaaaacctacggtgttaagtgctgtaaaacagtctaaacaaaagagacactctgtcttcttgtttgacaaaagtcttttttatttttttatttttttcttgttaaggtccagccattctgtttatacttccaggaagtttggagatagatgggtgcccttccaccattcccaccatcttactgagtggataagatactttccctttctccactatttaattcagaggtcttcaaacttttggggaggcaacagtttagctatctcaaagcataaagctacccaaagacaggttgtgctaaattccctgtttggggccagagctagtgggttctctcttctgtacaggcagagcattctgtattgacctctgcaacagccactaacacagtgtaatgctattgcctattttgtattcgtcagccccccacccctgagataatccgatcctcttaatggcatggcctttctgtgtgccctagcagtgggccctgcagagaatgagtgcttcttcaggtttgagcagagaagggaagaaatgggagaggggaggggaaggggaggggatggtgtggagaagtcttgaccacagagggctgactaattgccagaacaaggcctaggaaagaatctgggcctgaagagctgagtggtaacgggagtagtggagtatgtatgaggacaggggaggagagcaagggccatggtattcagggattctactctccaagcgtttcctgatgacttctgtgggaaagcatttctcacttcctggaatccagcccttccctatttctaggcctgagctgtgaaggttcagctgtctttgaaagggtttcctctgtaacatggggactctaatccagaggctgaagaggagtcacagtctttctgagtctagtaagttgtcacttgacctgaagggttttaggcagatactttaggagaaggtcaaatgtggccttagggaaactagcatttccagatcgcatgctcaaagctctgtccagggtacattcacttgtgagtttatttatccatcctccatcctatccccccacccccgggtcaccgcgtgtgatgttcttcaaggccttctctttactaaattgctaagagtcaggatttgtatttgaatctgcagcctcatgcggagcaggacaaatctcttcaactttgaacagccgtgatttcatgccacaggagaagaggatagtttgttttttttttttttctgattttgattgattgatattgatattttagttactaacgtgctgcattattctactttggccaccctgataataacttttgatgcttcacacagggagatcactgttttcccccactgcttaagaaagaaaaattttgtgaaaactttggatgtgagagtcatgcaaaaacgcatagcaatcatcaggaaaatgtcttcattaacgcagaaacaatggttccttacccaccagtatgttaatgtatgttaaaccagtctgttgacatgtaaattctaatttgcacacctcaggttttacctgcctcactcactgctaggacttctgaggaaaccctctttgaaaaaatgtttctagcttttatgtcctacagtttccccaacagacagaattccaacaagcaatgactctgtaggatgactaaagaactgaggcatctgccaaactaagacgtgcttgcttaataaaggaaaaaacattcagcctagttttcataacatattttgcaattgagagttttattaaccatttatcctgtgagcattcagaaagggtacaagaagaatcaaaggatacaattttagaaatctcaataaccataagtctgccttaatagttcatgcacatcatgcatgttgggaccgaaagatagtaagatatctccactgtctttattcagtcttatttaatatattattaaaattgggcaagggaccagctcagacccgtgtatgaatgagcatatggctgttggtcaagttggccactgaatccactcactactgtagctatggagtaggagaaactttatttcagacacgctgtcaaccaggaattgacttgtctggacaagacagtttgtttgcttttattgtcctcaaattaaactactctctgtccgactcttcaacttgtctcaaatgtttgatgaaacactgggagaattgtcaatatcgctcaacttctaagtcactaaacatcctaattctttacattccttgcagctgaggccattttccttcagaattctttcaagcagttgggagggtggagggttctgtgagacaccagggggggttagagcctttactttggccttgcagactggtgatcgttctcagccagagagaggtgtggagcttgtgtagaggcttacaaagtgctaatgactaaaagaaaaatcagcataggttaata

SEQ ID NO: 7749 - DNA, 2198 bp, artificial
  synthetic oligonucleotide
acaagcaagaatgtacaggcacagacaccgactcacacccaatgcgtgaatatatgtatattatgtacacatggatacatagacatgcagaagctcacagagatgaatatttgcaagcagtaaacataaggacaaaacgtccacatggacacagatgccattttgtatgcctggactcgtgcagagataaatacaggtgaatacagatacagtcccacaaacttacatatgtacacctagacatggctacagcccccaaacaagacaggatttcacccacttaaatgatgacacactcaaaacccccattacaggcaaggcgtggcagttcgtgcctgtaatcccagcactttgagaggctgaggcgggtggatcacccgaggtcaggagtttgagaccagacaggccaacatggtgaaaccccgtctccactaaaaattcaaaaattagctgggcgtggtggcaggcgcctgtaatcccagctacttgggaggctgaggcaggagaatcgcttgaacccgggaggcagaggttgcagtgagccgagatcgagccattgcactccagcctgggcgacaagagtgaaactccacctcaaaaaacaacaacaaaaaacaaaaacaaaaaaaaccattacaggcccatgcataaagagctctataaatgtacttgcatatatagacatttaaatgcacaggcagatgtacactcagatgccatgtatacccacacagaaataccgaagcagactacatcctaagcatgtaagagacatacacatatatctatagataatacctacctaaacacactttagacatgcatatgtacatatagacatccactggcacacaaatgcacagatgtacagacttgcaccctcacgtgtcaacatacacacacgttggcatgcacatatccacactgttctacaaatctatgttcgtgacatacaagtcctaaatgcacattgaatatatgtatatacacgtatacatgtgccagtgtaggtatatggatgcatttatagacttaatcatgccacaaacagaaacagatttacacacgcacagacattagagacacatgcaatttatacatatgaaaagcagagacacctaaccacgaagaagcacctttacaaaggtggctatgacttttttttttttttctgagacagagtcttgctctgtcatccaggctggagtgcagtggcgtgatctcagctcactgtaacctccacctcccaggttcaagcagttctctgcctcagcctcctaagtagctgggattactggcacccaccaccacgcctggctaatttttgtatttttagtagagacggggtttcaccatcttagctaggctggtctcaaactcctgacctcaggtgatccacccgtcttggtctcccgaagtgctgggattacaggcatgagccactgcgcccagccgaggctgtgacttttaacgtgtccttgtcttagtctcttcaagagagaatgaaaattatcaagctcctgctaaatacactgtgtaaaagtagatgtggacattaccagaaggatctctaaaagattttgagttcacatgtgagtatgcacacacctcacaaacccacgtgcacatgcgctttcgcgtgcacagaatcagagatatagcatcacatggaatcacagaaatagaaacatgtgcatagccacatatagaaagatacatggacagacacacaccccactgaaatgtcaaactgtaatatttaaatgcatgtctattgaagttaaaaaaaaaaacctgcatttttatcccagctccatcacttactagttcaatgatttgaggtcattttcttgtcttctcacctgtaacatgagagtaatattagcacctatcttttagagttctttgaagatgtagtgaaatgaagggcttagcccagtgcttagaatgtcatagatgttgctgcttattgctgttatcttttggttttggtacaaagtgcttagctagataggatttggtttttgtggtcaaactgcatgattatatcatagagatgtattaatcaactttttttgtaaaggtattaataaagaataatttattaatgtaatatagattacatccacaaacaaggtcatttctgaaattctcagcggtgataagggattattactgtctctggcaaatggaaagac

SEQ ID NO: 7750 - DNA, 1160 bp, artificial
  synthetic oligonucleotide
cttagtttgcctaaaataaacttgtacaattgtcttcacaaaaccatagaaatgactctatagctattataatatcttagtatgtaatagtttaatataaatttgagaaggaaaatatgaaaaatcatgtttataaatagtggaagatggctgtaatgtggaagttctcccagattacatttctttttcttacaaatatgaatacatcacggatgaagagctaacatgagttaatatccatacattttaataacaaaaatgggaattttttgcaataatgccttgtctagattactgtttatttcagagaaaaccttggcattaaccaaattgatgtagaccccatataggcaatacatttgctgaaccttacacacaaacaaacacaaaacacaaacccaaattaagatgactactggacagggattcagatgacttctgattccaagactaactcactgatctgaaccaccatttccttgtctttcaactgtggggctttgactgaaaaatctctaagggatcttccagttctgacatacttaatctaagattttattaatgtaccataatgcattaacatttttttgctggtagttctttacaaaagtaatatattcaatacatagtgttctattgctatctcaatgaaccataattgtttattactctagtaagtatcaaatattgaggttaactaaacccacaggagaaaatgtattatttatgcaattcacacctctggacaaatctcaatcactgcttcctggaaggcagtaatggttgtaataaaccgataggactgtagtccaaacataacaatggcctgttacggaattgtaaaaatacttgaattgatgagttcgctatttgatgtttcatacttgcaaatgttaactcacattttgaaaaactcactaggtttttatctgtgataaatacacaaattaaaggcatatttgcaaagtggtagcttttatttttaagagggtctcacccaaagctctgccttgcttttcagtaaatgagtcttgcaaggcctactggggtattagaaatccagcaaatgaattcacaaccttggcttccagaaatgtccttgaaaaactggaggtcatgctctttgcttatttttatttttctttagctgacaaagcaat

SEQ ID NO: 7751 - DNA, 1204 bp, artificial
  synthetic oligonucleotide
tttggtcttctcaaggtcagaccaatttttaaatataatttttctgaatatcatgttttagtgttctgagaaagtagaaataatgatcctgaggggcaaagacttctgaaaccctttctgatggaaactatggttcacaatgattaaagtctcctcctggtctgtgactttctttgaaaggcttaaaagcacactgttcctcccctgagtgtatttcttaaagaaattcttgcacacctgcacagaaagtatgtaccagaatgttcattttatcattatcagtgatagcaataaaattgtgtctaaatgttccatcaatgggaaaagagataaataaataaggtatatttggaatggaatgaactccaaataaggtatatttggaaaggaagctatggaatgaactccatagcgacatccatcagcatgggtgaatctcaaaactgcaaagcaaaaattgctggatgataaatgtggtgggataacatttatacaaagtcttaagtcatgcaaaatgtgtctgtttggataagctaggtaatgctgccttaacactcccaaatctcagttgcttaatgccatgatacgtttagcacagattatctggaggcctccgttcgtgggtcactcagagtctcaggttgatataggtttcatcttatcacgtgtttcactgatcactcaaccagtgggaagcagataaagtgattttcatggtagcttttaaagcttctgcctggaagtgacgcatttcatttttcctcgtatttcattgtccaaagcaaatcacacagtaacgctaaactttaataggactgggaagtttaattttcccatgtaatttgaggggaaatcactccaaatatttgttaaataattcaaataactacgagactaaataacactctacactgcatatatgggtatacacaaatgtaataaaagtatatttacataaagttcaaattagcaatacccctgtggaaaaaagaaaggaagagaatggaatgggatgagaatgctggataactcaggttgggtttacaccatggggaaacaaaagatcagggagaagaagggaaatattctcctggtatcttctctgtgaaatcatctcaaactgactatgtcccttgactaaaggtctctgcaactctcaatgtggctaattctacaagatacttctttggattccaggcgcctt

SEQ ID NO: 7752 - DNA, 781 bp, artificial
  synthetic oligonucleotide
ttagatagaatggacctaacagaccattatagaacatcctactcagcaactgcagaatatacattcttcttatcagctcacggaacactctccaagacagaccatacgttaggccacaaaacaagtcttaatgaatttttaaaaatttgaaattataccaagtatcttctcagaccactgcagaataaaccaaccagaaatcaattctaagaggaactctcaaaaccacagaaatacatggaaattagacaacatactcctgaatgatctttaggtcagcaacgacattaagatgaaaatttaaacaatttctgaagcagaggaaaatggaaacacaacatatcaaaatatctgattttctttttaagcacttcaatacctgaccaggcaaacttatgatcccaacaaacagagattgtaaattgcttgaacaactcatatattgaataatttaaacttgtaaatataaagaatctcaagttttctcttaaatattctaacacaataaaaagtaaatttagtcaaaatattttacatcctttaatgaaaaaatgacaaactaataaaacattttaaatgagaatctgtctgttctctctgtttaaactgttactctaaaatatgtcatattctcttaaacatcaaaagcacattcagtaccaactgcacacacattattctgaatttcacatattggtattcatactatggactttgttcacttcattatatctgttttttattccaaacctccctaagatttttaaggatacttagtttc

SEQ ID NO: 7753 - DNA, 892 bp, artificial
  synthetic oligonucleotide
ctctaactctgtactgtaaagggcgggacaaatttttgtgaacagctattacctcttacatagtaaccaggaatttaaaatgatgtacatctggcaggcaggttttgtgaatttcttcagtaatactcagcttatcctgtaaaattctgttttgtgtctttccctaccacacctcttgctagatgctaaagtcttcaatgaatgaggtagagtgacaaagagttggtaaatgattgccataaagagggggaggggccggcataactggaagacatgagcctccaaggaactggttctgtattttccataagtgaagtagatggaaataattgtctggaagtgatgcttgagaaatatggagtgaagggaaggcagtgtcctcacagaacagccagattcaaatgaggttttggtggtgaaactatcaattgacaagtggcttgagaccttctacttaaaatgtgtcccactgatcagcagcattgtcatcacctgggagctaagtagaagtgcagaatttcaggctccatcccacacccacaacatcagaatgtgcattttaacaaggaacccaggtaattcaaatgcacattactgctggtgaagcactggtttagaatttagaggaactcgccaacatagattgggagttccaaaggtcatagtggaaggctttggggataggaatagaggcaagaagattgaacagagtcatacagcaacaagaacacatactttctttaccccttcaggctgcctttcaacctccacacttgcctgcaactctcagatatgacagatctttcccatgtcactgcattgaacaaagttactttaagcagtttgtccaaaatgattgattacaaaggtgttatttttttcccttctaatt

SEQ ID NO: 7754 - DNA, 1692 bp, artificial
  synthetic oligonucleotide
attctcagattgagttatttttctcatttgtggcttaacccttttccaaaaggggacgaaaaggcagaaatgtgttgcagtcacagctttccattccagaaactcctctgagcaatgttagaagtaacactcactaggcaggttcaggcttgacagaagagggagtgagaatcgaacaaataggggaaagatgcagctatgtggaggcaaaggcaggagtaatttttcacccatgcaatgacaagtagtcaaacattggtttaatttgagtttgctctgtgaggacaaagcctgtttggccctaagtaaaacctttccactttgaaaaacattttttggggtcactgctacagatcaggaaacaaaaacaacaatttgaggttgagagagaattattacatgagaaaatgtttaaatttttattttatgaagtatatgattaaatgtgctgacgttatttgtgaaagttgcctcagctcaagaaaaatactaggtaccttaatagaatataagaaaacatggcttagatttagatactgcaacaaataaaatgaaagagcaggagtgtttgcatgaaatgctgctagggaaattcctcttgcccaaagtaatattacagaggactgaggaagctatgataattgtcagtgctgattatatcagcatagaaaaacagtctattttgatggtgaattcttgcagttaattacttatacttccttagtaactaatatttttattttaagagttgattttcaacacttacattgtgaatatttgataggggcatgagttatgggtttaattaccttcatgacttttgagagttgaatgcattggaataaaaactataattatttatcacatggagtatacagaagcctttctatttatgaacaggatccaagctttgaaaggctgttctttaaggccttttgtttctatgttccaagctgcactataaaaatgactgctggccgtgtgtggtggctcacgcctgtaatcccagcagtttgggaggccaaggggggcggatcacttgaggtcgggagttcaagaccagcctgaccaacatggagaaaccccatctctactaaaaatacaacaattagcggggtgtggtagtgcgcacctgtaatcccagctacttgggaggctgaggtgggagaatcacatgaactcgggaggcagaggttgtggtgagccaggatgacaccactgcactccagcttgggcaacaagagtgaaactccgtcaaaaagaaaaaaaagaaagaaagaaagaaggaaggaagaaagagagagaaagaaagaaagactgctaatgacattttctggtggcatgcagttttacccatttgttctggcttacggctgcttcacatctattcaatttggtaattcaaaactttgttagtagtttctgtaacatggcaggaagcactggatagtgtgagatccaaatgcttgtcctggtaccactagtgactagatttgtaactttgaactggtccctctatctcattggctctcagttgatcctccgcattctgagggatctggactaattaatcttgattcaggttctagttgaactcctccttaggctatagattaacgctaaatcacacacatacatgtcacactgtttatattgaaatattttaatgtaaattacagacaacataaaaac

SEQ ID NO: 7755 - DNA, 896 bp, artificial
  synthetic oligonucleotide
caattagtcacagcaaattacctgtccttcgccttggcaagagcagctcagtgggcctccgtggagtattttccaagttttgtccggtgaattcttgctttaattctccttaagcattaacatgtaatgttttttcaaatgcagatttgacactatctcattcatgtaggaaattacctattaaataaggagtttgaggaatcttcctttttttattttgcaatggtgcattataaaaataatttaacttaaatataaaaaagaattgaaacattaaagaaaattaaaatttattcaatacttcttagtcattctaacagagagagcttatggcatgaatcatataaaagagcaaattctccaaaatccatttccctctgcccagccctggcaaagtgcctgccctcccgcccccggcactccatcccatggcccccatatttctcatcccacaacacctaaccagctgcattttaatgctctgtttatagtcagtccttgcccccttcccctaataacacaggaacaatgtcttcatcagaagtgaatccctagatcttggcacactatatggcacagaagtaggtgcttaggaagtgatagatgaatgaagccatttgcctttggaaaacactagtgcatccattttagctatggtcatatctcacaaattaggatttttctctggctgtagtttaagcattatgttgctttcccataatcctctctggtaagggaaaccaaataactcctccgcccttgaggaccccacagtctaacagagctctgtctaatgttaacgtttctgaaggcctcgtggtagactccattccgagtgctttgtcagcagttgccatattccctttttctttcatgtgtgccattgtccttaagat

SEQ ID NO: 7756 - DNA, 171 bp, artificial
  synthetic oligonucleotide
catgatttctaaggttcataaataattcatctttttttgattgagaatgatgaccttattgcttttagatacggatactgtgttaggaacaggaaggtcttcttaagaatactgcaccagtcgtgctgagctgtgattttcctggaagaaagaacatggcacactcagctg

SEQ ID NO: 7757 - DNA, 3878 bp, artificial
  synthetic oligonucleotide
tctccaaggaatactcattaacttcagtagtgattggttttcagaaataaacatctcaaggttaggagtgcaaattgctgttgatattgatttctcacttttggaacaaccattcagccatttggaaaagaaagtcaacctcaaaccttaccttattccatgtacaaacattaatcatagacttaacataaaagttaacaactacaaagtttctatgttttttatataaaagaaaataattacaaattggatttcatacaaagaaaattattttgctcattaagacactggtaaaggccaggtgcggtggctcacacctgtaatcccagcactttgggaggctgaggtgggtggatcacctgaggtcaggagtttgagaccagcctgaccaatatgatgaaaccctgtctctactaaaaatacaaaaattagccgagtgtggtggcatgcgcctgtaatcccagctactcaggaggctgagacaggagaattgcttgaacccaggaggcaaaggttgcagtgagccaagactgtgccactgcaatccagcctggtgacagagcaataaataaataaataacaacaacaacaacaacaaaaacaaaaaagcactagtgatcagcagaataatattacataattctgtatgtttgcccagttattaatataggatcaggctttccctgtagggactttcctaagcctttttctctctgatatcccattttctgtaacattttaaatcccggattctcaatagtttcatttgtaagtctcatatcccatgctgtaagtctcaaccccataggttaacagctacagttgcaacataaggctgaaaagtacatgactgtccatctagtctgagacagggtaaaatctcagcactctgttgaacactttgagctgttcccactccgactaaggatgtagaagttaattgcaagggccaggatgggggccaattgtctttagatattactgacacatcagctcctgtatccataagcccataaaatgtctttcctgtaatttgcactgtacaggtaggtcgattagaagctatgagttgggataggtaaatttccctcctagttttactctcaaatccttgattcccttgtttctccttatgtggagaagggtgtaacttgcaaggaataagcaatagctgagcagtatattctcccagttcaaaaacccaaagatcttgtgacattaccactacttgaatttctccttcataatcagaatcgataactcttgggactatagtaatgccctgtaagttaagacagctttttgccaaaattaatcccatatatcctgttggcaaaggtccccaaataccagtgggaatcttggtgggtttgtctcctccaactaatataacccgttctctgactgggagatctaatcctgagcttccgggtgttcctggggagagggaatcaatgtgcctccgggaacctatccctgagacagggctgtggcctggattgggaatgccctcattgtttgtggggcctgggttcaggccctcttctcgttttccgacatgggggtgccattctgatgaaatttggaatggcattgactagcccaatgatttcctttattgcaagaaggcaaagtcctggcgttttttcttttgggggcggagaactgcattataagatcccttctgcccagaggtctgacggcattcttttttgaaatgtccgatttttcaacaattacattttctcattttaagatttgccccttggccctttttagatttgtccattactaaatcagccattgcttgagccatcattgtagagcgataaagctcagttcccacatctggacaagctttaagaaaatttcccaagttttttgtacatctcacaggtgccagtgcacgtttacaatccacatttgcattctcaaaagctagagttaaggttagcatttctgcagcagtggtatgaggaatctgttgcttcactgcctcttgtagtcttgcaagaaaatgtgcatagggttcctgcaattcttgcatgatacataaaaatgattttacagggaccccttcctctggaattgtggcccaggtgcgtttagcagccaaggcacactgcttataagcagcatctgggagtgccatttgatgttgcgggtctgaataagggtgattacctaatagcatatcctctgtaatgtctccgtgtccagcagcacgattctttctagcctggtctgcacacagttcttgccaatttaaattccatgtcaggtacacactagcagacaaacaagtgcgagccaaatgctttacatcaaatggtggaggatgcatggcaccaaatatagattctaacaatcctaaagtgaatgggctttggactccattattcactatactagctttcaattctttcggcaacttaaactctagtgtggtgtgttgatgaataaactgctgtggattatttggatcgggcctcatggaaatgggaaaagtgcaaggtcctaagggctctccagctatagcagcagagcgtaaaattctttgtattggggtctctatttctgctactgaaggaggtggtacagatgtttctgctactggagggggtgacacaggccaattttcatcctccctcccctgtttattatttttaattggtactgtgggtgggacaaaagattcttttaaatttttagactcaggacatgactcctgctgtctagcagaataagaaggagataatggcagaaggacagtacaaactaaactccaagcagaaaaaacacaaggatcaactttaagacctttttgatgagctcgttttaatccttctcctgctctgtcccaattttccacatcaagagtgcctatctgtggaaagcatgggttatgcgtgataacctcctgcagcatcttagtgtttgagaactaacctgagcaccagattgtttaagtaaaactttaagcaactgcacataatgttgctcctcaatagacaaattctgccccatgttaccctgattaagaaaacgtcctgttcccagtacctctttagggcactgaccttatatctgctgccgccacactcctcccggggtttctcgtttgtcttgtcagtttcacgttctctcctccagcagaccttctttgctcactgtctgtgttcaaggcgccacttgtcgctgacggtttctacgggagtgaacaaagggggacgaacgcggaaatagagacaaaaacaagaggatctgttttaaaagaaggggtcagggggctccttgcttctagtgaggaaaggcagccctgagcttctacagcccttcatatttattaggtagaaagagcagggaggaagaggtaattgttggtcagctgcttgatttatcacaggtacacataattgctttctttgtacaacaggcttcagatgttctaatagataatcacaaggaacactgtgcttgaggcatgactgccctcagcaccccttctggcggcagatgcagttgttagctttccaacatcttgctttcatgacagcagtttgctgtttgctcatatagcctccagtggtatactgagttggtcatgacccccattttcttgccctataacacaagagcaaaactctgtctcaaaaaaaaaaaaaagacaccgctaagaaaatgaatgtacaaaccactgaatatataaacatatacaccctcaaatgaatactacctagaacatataaaaattttagaatatataaatataaatgtttattaagaatatataaacatataaattactcctaaaatcaacaattaaagaaaaacatccttagaaaataattggacagtttcatacacaggcttaacat

SEQ ID NO: 7758 - DNA, 605 bp, artificial
  synthetic oligonucleotide
gagacaagcagcttagcactgactcacaacagaagcagtcaggaagaggtatgtagtatcagttgatagaagatgtagaatcttaatgctcattttaaccagcttccaggtgcctgtgaggctctcccaccagtgccaatgcatatcagcacttccttctccattcaccctgctcacagctgcatgtcgccttcctcattttctttccccttctcgagtggcccttaagtgttcctttccacttaacgtgaatatgctgggggcagacacaagtactccctgtgacaagtactcatagggagtacttgtctcgggccagtaaaatttatcaggacagctctgggttggaacgccctaagggtggcttagactccaccgtttggcaagagcacaagtccaaggcactcactaccaccatgtttcaggctccaaaccgtgccctggtacacatcaagcatccagactgtaaaattctcttgaacatgaaaatttcccatgattcttgagccaccagatgagtgtgcacacatcgactgggtgaactaactcagcactcaaatatacagccaggaacagaaacagcttcggaaagaatatttgtgaga

SEQ ID NO: 7759 - DNA, 1947 bp, artificial
  synthetic oligonucleotide
cccagaaaggtcattcccagatctaatcacagcccagattctcttcctggccctttcctgtaactaatcatcaaagttctgacccagggcacagtaaaagcagcagactggactcgctatgaaggcagagatcacattttattcaaagatgtttctgtaactccactcagcataactgggccataatcagtttggaataaatgacttttggtctcactggatcctttaccttttagatcttgctcacttttccacatttatccccaattcaaggcctttctagttaggaagaaagtgtaattatctggcctcacacatattatgtctcaaatataatctctctcttccaaggggttttgtatattttccaaggagactgggagaagtgatcaatgaattctaaataaccagctgtctccttgattcagatttggaggcggcagctccctgaagagccccagatctcatttccacccaagcctcagcctcttttattaagtcatacgcaaccctgtccccaccctccagaaacagctatcctaggggtgagatataactcctaccctgaactttgcctgtccaccacgtaaaacagctttgtttcttgcttcatataagactccaaaaagtaaatggggtcttatcatgctctcatttccattctccctgaacctgctctgctcctcttcacgctgacattttcctactaaagccaggctcagagtcagagacttgctttctgagacttctgttccctggcccaggagtaacagcccatggtttgctgagtgctcaccatgtagcagggaaagttctaaatgcttcatgggtatgatctcatttaatccgcacctatgaggtgattaatatgaagacccatatctcatttaatcaacactgaggtttaccagtacaaatacaatatcttgcctcaaaaggccttaaacagtacggaaatgtgttatctaaattaattaaaggttataaagtcaagttggctccagacatggtacaatgaggacatctggacagatataaaagagaactctgaacccctcatatcctcctaaacctttctaagaggcagtcctctcaaatccccaaccaagctgctctgcattaaacatttcaatgacttaacctggagcaatggcctcacacaggtatgcagcttcttctcagcagccacccccttcactgctctgaaccctccaggcccagagatctcagcatagcccctagatagcagtacaaggtctgatttaagagataaccaagcatcttgctaatttccatagggaggaatctgggacacatctatgagtgggaattctaaggatgtctgtccaaggagaacgaaatgtttgttaagatcaggctatatctttatgggtgcacttgcccaggatccgggacttaatgttagctggagcacctgaaagtgacatgttggctatttggagtttgaaagtgacaatctactatgttggctctctggagtctgaactcaacagctgcacataggcaataaggattaaggggcagaacttccctggcacagtgttaaggaatccaaaagctcagagaattaggagcattacatatatatgtccaggtttacgcctattgttatggtctaattattaatactgctctctttgccgtctgctcagccaacccttaaccacgccaccctggaggacccagagaacacaccctttgccagggctttaagaaatgcgttggtgaagggagcatcagaaccctgacaaagccctgaggtagctgtccccagcagcctggagatgacagcggggaatactaggattggttgtattccctgatttccacgggaataatggtagtcagagtgacagtggtagaggccagtgatagcacttaaccattaaaagacaatcatttctttttttagtgcttgatatttat

SEQ ID NO: 7760 - DNA, 375 bp, artificial
  synthetic oligonucleotide
tcttcaatacatacttaattacaatatgtgattagatatatgtctaaatgtctaaaccctctaatctgctatattgttctgcctgcgcatctgggtaacgtcttttcaattacaatagcatttagggtagtttttaatgtctagtgggcaaagtccctgccattactctactttacttggtctttgtatagatattcttccatattatttccctccaggtacactttggaactattgggttgagattcacacacacacggaatcccattcagtaatatttttaacttgttttttaaatgaaagaacgatattataattatatattaattttgctgtcagttgcattcatttctgatgtgtaaaaaaaatgatgtt

SEQ ID NO: 7761 - DNA, 193 bp, artificial
  synthetic oligonucleotide
aattctctacaaaagaccattcttttaaaaatagacatataagattatttttagcaacagtaggaatgacaaatgagtttcacctattgtgcaaacttcaatcaattgatagtagttgccaagtgcacagtattgaggagaattctgaggcttcttcaaagcttactagaaaagatagccatgattttttaat

SEQ ID NO: 7762 - DNA, 712 bp, artificial
  synthetic oligonucleotide
tgatcaattccaacttttttttcctagacagttaaataaattgaaggctcaggaacaggggaagaaacattacaaccagactttcatattaggattcttgactctgtcccagttgtttctgctgtatcttgctgcttcagatagcaaaatgctacattgaatcgtatgcaacatgctacagcaagaaataaccaattcaactcactcttcctttttgtgtattcccaaaccctgagagatccattttcataaaatttgattgatctgtttagattgtctttatcgtactctaggatttgcttttttttccttctcattgataatattttaatagctacccctaggctgcagtggattcttcagttttatattgcacaatatatatggcttttcaataatttatcctttaatgcttataaaaagtgcatatgtgttaaaaattaacaaagaataaataatactctaacagcaagactgtttagatataactattcaccaaggaataagactgtcaaaaactgtgttaaatgtcttgtttagagcaacattttaaatagttttgtttgataattttttaaagaagtgggttatgtgttctaaaaaaattctaaattaattctccattgtgacagcatgctgcctaataaaaaggatcttttagattataacaagactgaggcagggagagaagataggtagaagatctctactt

SEQ ID NO: 7763 - DNA, 340 bp, artificial
  synthetic oligonucleotide
agaacatcatcgttgtaatcatcttagccctggtttctaagtacagtcctgttactgaacctgcaaaactatgtttagtatatttgaaaaaaaagtacagcaagtattttgtgtcctgtaggacgttaggtataggttggaaagacgttctctggagtcttttccttgttttatcaggttagcctgacagctaccatggggagcctcatagagctatcctagaaattgctatattacacaaagtttgagcaatattcattctttgatcttagaaatattgactaaatacctactccatgataggttacgggacataagaatggatcacagttcttacata

SEQ ID NO: 7764 - DNA, 514 bp, artificial
  synthetic oligonucleotide
tttggatactagagaacattgatctcagaaggtactattccttttgtgatgggtgtctatattttcacatgtaaaatgtactctctctagaataaccaatgatgatattataactttatatgtgtaattactaccgatggtttcaaaacgttttccatcactttaatatcctatttggagctcacgagaatgtccatggaaaataccaacacagatttattagagtgagactggaaaactaacttttactttcaaatgggtaacaaggccattctgtcattaattctccccatgaatactgaactaatctaactctcaagagtactattaattgacaagcacacagtgacagaatgtgttatctgttttttgagttaatttgtattgatccaaaaatatgtcagtggaaactgctgttgcaaaaccgtctccctcaaactgctgatgacttttatgtcaagatttctaaagatgacatcctaaaaaataaaatataaaattccatgacttttaa

SEQ ID NO: 7765 - DNA, 896 bp, artificial
  synthetic oligonucleotide
tttttgctgacattacttctattacttttaagtatttgtctccacactttgaaaaacaacgtaaatgttgaaattgctaaaatctaaacttgtttgcaattccaaatatttattaatttccttctattatgtgcctcactcagtctaggataaaagaatggggatacaccagtgaggttagccaacttttactgagggctcagtacaagttaggcattgttttgagtgagttacatttcttcactcaatcaatctacacaacaatgctagcaagtggctggtttgatgtacattttacagatgataaaaatatagtgcaatgatattgaataacttaaccacggtcacactgcaagtaaggtgaggcaccaagatttatatgtagatagtctgtcttcagagcctgtgttctggagtactcttccctactgccagtactatagggacagagttatcaactaacaataataacaaagagaaagacagttttgatgccaaaccttttcttttgccagagtggtttgttttctgtgttatagatatatagcagaataaaaggctccagtctcatcaaagcaaattgattactttggatgcttcttgttagtcttcatatactgttttgggtgtaatttaattactttttgctttgattttgcccttgtcaacctttttgagagtaaggataataccgattttatgtgttttcacttattttaatacattcccatttggtggccaataattagtttgtttaagtggccttttgaaatcacatttatgcctaactgacatataattctaggttctgacatttctgagtattgatttaaattcttttttgtcttaacttctgggaaaactttcacaaaattaaataataattcctcaaatta

SEQ ID NO: 7766 - DNA, 343 bp, artificial
  synthetic oligonucleotide
ggggaagattagtcaaatgtcatcattaagctaagatcataaaaaagatggcaatgtatttcagggtgtatgtgttccaatatatctaaaactaagcaacacctgggacatttacaaaaaaattcatgtggaaaatttgaacattctagaagcccatactgtgcaagcctacactaaaagctacagataattgtcttgacttatctttggcctacactctgtgcccctcaggatatataagttgagtgctgatagcctgagaaatgatgggacatattatgggcaaaagattcaagtgtatatatatctaactgcactacagaaaagcaaagaggcaagttgc

SEQ ID NO: 7767 - DNA, 590 bp, artificial
  synthetic oligonucleotide
ttctaatggcagcctcaaagcttcccatttgtgtgaaatataaaagtcacataacttcaacatttaaataatagtagtatttgtcatacatagttatgagtactaaatgtgatattttatgtagaactcttagcacagtgcctggcaaatgacaagcacatagtagtgcttactaattttcatcttatcacaaatattctccaatttatgttaaaaatacttttattataaaagttcactgtgtcttaattggttctctggaaatagaaaaactatttccttagacatagttggttatctggaaacagaaggactttttcttagaagcaaattataaacatttctcggattcctagattacactgcccgattccattaaggccatcatggaattgtatacgtgttatttatcatgtttcagccaagatacaggtcaggagtcttcagagccccaggtaaaaggctgggagaaacagtggtggggataacagttgaagggaagagttgtaactatgtagctacataagaaggggaatgcaatcattaaaattaaagactagatttgagtaaattgatttatttgatattaa

SEQ ID NO: 7768 - DNA, 176 bp, artificial
  synthetic oligonucleotide
aacaaagagagaaggaaaatgtaaataaattcagagaattcggtgcaattaaatcaaactcattttgtgaaataagactcaacagggaaactacctgcatgatcctttctgtgatgaactgaattttcatcatctatggtgctggctggtcctcagaatcagaaataagtctagtg

SEQ ID NO: 7769 - DNA, 338 bp, artificial
  synthetic oligonucleotide
attataataagttctgaatctccaaaaataggacaggatgtgtggtattcctgaaacatatttcaccagataatcttttgtgtgtgtgtgcagctaagattaaatttagtggtttgggatatgctggaataaggacatctccagatatttaattttttgttataattactttaagtggagaagttaagggtttagtaccccatgttgatctaccttctcggaggggagaaacatatttctttatccgtgtctgtatatcctatcagacaatgtagcagaatttaaacttcttctttttgttagttattttatgtgttttgatagattatgacaagatt

SEQ ID NO: 7770 - DNA, 830 bp, artificial
  synthetic oligonucleotide
atcattattttaaaaaatgaatttgattccagaacctcctctgctgttgcctgctcaaacaaaataccaaaattaaattttattgtcatgtctgccacattacctttccatttcttcctactacttagcaattccttccaggccgagtctctgtcgttatacactagacttgagcttacacatagatacacacatattaagctcatgttgggcccagagcacatttccctatcttgttagtaagcataacaaacttcctgggtaaaggagtccaaacttttgatctatagtatataacttttccaaatgatttgcttctcccacacacagttacattattcctttgctctatgctttcagaaatttattggtacctatcaatggaaagggcatattttacaaaatgacacatgccaagagcaactttaattttggaaagagatgtactttttgcccgtaacattgtgctatcacaaaggacaagttgcaaatacttttatttaggaatcatcactgtaagaactagaagcatgcttcagaaatatttgccactggaaactgcagtggtgtgtctaagagcagaatttctatgtgttttaaattctcccttgaggctggacagaaagaaaaattattcataaacttagtttttatacaaagggatatacagtaaaaacattgaatgcactttacagaaacgttaaaatgctaaattttaaaaagcaacaatggataaactatagaaacacagcattgcaagatagtgaatcatgcaattcatatgtgttttttcaaaataaaaaataatttaagactataaaatgacattt

SEQ ID NO: 7771 - DNA, 6129 bp, artificial
  synthetic oligonucleotide
tcatcaattgtgctcagtctcttcctggtatctacatgtaataaatctttctccttgtcggccacatttctcataacaactttctgtcctggaggatctgaaaacatgaacccagtttctgactctttcaagccacaagtgtggctcttgctcatctgttctatagtttgtggaatgaaagcttctgtgctcagtccatcttttttattggttttgtggtcatgcttccttagctgcagctgcatggagccacagtcaggattccccaggccttcgtgcttcactgtgggtttcttgttgcgtcgcaggacaaaaacaagaaggcaaaaagcaacaaacaccgttaaaatgaggaccactaagatacttaagattaaaatagacagaggcactggcccaccaggaggacttcgaatgggacccaaaggagtggtgaatgtaatggcaggtgcagggcttgtgaatggtgcagacggcttatttaaaagtttgggacataagatttcatttttgagggacttcagttcaatgttggcaaactgaacaggcgtctcacatttcagttctttcacaacaatcccgtcgctcaacttctccacccacagctttaatgccaccaagtcacaagtacagtcccatgggttgccctccaagtcaatctgtgtaagagattgcaactgatcaaggaccccactgacaggcaggtacatgaatttgttgttcctcaggttcagtctagctaagggtgctccggaaaagatgtaaacaggcaggctctttaggagattattgtttaagtacagtaactgcaaatttggcatggagtcaaaggtgcctgctgagatttccttaatcaaattgtattccaaatacagatactgcaggttatgaagacctgaaaatatttcaggatagagtctctcaatttgattgccattgagatatagcctgcgtaaattagtgagattgtgaaatacgtctcccttaatcactgtaatttgattgctgcctaaatgaagcaaatccagtccttcaaagtcagtgaagtctgatacgtccacatccttgatgctattgccattgacgtgcagcttcttcgcatttaaaggtttcggtatcagttcagacatagactgtatatttttctcttggcagttcacacttagtcccaaatctgaagggtgtgttttgcagaagcaaggtgccgggcaaggtgttagaggaggcacccttgtttggtaagacacaatctgactgagattgcggttggagagggctttgcctgcaacgattccagagatcttggaaggatttgttgtttttggtggtttagttactaatctgtgtaaagatgtttgggtagtgtgaccattgggagtggtgtagccattttccagctgagatggaggcaggatgcgcacgtcaaaatcactgccggtgcccatgggacatagctcttgtttgttggtttcttttaaaagccttccatataagtcactgggagtttcacagatagcttctcctatgtaaatgttatatggcatgttctccagccaagcttttaagggcaataaatcacagctacagttccaagggttatcttccagttgcaattcaacgacacggccaatgtgttccagaaccccgatataagggagcttctggattctgttccctcgtatatccagatgggtcaaagatgcgaatcggaaaatattatcaggaaggaatgaaatcagattgtcattaagaatgagaactttcagtttgtggagcttattgaaggctcctcgttcaatatacttgattaaattgtagtcagcctggagatactccaagttctctatgccaaggaaagtgtcagctcggagaatctttaattcattgttgttcaagtgcaactgctttaatgcactgagcccaagaaaggctcctccctcaatgttctgcagtttattattccccagatgcagggagactgcatgtgaaaaattcaagaatgtatttggatacagaatatttaaaaaattattttggaaattgaggtgataaaaattagaccaaggtggtttcagctgatttggtctgtagactgaaaccttctcacagttgacatagagcacattctcaactgacacgcaggaacacacattgcaaatttccaccgatatgtcagaatctgcatttgtcgaagaaatcagggctgacaaaatcagaaacagccacagaaacatcttcttgcaatcagcaaacaactgtatgcttctgaataaagagaaataatctaaaaaataaaaagaaaacattttttcaatggtcattacttgaaaaattacttgtatgtaaatcataccatagtgaacacatggctataattaccagagttgtatttgtaaggcaatcaaacctccaaatagtctcactcagtcgaacaataataaccactaaaactgccatacattttattttccatacctgtggtttataccaaattcacatgtgcagaacacacaactaacagtaggaaaatatattatcaatcatgcttaaatcttgcaatctgaaaatattttttccacgtggaccgtcaaactctgcccttgaacacaggccttaagcttcctacttgcacttcaaatgaccgagaccatcaagtatgccatcgagtttgtaccacaaagccattttgattagtggatatctattctctaagcttcagctagatagagaggctgaattaaaaaaacaaaaacaaaaacattagagcccagagttcactggaggatggaaatgggaggattgggctgctgtagcagggactgttaaaagactaaggaacagtgacctgggaagagatttgcttgtgctgtagccccataggtaagatcattgctgtcaatcggttcacacctgtacactgctgccttcaaagacacagacgacgctgtgcggttctagaaaaacaactgagtaagggatggccaaattttattttctggtaaataaacagtctctaatttcctgtcagtcatctcccaaagagggagcaaaaagccttttgtcttggagcctctgaaagcagcagagtaacctgcttactcctgcattgcttagctaatctccaggcagtctttccactttgagaactggctctcttgcctccctggccctctcccacatctttatttaccattttgaacccaggtccgactgatcctcggcttaactgctttatctctttcactttgaccacagactgcaactgctgaggaaggggagttcacacaacacaatctttgagtagcttttgctacagcaccaaatatgttcagtacagcacatttttcgtcctaaaatcatcagttccaaacacccacccgcccttcctaatattaccaccccatgtccctgactgtaaacgcataaagaatcacttgttggtagagtttaatgcttagcaaaataactcatcgttttcaggtccttaaatactgcatatatacacaaacatacacgatgcttcctggaaaagattaaacaacacaagcagagtgcattttattgatactattttagcaatattagtcttttccattgtgaatgggaagctgggtgcaatttcaatatcgttatctccaaatattaattaaatacataaaatacccaggaacacacaacaaggaaatgatgcaaagaaagaagtgtcgcacagaaactcctttgtttattttacccacgaggaatcagctagtggtaaaaccgaacatgtctcaaggtagacaacccattagccatgacccaggaggatttgcattttaagtagtttggttcagaatacagccagcactgctgagatgctatttggctgccatatagacgtgcatttcccctattcaccatgagagcatgattggcattgcaaaaagaagtcataattcttaactatgacatcacctaaagcaactttcattgtaaaatcaaaatttcacttgatattttttgccttgttatgaatgtggttttcaacagctattttggttcagttgagtcatttcttgttactaaaccaccaccccacccacctcaaaacaaagaaacccaaaagcaaccaaactaaaaaccaaacgcagaaaaaaaaaaatccttataatccgaattcagtacaaaaacaagaaccaggaatctcaacacatctgaaaatgcataaggagctgccctcctcctggtgattgctactttaagtagcaagggggggaaaaggcactagtaagagccaggaagttcccaaatgcagctcttgtgaaacagaggaagccacaagcagctggaggggcaggcaagagagagaaagagtccagttggtccaccaaggagagaggaaaagaggtactgaaagggcaagagaccatggaaatgtggagaaaggaagaaaaagaactcggagaagggagctacaaagagggtaaagggagcactgaatgtatgcgaataaagcctcacactccggtggtaccactgaaacatgcacatttaaacatcaagggaaaaacgcaaaaaagaaaagaaaaagcccacaaagtaccagctgggtaccaagagccttctctgtggctgctgggagctgtccgtcttcctctcggtgccctgaaagacccttggctctcacgaccagccaggactgaacaaacctagcccgaccaaaaacaaatcctgcatccaccggagtgcagcgcctggcactccgcgactgggaggagagaagcggcctgaggggggcagaacactgatgggcttcagggcggtgggccgaggtggctccccgagagctccctcgggaaaccccgctggcccgcctaaggctcggatggaggtggaagaggttcgcggagagacccggccattgccgcccgggtgcgctacctcgggcgggcggcgaggaggctggaggggctgctggcgcgtaccgcaatgttttgccgcatccctgttcccggagccggccgctcagccccctccgcgtcaggggcccaagcagcagcctggcggtccgtgtagcggaggcggggtaccgcgcgggatgtcgcgggggccttcagtcccgccgctcacacatttctccgcgcgctcccgtcccacaaggggcagctgccggagtttcagtggacctctctagacccaggcgtgcggtgggtgaggaggaagagaggccagatcaggccgcctcgaagacgttggcactagggagtcactgacctgcttgccacgggcagagtgaccctgtggttttgtggctgcgagcggcggcccaggctcccccttgcctgttctccctccctggccagctacaaaaatcctgctctcaccatgccagaaatcagctcaacatttaggccccttgcaaagtcgcgctggcagcgctcgcctggctttgcagagcttttagagttacccaccggctcttcctctggtattcctagtcttgccgagcgctagcaatctccgaccaacccgcgggccactgccccgagcctcagatccacgtctgcggaaagtggctgcgagtggggtgcaaaaataaagcccaacccagcccagcggcccgacagccggagccacccgagacctgtacaacttgccccgccgccctggccgcttggggtatggtggggcgggggggggcgggcagcgatgccaaggacacccggatcctttccggtcctcagcggcatgagaccgcgtcgtaggcaggcaagtgggaggtggagggcaggattagccacctcggccactttggccactcaaccggccccaaaccaacaggacccaaactaaaaataataagctacctgccccctcggctcgcgtgcgcgcgcgcgagatctctctctctctctctgtctctcacacacacacacgcaggcacacgcgctactgagctgagcggggaagaggcagcacgcgtgtcggtgcagcttgtgcagcccccgctgaaaattcacccacctctagagcccagcgtctggtgcagggcccgcggcgccgtgacctgcgctgctgtttccacgatggtatctatgtgattccggacagagctcctccgcgcccgctcgcccgtcaaacccacggagc

SEQ ID NO: 7772 - DNA, 1201 bp, artificial
  synthetic oligonucleotide
tgaagagtacagatcagttattttgtagaatattcacctgttttagtttgtcaacatttcctcattaaattcaagtattgcatttgtggcagaaatactccagaagttaaggagtgcccttctcaacacatcatataagaaggtatgagaacacatggacacagggaggggaacatcacacactgcggcctgtcagggggtggggggctaggggagggatagcattaggagaaatacctaatgtagatgacgggttgatgggtgcagcaacttaaaccaccatggcacgtgtatacttatgtaacaaacctgcacgctctgcacatatatcccagaacttaaagtataataattaaaaaaagaaaataacactaacttagcataagaggtcttgggtttagaagatggtacaacaacatctagagacccaacatgattatcaaagactgaggagcttgctgagtgggcgagcaaacacattctgggtagcccctgtattgggaggtgagaagtcctatataaaagtaataattatctgcattaattgatttgttgaaaaaaataaaaataaaaataaaatcacttattaatggccagaaataaaagaaggtatgatatctatttgtccctttaatggctaattttggtcacttggtgatggcagtgtatgccaattttctccattgtaagattattgattcctttgtaatttataagtggtttgtgaagagctatgttgagatgatataaatatcctattctcatctaactttcaccaactattttaacattcattgactccatcatttcttatacatttatttgttgacattctactgtggggaaaagctttcccttctccctcacttagttatcatttattgatatgagtatgggactattaaatcttattttattcacagattacaatctcttaaaatcattatttattttgatgctttaattatcctagaactgaccaatctcagaagtggctcctatgatataacccccatcattattggatacttaattacctttaggcactaaaaaagcttatcttctactccccctggtccatccttggaattaaccatttctccaaaatgtcttgattcattttagaagccaagatctcggtggtaggtgtgctgatcacattgagcctatctcagctgaccaagttcatactatgagctta

SEQ ID NO: 7773 - DNA, 3208 bp, artificial
  synthetic oligonucleotide
caaatggaatgggataaaaagccaagaagtaagcccatgcatttatggtcagttgatttttacaaaggtgttaagatcacataatgaggaaaggatattttcttcaacaaataatgttgaaaaaactcgttacctgcatgcagaagaataagattagatccttatctcagaccatatacaaaaattaactcaaaatggactaaagacttcaacataagacctgaatttctaaaactactgtagaaaacacaagagaaaactcccgaaacagttgtctgaacgatgatttttggatacaacctccaaaacacaggtgacaaaagcaaaaatagacaagtagaatttcatcaaaataaaaagcttctacatagcaaagaaaacaatcagcaacatgaagagagagtccacactatggtagaaaatatctgtaaaccattcatcagataaggagttaatatgtaaaatacacaaggaactaaggcagctaaatatcaagaaaacaaataacttgatttaaaagtgagcaaagaactcaaacagaaaaatctcaaaagaagacatacaaatggacagcaggtacatgaaaaaatcctcagtatcacaaattattagagaaatgcaaattaaaaccacaatgtgatgtggtcacacctcattttattgtactttgctttattgccatttacaaagaattgcattttttacaaaatgaaggtttgtgtcaatcctacattggacaagtctattggcaccatttttccaatagccatgtgctcacttcatgtctctgtgttacattttggtaattttcacaatatttcaaatttttcctattattatatctcctttggtgatctgatttcagtgatatttgatattgtgattcaaattgtttaggggcactgtgaaatgtgcttatataagacagagaacttaaccaataaatattgtgtgtgttctaactgctccaccaaccaaccattccctcatttctctctccctcaggcctccctaatttcaatcatttcaatattgaaattaggccagtaaataactgcaaaggcctctaagtgttcaagtgacagaaggagttgcacgtctctaacgttcaatcaaagtctataaatgattaagcttagggaggaaggcacactaaaaacagagacaagtcaaaagctaggcctcttgcaccaaacagtgaaccaagttacgaaagcaaaggaaaacgtattgaaggaaatgaaaagtgctactccagtgaacacacaaatgataaaaaaaaaaatgaaacagccttatttttgatatggagaaagttttagtggtctggttagaagataaaaccaaccacaacattcacttaagtcaaagcctaatgcatagcaaggccctaattctctccagttctatgaaagctgagagaggtgaggaggctgtggaagaaaagttgaaagctcatagaggttggttcatttcataccataaaagtgcaaggtgaagaagaaggtgctgacgtataagttaccagatctagccatagtcacggatgaagggcgctacactaaacaacaaattttcaatacagatgaaacagtcttttattggaagaagatcccatctagtactttgatagctagaaaggagaagtcaatgcctggcttcaaagcctcaaatgacaggttaactctcttgttaggggctaatgcagctggcacctttaagctgaagccaatactcattctcatttaccattctgaaaatcctagggcccttaagaattacactaaatctactcagtctgtgctctgtcagtggaacaacaaagccggaatgacagcacacatctgtttacagcatggttgactaaatattttaagcccactgttgggacttactgccaaggaataaaagattccttaaaatattcctgctccttcacaatgcaccttgttacccaagagctctgatggagtggtagaaggaaatgaatgttgttttcttgtccactaacaatatcaatactgcagtctgtggatcaaggagtaattatggctttcaagtcttattatttaagaaatatattttgtaaggctatagtttccataagatagtgattcttgtgatatatctgggcaaagtaaatggaaaattttctagaaagaattcaccattctagatgccatttaagagcatttgggaggtcaaaatgtcaacattaatgagagtttgggagaaattgagtccaattctcatggatgaccttgaggcatttgagactacagtggaggaagtaactgcagatatggtgaaaatagcaagagaaccagaatcagaagtggagcctaaagatgtgaccaaattgcttcaatttcattataaaactttaacagatgaggagttgcttcctatggatgagcaaagaaactggtttcttgagataaaatctattcctagtgaaaatgctataaatgttgaaatgacaacaaaggatttagaatattgcataaacggtgggtaaaatgcaatcaaacagcattgcacacggcagagaaaattttcctaaaaggaagagtctaattgatactgcaaacttcattgctgtcttattttaagaaactgtcatagccaccccaaccttcaccaaccaccactattattagtcagcagccgtcaacatcaaggcaagacactccacgagcaaaaagattacgactgactaaatgtacagatgatagtttgcatttttaacaataaagtatttttcatttaggtttgtacattgtttttagacataatgctatcgcacagataatagactacaatatcatgtaaacataatttatatatataccaggaaaccaaaaaaatcatgtgactccctttattgtaaaatttatattattgtggtggtttcaaaccaaactcccagcatctctgatgtatgtctatatcctctcatgcctgttagaatggcttttaccaggaagatgaaaaataacaattgttggggagggagcagagaaaaggagactcttgtgcattgttggtgggaatataaattcgtacagcaattatgaaaaacaatataaagtttcctcaaaaacctaaaattagaactgccacatgatccactaatcccattattatttttttttaaagaaaaggaaattagtatatcacagagatatctgcatcccctatgtttatt

SEQ ID NO: 7774 - DNA, 978 bp, artificial
  synthetic oligonucleotide
ctagcactacggagaactctgtgctcacataaaagattatcttaaccagttggatttcagacgaactctaaatagcccagaaatattctgcttgatactcattgcaaggctaatcatatttggcttgtttctatttatcaagtacattattgtgtgacaataggttgaattttgaatgagaacattgtaggaagaaacacactgaaggctgtaaggaaaatagaacagttgtttgattagtcttccagatttttgcagttaaagtgattccacgttaaaagaggcagagtggattttttctcaatttttttcttaaaccagagcacctcaaaatctcttgataaccttggatgctctcctgggcaacatgtgcaacatctgatgatttatacttcatttcttaagatttacttggtcctgtctccaaatgtaatcccatttgcccttgccttatgtttgttttttatgtttattttatgaatctattgcttctttcctctgcttccttgtctgtatcttcttacttaatcctatttgatatatcctctggaatttctcttttcactcactgatcttcgtttgtcagtacctcataaccatgatcctaaactcattttgcagagataagctggttttctcacaagcctagaagggtatgtttccggtttctgaaaacgccactgatcattgcttgaagaatagaaactaccgacaagagagaagaccctatgatattacacttttaaaaaatgttttgtaattttttccaatattgatttttttactatggtaagaatatttaacataagatttacactcttaacaagttttaaagtgtacaataaagcaccattaactgtatgtatgatattgtactgcagatcccccaaatttattcaccttgcataactaaaactttatacccattgcacaataactcagtgttttaccagttgtttaaagattttactattgttt

SEQ ID NO: 7775 - DNA, 4400 bp, artificial
  synthetic oligonucleotide
atgtgctcagtgcactgcttttagtctgtagcaaacagcacattggatgtttacactaatacagatattgtaaaaagaagagcaatgcttctggatatataaccgtacatacactgcccacgtgcttatgtgagaactatgttattccgaagttgcttatctgaatggtaggaagatttcaaaaaggctttctcaagaatgaaataaaaggaacagtaatgacccttacaactccgaagatacgattataattcttccgactattattaaagcaaactctgtacatcttcataatataagattgccagtagttttctttttaaaaagcccagcataatctccttagaaaaccattatgaaagaaagccaagaagagaggacaggagaagcacaaaagattcccacgggaaggacaagaaaaaggtggttgtcagtgctgtgagaacgagttgaaaggcatgggaaatatggaaacagacaaattccaatgcagatccactagctggagaggtaattttgcgtctaattttgcacctctctcctcgcctccccgtctgctctccaccatcacgcttttcgacagtaagaaggatttggggttttgcagactctagcgggcatgaaaaggatagggggtggcaacgacttgaattaatgacgttctcctacaggatggaggggaaaatgacttagtgtcatcaaatgaactccctactcctggcataaatttatcaaactgcaactttatctcgaatactctggaagagtagaggagaggccctagagaaagcaagtcttgaggggaaacgcaatgctcttggcaaaaaccgcacctccctcttgaactacactgactcttttcacagagcgccttcctttaatagaatcacaaccacctggactactaataagaggaagaagaaaggagaaaagggaagggaggatggcaaaaatcacgctctagaagatccaggcaacgtcgtcgtgaagaataaagggaatcaaaatgggcactggaacgctgctaagggcttgctttgttaacacacttgcacaactcaagttcagctctatcttatgttgaaagtccttgtttacgatcctcgtaggaggttcttaaatatctgcctgcgaactcccaaagactgggcgcttactagttaggggaggcagctgtcccggagggtgtccagctcggatggctgactgctctttcacttgtcgttaacttccacccagtagtcttagtctccccttggacatggtaccgaccgtgtgccattcttatttcacttgaccgagcccgagctgcagcccagggtggaagccgcaagggctgggcagagttccaggcaagagggaccgagaggcgtgagcagtgctccgcagcgcttgtcagagaaatggagcagcggctcctttgtgggctcttacatccccgtcctgggtgcacagcccggatatttgatctgtggggtgattgataagtgagggagaggggggacgcgatccctccctccctcctccctccctcctccctcctcactccctcctccctcctccctccctcctccctcctccctcccttcttcccctctcctccctcccgctttacttccctcctccctctcgcctccctccctccttcctgcaagaagcgttgcccgttggctagctgctcggtggggatctgcctgccctgggggcgccgcccgcgctccccgcggtgctctcgctcctgggctgcgccagtccgaggcggtgccggctcctttgcctccccgagtcgcagatgctgcgggcgcctccgggaaaagatctgggcggcgcgctcgctcggtaagttctgagcactcagggacgcggtggcgacgcggccagtgagccggctttcctcagtccgttgcctttcccggccacctctccttgcgaggggcaccagcgtggggaggctgggcgccatccgcggagggcagctcgctggcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttcgcaaaaataatctgtcctcaaggaatattgaaagcgtcatcaatgtcttgaaggaaattactgtatctgagaaccgaaactagtatttgatgtttcactttcaaatacatttttttttaataaaaaggatacctttaagtaaaacactaccactgctatttacgtttaagtagatttttaattcatattaagcagtagtgtgctttttggaaagatgatggactgggactcataatccctgggttttgtttctatttgtagtttcttgagtaagtcagcactttccctggttaagaaatgacctcatctgtaaaatgaacctgacttctaaggtcttgttcggctctcacgtctttacttcagttaaatattgacataatacatgtttgttgaatgaatgactgaatgaataaatcttattgctctaggaactatgtgcttttaacctttggaaatacatagaaacaaatgcctcctttgctaggaaagggagcttaattgtgctcccactgcatcagactgcttccatctaatgatgcaattgcaatacagggtgggaggccatccacagggctgtccctctgcctcagagctcatctcaagtttgcccttctctatggagaaggaaaatttgagtctccagaaggaaagtattttgctaaacgccaagcaagaattagagggtaagggggcttctgatgcctggtccaaggctcttagaagaagaagaaggagaaagggagaaagctcaagaaaataatgcacagatcaccagctacaggtggccctagtgcctaagtttataaactacccccgcccttcccggagagaaaggagcttgtataaagggaacaatcctagaacctaggcttaacaaggaaggagaaggggagaagcaagggtcattctgttctcaagtggtttgttgtatctgtgtgtttatctattccacatttggccaggcagtgggactccgggaaagcaagctgaagtgttttgtgggacaggcacatcatttggtcaactccttttccctggttgattccctccttttcctgacccatctcccccttcctaccagaggcaaccaaggcctttccaggcaacagcagacattatttaccccttgcgaattgattccacaatggaagactcttgggtccaaggagctgtaagataattaaggagaaaacagataatgaaggcaaaaatccaacacctggccattagcaatgctctggaaaggctatttaaacccgcattggatatcagagctgggagggcccatacagtctacctacctgccttttgcagatggacacaggaagatccagaagctagtggcacatctagcaacagagccagatcagaacccaggtaagctcggtctcaggccaggattccttttccatctcctctctttctcag

SEQ ID NO: 7776 - DNA, 2647 bp, artificial
  synthetic oligonucleotide
cgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcct

SEQ ID NO: 7777 - DNA, 529 bp, artificial
  synthetic oligonucleotide
tgtggtttatttttagtttggagttatgagggggaaaaaaaaagaaaaattcccttcattgatatatttctctgctctcttatcatggcgctcagccccgccctggcaaccttttatgtccccccaaaattttggcagtgtcaagagcccaagcagccatgctactgggagcaagagcagaggcaaaacaccacgtgcccgtcagagcgctggtttgtctgatatgcaaggtccagcaggcttcatgtggcacagagcttttgctgttcccattttcaactcgcttacggagatgtacagccaagggagatgctcattgtagaagaaacatagtgttgttctcctccaagtgcctgagagcatcccttactgaatgtcctgcagcagcccagatagtaacccagagtatttgaaggcaacactgtcatgacgcagagcttcaggacagtcacagatcacactgtaaggttctggaacaaaggaaccaagttttttcaattttctgggaagggtttttggcaatctgcat

SEQ ID NO: 7778 - DNA, 1574 bp, artificial
  synthetic oligonucleotide
gatggaaacattgtgttcaaatgtctgtgtggtatacacagttgtatacacaggatcatgtccatgatatgagtccaagtgctaattaataaagggattaaagcatcagcctcactctttgttcctggcttcttttcctagaattctctattccctttgcatccttctgtctcacagtccttgcagtcccttctccttcctctgctacctagccactcttccctgtaccctttcagatgcctatttgtcattgggtttgtttgttgcaggtgtgtgggtgtatatttccagtgtttttagttttgtgacatacaggtcatcatagcctcctgcacctttatttctaagattgctgtcaacacacatccacttaaattagtgttctcatctcaatcaatatacgtggaggtagtaaatttttatgccagaataaagaaagaaggaggcaggaggaacagaaagaaaggagagctgaggaatatctttcactctttaacttgcaaacaacccaggaaggtaaggagggcagtttctatgatcaactcgagggagaaaatggaaatgggaggcagttaagagaagccatttgctaattaggaccaaggatagaatttgaaacctaggtctttcgatccctagtcactgtttttctgtcctactggaatgcttctcaaatatgctgcctttaaaaaagtaacatcatttcttgtataccatgcaagaaacaatcaggccttaaaaatttagaccaaggggttggctaactgtggcctataggacaaatccagcctgccacctgtttctgtatgctctgtgagctaagaatgttttttacattttctaatggttaaaaaaataaaaaagaataatattccttggcatatggaagtgatatgaaattcaagttttagtgtctataaatagtttcattaaaatacagtcgagcccacttatttgcctatggctaccttcatgtgacaacggtagcgttgagtagctgcttacatacagacaggaactgtatggaccacaacgctgaaactatttgctatgtgacccttcgtagaaacgcttctctggccactgatttagatgcttgctacctaaagtgcagtctatacacctgcagcctaggagtaacctgggagcatgctagaattgtagaaactcaggcactttccaaacctatggactaggcagctgcattttaataagaacctctggtgattcatatgcacgttgaagcctgagaagctcaagctcagaaaatagttgactagggctttctctcattagacaagcaggatggttactggaaagaaaatgagcctaggggttagacagggatgaatttaaaattgtgtttccactgctgagtggcttcagtttcctcgcctgaaaagtaaggataaatatgctttcctcatcagtttcttttggattggatggtgtgttagcttcctagggtttccctaacaaattaccttaaatttggtagcttaaaatgacagaaatgtattctctcacagctctagaagttagaagtctgaaaccaaatgtcagcagagccatgc

SEQ ID NO: 7779 - DNA, 1318 bp, artificial
  synthetic oligonucleotide
tgactttttattacagtttttcaacttaatttacaataagataatagaggaagacataatatgaaaattaaactttgaaaagagaagggcttaagaagagataaaactgaaaatgtacaaagaaatgtcaaaaggttattttttgtattagctttaaaactgttggttgaagaaaagttgggaaaatgaaaaaccttattaaacagttacctaaaaatataaaataagtcctagggaatagttaccagaaaggggaagttctgtgactgaggaatgatttaatataataatatagctgaatcaaaggatcagagaggaggctggttggaaataagagtaattctctggaacatgttgacctacctgttggaggatgggaacgacctgtgaggatgggtttggttttaaaactgtttttccagtaatgaagtcctaatttgcatggctgcatcgtcaatttccatatctctggttagaaaactaaaaaggcacagaactcgaagatgtaatggtgcatacgatttgaaatctcatacacgcagggcacagccaaaacctactttttcttttagggaggctgtatattcaacctaaaccctcattaggaaagtttaactatgaatgctaacccaggggtccctggcaatgctgccaccaggagtctgcaagtgtctcaggttataatagttttgacagagtagtctatgcacttggataatttatacaaaacctcttttctgaaggaattcacgtaagtgagaggagactgtcaatttctaccagaaatcaaactatatataaacaccaaaatagtatttaaacctatgaatggcttcaataatatgtcaattaataatataaagccctatgagtaaaaagtacattataaactcagtttcaacatgagataattaaatatacaatataatagtaagatacttaatatcctcttatctttatccttgtttccttaagaattgtggttaaggctattactcctcacaactttatgtataaactaatttttctcattttcccattttttctgtaactagtttctggcaagagcctaaatatagacactcccttaacctaattaagaatgcattaagttaattaggtcatgtataatatactttctatatcaatcagcctcaagcctggagacttattttccctcagtcaaatttctggcatttcctttacccgtcatgtctctagagaatccctgtcagttttcttcatcctctgtcagaaaatggagaccaacctcctctacctcttctttatctaaatgtttactcaactcaatgttaca

SEQ ID NO: 7780 - DNA, 1294 bp, artificial
  synthetic oligonucleotide
tttctggtgtatattccaggtagatcattagatcatgtaatacttttaacaattttttcctacttctgttattcagagcataaaagttcatggctgttacttcttcatggtgaaatgaaacttttatatatgaatgatatctcaaattggtaaaggtgacttaggtcacaacctttactttcctcagaactctgtagacactgcttcattttcttccagtgctcaatattgcagagaaaagttctggtatcagattgggatttttgttcctttgtgagttgcctgatttttctgctgagctgtatgtacaattttttttgtacatgtaattcaaaaatatcactaggatttgtctacatatttttctcttttcattaactttaactgaaatacaattaacttttttcatcagcagacccctttattcagctcataaaaagtttcttctattatgcctttagttagttattctcttctattatgcctttagttagttattctcttctattatgcctttagttagttattctcttctattatgcctttagttagttattctcttctattatgcctttagttagttattctcttctattatgcctttagttagttattctcttctattatgcctttagttagttattctcttctattatgcctttagttagttattctcttctattatgcctttagttagttattctcttctattatgcctttagttattctttcggcttaattttggtttcttcctttgggtagccaattacctgcaaatcaaattttggctgtctcttgtcctatctctcattttctttcattattttcatctcttcattggttttttccatagtttagtgtgggggacatgcttatagaattcaggatctgacaaagagtaagaaaccaggaaataattactatataattatatccaaagcccttctttacccagactttattcactgcacgaaggtgttaacaaattccattgttgtgcaaatttaagactaataaatcattttacatccataattttatttgactctcataacaacacttagaagtgagatattattgttgctattttatagatggaaaaactgatgttcagaaaggttaagtaatttaagattgcacaactgggtactggtggatctaagaacagggacctcattctagagagtgccccaatcattactctttcctctcttgggcagcattgatacttggtaactgttccttcagaatataaaaccctccaaataaagaattagctatggaatttcagctt

SEQ ID NO: 7781 - DNA, 1335 bp, artificial
  synthetic oligonucleotide
cctaaccagtttagctttaaaaattggctcaagacagtgactacaaatatttactatacatatgacttggaggactagagagccctctactatacttatgtttcctctgaaatccaccccccacaaaaaaaaatttaaagatgtgagtataaaaaatacattgttggagaatataaaattatactgtccatacgtttgaatttgagggtatgctaccttgagaaagctgaaagttgcaaaggcatgagaaatgtattgcttggttcccttgcccagaatagcggtcgttccattttaaatgtcactcgagtgtatatatgtcaaaagaaagataccaaatcaaactgacaatgactcagtgatcagcactgggctgaaattattctatgaagtatctgtcatgcaaattgatggggaacttagcaaagatggtatctcatcagacatcacagcaatttttcaaaggcaaagaaaaactgttgcgcatgcatgcacacacacacacacacacacacacacacgcacaaaaccctgaaagttcttttgaggttatatgaatgatcttaatacctacaaaagatttttcttacaatttgtaaaaaaagagtgtttaaatagtttgtattttggatcaatgcaaagttcattaagaaagtagaagcagtagctatagatgttcaagaggaagaggaacaaaacaaagtcaactgaaaaaaacaggacagttttaagtagtcctggaaataaattttatattctttggaagccaagttatttacaagagagaaataaaatatgtacagaaagaaagtatgggtctggttcacaaagcattttgtcctgtatcatctcattgaatcctcaggacgtccctgtaaagcaaaacaagtattagctccagtttttagatagaaactgggctcagagttgttggctagttcaaggctccaaagagccttaaaggcaaataaatgaagcaagaaagtgcacaaaagcaacaggaatcgaagcatgttctccaaaatgctttgtggtgtccagattttaaaatctgtggaatactgattttcaaatttgcctgcacattagaatcactgtggagttctaagaaaaattctgatgcctggttttctacttctagcgatcctaacttgactgccctgggcaacagcctgggcatcagaatttcttaaagcagcctagaggactataatgggtagccatttaggaaccattggcctagaacaccacagtagactttagaaccaagatttttatcatctctcttattgaattaaaggtgtagtaatgtcttaatgctcagaaaattcacag

SEQ ID NO: 7782 - DNA, 4817 bp, artificial
  synthetic oligonucleotide
ttttccttccattctctcttgaactctttccaatcaggattctgtgtgaaagaaccacatttaagaagtcttgaggccaggcgcggtggctcacgcctgtaatcccagcactttgggaagccaaggctggtggatcacctgagatcagcagtttgagaccagcctggcaaacatggtgaaaccccgtctctactgaaaatacaaaaattagctgggcatggtggtgcacacctgtaatcccagctacttgggaggccgaggcaggagaatcgcctgaacccaggagacgaaggttgcagtaagccgaacttgcgccactgcactccagcctgggtgacagagcaagactctgcctcaaaaaaaaaaaaagtctcagaggcaatacgaaacatagtacatttaagccctttaaataattcaatatggctgaagtatcatatggagaggagacagaaaggtggatataaacacaggtgtaaagatgaggttaaaggcaagaaattaggcaggataggtatgcatacatacacacatatacacatagagcaacttcaaataattggatattgccagcatagtatatggttgtggaggagagcaggaaaacagatgtaagcacatatgtaaagatgagtgtaaaccctgaataaaaataatgtactttttgatggaagaatgaaccaaaaattaaaactaaaatggttacatatagggaaagagagggaacaagtagaaggagacaagggttgaagctacatgtctctgaatatgccttattttgtaaatttcattttggaactatagtaatgtttttacataattataatgcaaaattaaattttaaaaaagcaattcacaaaactctgtttctttgagacagggtctccctctttctccaggcttcagtgcagtggctggatcatggctcactgcagcctgaaacccccaggctcaagcggtcctcccatctcagccttctgagtagctgagattacaggcatgtgccaccacatctggctaatttcttttttttttttttttttttgtaaaggcaaggtctcactctgttgcccaggctgatcttgaattcctagcctcaagtgatccttctgcctcggccttccaaagggcttggattataggcatgagccatatccataaaattctaaagcaaaacaaagaaaattagcataaccatttacagagtggtggcataacctcaaaaaaataaggatacaagtctattcttgcatacatgtaaaattttctatgagtgggagagggagagggaaagggatgaggaatgggggatgagggatgagggatgagagatatcatccagaaagataggaggaaaacataatgtgaagtcaaagaaactattctttaagcaagagagaataatcaaaacaatgaaatgctgcccagaggtcaaataaaatgaggagtatgaaacatccattgcacttagcaacactcagtgagttgatttaaaaacattacatgagctaatttttgtataagttataaggaaagggtccagtttctgtattctacatatggctagccagttttcccagcaccatttattaaatagggaatcctttccccattgcttgtttttgtcaggtttgtcgaagatcagatggttgtagatatgtggtgttatttctgaggcctctgttctgttccattggtctatatatctgttttggtaacagtaccatgctgttttggttactgtagccttgtagtatagtttgaagtcaggtagtgtgatgcctccagctttgttctttttgcttaggattgtcttggctatatgggctcttttttggtgccatatgaaatctaaagtagttttttctagttctgtgaagaaagtcaatggtagcttgatgggaatagcattgaatctatacattgctttgggcagtatggccattttcacaatattgattcttcctatccatgagcatggaatgttttcccatttgtttgtgtcctctcttatttccttgagcagtggtttgtggttctccttgaagaggtccttcacatcccttgtaagttggattcctaggtattttattctctttgtagcaattgtgaatgggaggtcactcatgatttggctgtctgtttgtgtattattggtgtagaggaatgcttgtgatttttgcacattgattttgtatcctgagactttgctgaagttgcttatcagcttactgagtttttgggctcgtgatcactggtcattagagaaatgcaaatcaaaaccacaatgagataccatctcacaccagttagaatggcgatcattaaaaagtcaggaaacaacagatgctggagaggatttggacaaataggaatgcttttagactcttgatgggagtgtaatttagttcaaccattgtggaagacagtttggcgattcctccaggatctagaaccagaaataccatttgacccagcaataccactactgggtatatacccaaaggattataaatcattctactataaagatacatgcacacgtatctttactgcagcactattcacaatagcaaagacttggaaccaacccaaatgcccatcaatgatagactggataaagaaaatgtggcacatatacaccatgaaatactatgcagccctaaaaaaggatgagttcatgtcctttgctgggacatggatgaagctggaaaccatcattctcagcaaactaacacaggaacagaaaaccaaacactgcatgttctcactcataagcaggagttgaacaattagaacatgtggacacagggaggggaacatcacacaccagggcctgtcagggggtggggggcacgaggaaggagagcattaggacaaatacctaatgcatgctgggcttaaaacctagatgacgggttgacgggtacagcaaaccaccatggtacatgtatacctatgtaacaaacctgcacgttctgcccatgtatctcagaacttaaagtataaatacatacatacatacatacatacatacatacatacatacatacattacatgtggtttgaaaagggcaaatgttcttacagggataccatgatagaaggtgaaatcaagaatgatctgcactacccaggatgtgtgaacataattctcttacttctggctttctacgcttccaaattctgacccaaacaccatttatcatatcccgttgcataagacaggttcaactccaccaaaatgaggagcttacttcattttggtggaggctccaagtttttgaaggcctctgtaagtggctccgaaggcatgagaaggagttaaggaggtaagatttgatctgcttgagatgcagcatgttacactgtatattattattgttgttattactatttatttttagagatggggtctcactatgttgccaaagctggtctcaaactcctgggctcaagcaatcctcccacatcagcttcctgaggagctgggactataggtgtgtgccaccacacctactttattattattattattattactaaatggatactaatattgtgtttactaagtaccaaatgctattctaagcactgtataaatatggactcattgaatcctctcaagccccctataaggtggatgatactgttataaatttttgctctggctctattgctttctcaccatgtgagcttgatcaagtcatttctccactctgtgcttcagtttgctcctctgtaaaatgcagactttcatcttgggattgcaaaagttcttttcaaccttaacactctataagctgtgataatgagaaatgagcattgcccactgacttaacatggtagggatgaggataatactgacctggccctttctttttcccatcttctcccaacttagagttctattatctatattctgttgttccccatacagaaggtggaaaatgttgaataactacagtccctggctctacacagatgttcaacaaatatttttaaatgtattaatgagtgaaaaattcaactattctagcctccatttcttagagaccctgtaatgatgtttctttacccagagaagtggtgacattttggccaagggtgtgtatatgtgcatacgtgtgtgtgtgcatgtgcttgtgtgagcatttttacaaccatgctgcattcctgtccagattctttttactcaagaaaaggactgctgtggtcattcaaaagctttcagtaaagaatgttctgcaacacaaattcatgccggttgctaaaggaacagatttttgagagcagtcaaaagtggcttgaggctcttaagaaagttgactaagtactctaaacactaaagagaaagctgcatgtcaagctctgctgttgatggatttaattaaatggctgttccttcaggctgtacgcaggtttgttaaagcattcttatgtatgcttgcttctaaattaatcaacaaataattaaaactcaactcttcattctttaaaggttttcccataaaattattaaggtaaaagaaaaatggtggagcctcatgccttcagaaaaccacaactcagaaattatacatattacatgaggattattcgtgttccaaaaaagttcactgaatgcagttcctttaaatagcctgctccctcagtgcgcttaagatgtgactggattttccaaagttgtatcaacacaaagcttttcaggaaaacacatgttttgtaaagtgaggctcctctatatttgaactgagcaaccttaagttgccactgtgtatccaataatttttatagttacttgaactgaaaactca

SEQ ID NO: 7783 - DNA, 7325 bp, artificial
  synthetic oligonucleotide
taaattgctcatgaaacgctgttggttgtggagttatagtcagcaatgaacttttgctgctttgttttaagtgcacgttcttctaaaggtgctgagtgaagtgaaaatgttatgttgttatttattcccaagaacaggaaaaaatatttagtaattatatttcataatatattaatattaaatcaagaggtaaatctatcttggcatgtggaagtttttatttaattatttatttgtactatatatacttaaggtgtacaacatgatgttttgagaaaaatctacacagtaaaatgattactacagtcaagcaattaacatatctatcacctcacataggttacctttctgtgcattcaatttctacacttattcgtcttacacaactgcaagtttgtatcctttgaccaagatctctccatttttccctttctgtacccctggtaaccacgattctattctctgtacctatgtattagctttttggtggggaggttatccatcccctcaagcatttatcctttgagttaaaaacaattcaattatactctattagttacttttaaacatacagttaagttattattgactatagtcaccctgttgtgggatcaaatagtaggacttaatcattctttctatttttgtacccattaaccatccccacatcccccccagccttccactgtacttgctgctctctggtaaccacccttctactctctatgtttctgagttcaatcgttttgatttttacctcccacaaataagtgagaacgtatgatatttttctgtgcctggcttacttcacttagcataatgatctccagttccatccatgttgttgcagatgacaggatctcattcatgtttctggatgaacagtactctatactccattgtgtataagtaccacattttctttatgcattcatctgttgatggacacttaggttgtttccaaatcttagctactgtgaccggtgctgaaacaaacatgagagtgaagattatctcttcaatatattgatttatttctttgggatatatgcctagcagtgggattactgaatcatatggtagctcaatttttagtttgttgaagaacctccaaactgttctccacagtggttttagtaatctccattcccaccaacagtgtacaagtgttttctccacatcctctccagcatttgttattgcctgtcttttggatataagccattttaactggcatgagatgatatcttgttgtggttttgattttcacttctctgatgaccagtgatgttgagcacctttttgtgttcctgtttgtcatttgtatgtcttcttttgggaaatgtctgttgaaatcttttgctcatcttttgatcagattattagatttcttcctatagagctgtttgtgttccttatacattctggttttgaatcccttgtcagatgagtagtttgcaaatattttctcccattctgtgagtcatctcttcactttgttgtgcagaagctttataatttgatgagatcccattagttcattttgctttggttgcctgtgcttatgggttactgctcaggaaatttttgcctagagcagtgtcctaaagattttccccaaagttttcttgctatagtttcattgtttgaggccttagatgtaaatctttaatcaattttgatttgattttttaatatggcaagagatagaggtctagtttcattcttctgcagatggatatccagttttcccagcaccatttattgaagaaactccctcttccccagtatgtgttcttggcacctttgttgcaaatgagttcactgtaagtgtgtggatttgtttctagtttctctattccattccattggtctatgtgcctgattttatgctggtaccatgttattttggttactatacctctgtagtataacttgaagtcaggtaaaatgatacctgcagttttgttctttctgcttaagctagttttggctattttgggtcttttgtggttccatataaattttaggattattttttctatttctttgaagaacgccacctgtctaccttgtgttctattttattgtggctaagctggcacttaaactgcaagacacagtctttcccactctttcctcccctttccacaagcagaggagtctcaccctgtagccactgccaccccaggccatgaggagtactgccagactaccaaccaacattctcttaagacccaggggctcttaagtcagcttgtggtgaatgttgcctggcctgggactcacccttcagagcagtgggctcccctcaggcccagggtaagtccataaatgcagtccaggtgtcaagtttcggaattggggaacccaagaacccatttggtgctctgtccctctgtggctgtgttgatacctaaggtgcaagacaaagtcccttttactttgccttctgcttttttcaagtagaaggagttttgcctcatagccaccaaagctgagaacgtgctgaatttcacctgcagccagcaagtctcagatgctcaccaaagacccttaatgtagtacctgggttttgcagctggttatttagggcccagggcctcctcggttagcaggtgatgaatgctgccagcactaggtccttcccttcaaggcatcaggttctcttctggctcggggtgtgtattgaaatatcatctgggacctagggcctcgtatgggtacttcatgctggctggtgccttagatgcaagacaatgtcctccccactcttccctctcctctcctcaagcaggaggaatgggtttgtattggagactggaactgtgtggcccggggtgttataggacgggtgacaccagcactcccttggctgcccagctgacgtctcagtatgtcacgtaccacccccagtccactgactctgggcctagttcagcactgggccttgcctatgagttgcagtccttatggcctagactgcctttcaagttcatttagagacacagagcactgtagcccttggtggtgaggtttacaggaactcaaggtttgaccactgggatcagcaattctcctctggctagcactagtttaaatgctcccttagtaagcaggtgtcagctgagtttggtccacttttcttttctgctctagcaggacaacactaagttcggttccgcataattgctgtgctctccctcccctgcagcatctggagatgctctcggcaccaagctgctgctgttgggggtgagggagaggtgacattggctattcaagactttttaaaaatctcttcagtgcctttatcagtgatatgaagttaaagccaggtgccacgagtgctcacctgatttttggttcttacaaaggtattttttttttctgtgtagatagttgtttacttggtgtccttgaagagggggaggattggtggagccttctattctgccatcttgcttcacctatctatcacacgtggaagttttttctttacatttttaattcataaaattatttttcctgctaaaaaataatgcatagcaaaagccttttgccaggatggatttcagtcaacatgatcagcctcctttttgaagtacattattatcgtgaccaagagattgtgtgaaacacttccagtgccctgtgagggactataaaggtaaccaattatggaagagaagaaatagaaggagctaatcttctctgtcctggcttgcctttgccccgaactcttaaaagaattaattcacttctctgggagatactgggaaactgaggtcgttattggcagccttcaaacactgttcttaatttatggatagttactaaaccacataatcaccgagttatcccattacagggctcagcagaacctaggtctgcagccctgggtgtgaagttcaattgtgagaggttttgagagtgtttattaaagagggcgtgagtgtgcccagccatcatgcagaccatttaggctcccaacacacagccgaacgaaaggatcccatgcataggatttggcatttatccattgaaataatttcctttcattgatttaaaatgataattcaattaaaataattattccaatcaaacttcatatctttttggcaggctccgggggggggggcctctgccctcaatgttattttagtatttgcttcatttgttttctcactgggctgactttggctctctgactctttggaaaattttatgtcattgagcaattactgcacccttctggagctttccactcaagatgcagagaacaagggaaacaaaatatcctagagaaatgttgcactttgaattctgaccagtggaggccaagaaataactgagaatggaatatggttggggtcacccacccattcacctaaatgtatacgtccaagaggctagccagcctgtgttaaagctgtaaggtgaggatgaatgatagtctcaccatctgattcctatctttttaaaatttcttcatttttctttcaacggctgttgtactcttgaaatgtataacagttgtatcagatctcagaaaatctctgatatggtttggttctgcatccccacccaaatctcatgtcgaattgtaatccctatgtgtcagtggaggggcctggtgggaaatgattcgatcatgggggtggccttccttcttgctgttctcattatagagttcacatgagagctgatggtttaaaagtgtggcacttcccccctcactagctctctctcctgccaccatgtaagacatgccttgcttccctttcgccttctgccatgattgtaagtttcctgaggcctccccaaccacacagaactgtgagtcaattaaacctttcttgtttattaaaataaataaataatgcaaaatcaacatggaaaattcaaaaactgcagaaaatacaagccagtcaattctattctcgcgcacaatataacaactgttaacatattgatgtattttgtcctttgttttgcaatacatattttttcacatatttgtgatcacatggtgcacttcaacatttatcccctatctactttcattattgctttgagaaatgagcctagtgaaatgtgtaccagagcactgatctatctcttaaggtacatcttccctcccctcttaaccttcttttccctggagctcagccccatcatcaattgagcctgaagacaatgaaatcattaagaagaaaagctatgaaaaaaaggcttgaagtgtccatcatcttgaagtgtccatccatcaccataaagcttactgttgtctctctcagggttacatggaatgaatcaataccgcagcaacagttgaatttcatctttgtaaataaggtcatgaataaaaacagagaagttaaagagactaagcactcttctaatcaagtatctgaccccttcaccacatcacaggagatctgttatgctgtcacaatcttctcaatatataacctctttcatgttgttaatagaacaacacaccagttctccagaaagtagaaggctgtgttgccactgttagggcatgatcattaatactgtaaaatcattccaggctgaacgttgtattttaaaagctgttgggcatggtggcacacacctgtaaccccaactactcaggaagctgaggtgggaggatcacctgagcccaggagttcaaggccaacctgggcaatacaatgagacctctgtctctaaaaaataaaaatttgtaaaaagacaatgatacaaattgcatctataagcagtgtgaagcctgtttaaagcatcaggaaacagaagctgtgcattagtccagtctcacactgctataaagaaacacctgaaactgtgtaacttattttttaaaaaaagagatttaattggctcacggttccacaggctatacaggaagcatggtcgggggaggccacaggaaacttacaattatggcagaaggtgaaggggaagctggcatgtcctacatggctggagcaggagaagacagagcaaaggggaaagtgccacatgcttttaaccatcagatctcatgagaacttactatcatgagagcagcaaggggaaaatgtacccccatgttccaatcaccacccgccgggtctccctcaacattgggaattacaagtcaacatgagatttgggtagagacgcagagccaagccatattaagctccatctattccaaagtccccagccagcaaaagctgatagatccaaaacttgcaaatataataaatataaaggagttattgtcctatacagcagttgtccccaacccccaggctatggacaggtactgttccatgacctgttacaatagtgaaaccaggccacacagcaggaggtgagtggtgggctagtgagtgttacctcctgagcttcacctcctgtcagatcatcaggcattaaatttgcataggcgtgtaaaccctatcgtgaactgtgcatggaggaatctaggttgcatgctcattataataatctggtgcctgataatttgacatggaacaattttatcccaaaatcatcttctcccatctcgcagtctgtggaaaatttgtcttccatgaaacgggtccctgatgccaaaaaggttggggaccgctgctatacaactttataaagtccctgtgcctgggaaatgtaccggtgcgcatatgtgttctgttgcgggaagtgctatttgatccaacaaagcccaaagccccacatttaaaaaatgtttgctgaaggtaagatccacagatacacactgcaagatctaccaaggcaacagccttgatgaccatggtagcaagcctgaagttgctgaaatgttgagtaggtatcagataagagacctgctgctaatacccttgtgaatcattaggtcgcagttttctcctttacatgctcattattaaagtgccttagacccccttgtgtacagatgaaaaataatacattaaaagaaaaagaaatcaccttaagccagttgttctttggatctaactgtgattgaaagtgctattaggacaaaagcagaaagaaacagattattcaaagcctgtaacattagtcactaatagattctgtgggagaactaaatgtaatcagataggtacattgtatgatgtcaaattaacccatcttttcaaggactatggtgctgagaaaaacgaagcaaaaatgtgtgtagttgtgaatccaaaggtttacagttatgaacaatactcaattcgtgcaatttactagaatgacctgaagtaaaagtagccagtcccttaggcaggaaaatatttggctaaaacacggcaagaagc

SEQ ID NO: 7784 - DNA, 8397 bp, artificial
  synthetic oligonucleotide
agtttataattctaacctaaatttcacaaatagggagcaagatggcgccatagaaggctccaccaatcaaactctcttcaagaacaccaagtaaacaactattcacacagaaataataccttcataagaatcaaatatcaggtgcacactcatgagtacttggctttaacttcatataactgataaaggcactgaagagatagaaaagcagcctggaattgccaacactgcccccaaccctgcagcagcagcatggggtggggagtatctctgggtgctaggagagggagagcacagcaattatgaggcactgaactcagcattgtcctgttagagcagaaaagaaaaccagaccaaattcagctgatgactgcccaaagagggagcatttaaaccatccctagccaaaggagaattgctgatcccagtggtctgaacttgagttcctgcaaacttcgcacagagggcaactgtgctctaggtctccatgaaaacttgaaaggccaccaaggccataaatattgcaacacttaggcgagtcctagggatgaaatgtgtccagagacagtagactggggaaggtgcacacgacctaccaagacaccagccagggcagctaaaagagtgctggcatcacccctcccctaaccacaggctgcacagctctcagccacaaaagagacctcttccttctgcttgaggagaggagagagaagagtggggagaactatgccttgcatcttggataccaacacagtcacagcaggatagggcactggacaaagtcatgaagccccttttctaggccctagctcccagatgatatttctagatatgtcctgggccagaagaaaccagatgccttgaagggaaaaacccagccctggcagcagtcatcacttggtaactgaagggcccttgggccctgaacaaccagcagcaacaccaggtattacaccaagggccttgggtgagattctgaaatttgctggcttcaggtgagactcagcacattaccagatgtggtggctatggcatgaaactccttctgcttgagaaaagcagagggaagagtaaaggggactttgtcttgcaccttcgttaccagcacggccacaggggaatagagcaccaagtgggctcttagggtccttgtattcaggacttcactcttggatggcatctctggacctgtcctgggccagaggtaaaaccactgccttgaacagtgagtcccaggtcatgcaacattcactgccctgaagagtgagtcccaggtcatgcaacattcaccgccctgaatagtgagtcccaggtcatgcaacattcaccacaagcttgggccttaagggaatatcagcagtagtctggcaaaactccccatgacctatggtggtgcctatggggtgaggcttctctgcctctggaaagaggagggaatagtgggaaggactgcatcttgtcgtttgagtgccagctcagacacagtacaatggagcaccaggtagaattctaaggtttttgactctagtctttgtctcctagacagcacctctggaaccactcagggcctgggggaacttgctgccctgaatggaagttcacagatgtagccgactttttcatcagctgattgtagaactgcagggccttgagcaaaaataggcagtagccagggagtgcttacagcaggcctttggtgagacccagtgctgtgctggcttcaggcctgatccagcatagtcatagtggtggtacccacaggggtgcttgtagcactccacccccagcttcaagtggctcagaacagagagagagactctgtttgggagaaagtaagggaagagaacaggaggctctgctgggtaattcagagaattctcttggatcttgtctaagaccattaaggtggtatctctacaagtctgaaacaaccacagcattactgggtttggggtgccccctaaagtagatactgcttagatcacaacacccaagttctttcaaatatctggaaagacttctcaagaaggacaggtacaaataagcccagacagcaaagactacaataaatacctaattctttaatgcccagacaccgaagaacatctactagcatcagcaccaaaaagggaaacataacctcaacaaatgaactaaacaaggcacgagggactaatcatggagaaacagagatatgtgacctttcagatgaagaattcagaataggtctcttgaggaaactaaaataaattcaagataacacagagaagaaattcagaattccattagataaatttaacaaagagattgacataatttaaaagaataaagcagaaattctggagatgaataatgcaatggatacagtctttgaaaagcagagttgatgaaacagaataaagaattaatgaccatgaggacaggctatttgaaaatacacaataagaccagacaaaagaaaaaggaatgaaaaacaatgaagcaaatagccttaaaagggcaaatctaacagttatttgcctttaaaaggaggtatagaaagagataggtgtagaaacgttattcaaagagtaataaccgagaactttccaaacataaagaaatacatcaatctccaaatacaagaaagttatagaacaccaagtagatttaacccaaagaaaactatctcgaagcatttaataatcaaactcccaaagatcagagataaagaaaagatccaatcccagcactttgggaggccgagatgggcggatcacgagatcaggagattgagaccatcttcgctaacacagtgaaaccccgtctgtactaaaaatacaaaaaattagctgggcatggtggcaggcacctgtagtcccagctactcgggaggctgaggcaggagaatggcatgaacccgggaggcagagcttgcagtaagccgagatcgtgccactgcactccagcctgggcgacagagcaagactccatctcaaaaaaaaaaaaaaaaaaaaaaaaaaaaaaaaaaaatccaaaaagtagcaagagagaagaaacagataacataaaatggagctccaatatgtctggcagcagacttttcagtggaaaccttacaggacaggagagagtggcatgacatatttaaggttctgaaggaaaaaatattttaccttagaatagtacattcagcaaaaaaatattcttcaaacctgaaggagaaataaagattttcccagacaaacaaaccctgagggacttagagggacttaatcaacaccagacctattttacaataaatgctagagggagtacttcaatcagaaataaaaggatattaatacacaataagaaattatctgaagtataaaacttcctggtaatagtaagtacacagaaaaacataaaatattacagcactgtaactatggggtgtaaactactcttatcctaagtagaaagattatgtgatgtcccaattaaaaataataactacaagttttcaaaacatagtacaagaagatgtaaatggaaacaaaagaaaagtgtaaagaaaagggggacaaagttaagacacagagtttttattagttgtttttttgcttgtttgtttatgcaaatagtgttatgttgttatcaggttaaaatagtggcttataagatagtatttgcaagcctcatgctaacctcaagccaaaaatcatacaatggaagtaaggaaaataaaaagcaagaaactaagtcatatcaccagagaaaatcaccttcactagaggaagacatgaaggaaagaaagaagaaagagaagactacaaagcaaccagaaaacaaatgatgaaatagcaggattatgtccttatttactaattgtaacatctaatgtaaatggactaaactctccaatcaaaagacagactggctgaatggatgaaaaaaacaagacccattgatctgttgcctacaagtaacatatttcacctataaagacacatatagactgaaaataaaggatggaaaaagatattccatgccaatggaaaccaaaaaggagcaggagtacctatattatatcagacaaaatagatttcaagattttaatacaaaaagtgtaagaagagacaaagaaggtcactatataatgataaaggggtcaattcaacaagaggatataacaataataagtatacatgcacccaacactggagcaccctgatatataaaggaaatattattagagctaaagagagagagatggacccctatgcaataatagattgcaacttcaacactccactttcaacattggactaatcttccagacagaaaatcaacaaagaaacattggacttaatctgacctatagaataaatggatctaatagatatttacagaacatttcacctaagagctgcagaatgcacactcttctcctcagcacatagatcattctcaaggatagaatatatgttaggtcacaaaacaagtcttaaaacattcaaaataattgaaataatatcaggcatctttaggcatcttttctgaccacaatggaataaaactagaaattaataggaatttaggaaactatacaaatacatggaaattaaacaatatgctcctgaatgaccagtgggtcaatgaagaaattaagaaggaaattgaaaaatttcttgaaagaaacggtactggaaacatgacatacaaaaacctacgggatataccaaaagcagtactaaaagggaagttttcactataagtgcccacatcaaaaaaagaggaagacgttcaaataaacaatctaatgatacatcttaaagaactagaaaagcaagatcaaaccaaacccaaaattagtagaagaaaagaaataatcaagatcagagcaaaaatacatgaatttgaaatgaagaaaacaataaaagagatcaatgaaacaaaaagatggtttttgaaaagttaaaaaaaaattgacagacctttaacaagactaactgaaaaaaaaagagagaggctcaaataaatagaaacagagatgaaaaaggagacatgaaaactgatactgctgaaattcaaaggatcattagtggctactatgagcaaatatatgccaataaactggaaaatataggagaaatagacaaatatctagacacatacaacctaccaagattgactcctgaagaaatccaagacccggacagaccaataacaagtaacgtgatcaaagtggcaataaaatttctcccagtaaagaaaagcctgaaacccaatgacttcgctgttgaattccaccaaacatttaacaaagaactaataccaatcctactcaaactattctgaaaaatacaggaggagggaatcatcccaaacacattctatgaggccagtattaccctgatgccaaaaccagacaaacacacatgaaaatgaaaagtacaggtcagtatctctgaggaatattgatacaaaaatcctgacaaaatactagctaaccaaatttaataataaattaaaagaatccttcatcagaacaaagccctgggatgcaaggatggttcaacatatgcaaatcagtatgatacatcatataaacagaattaatgatggaaaccgtatgatcattttgattgatgctgaaaaaacatttgataaaattagacatcccttcatggtaaaaactctcaaaaaactgtggatagtaggaacatacctctgtataataaaagccatctacaacagacccacagctagtatcatactgaatggggaaaaactgaatgccttgcctctcaggtctggaatacaagaatgcctactttcaccactgttattccacatagtactggaagtcccagctacagcaatctaagagaacacataaagggcatccaaattggaaagggagaagtcaaataatccttatttgcaggtgatattatcttatatttggagaaacctaaagactgcaacaaaaaactatgagaagtgataaattcagtaaagtcgcagaatacacatcaacatacaaaaatcagtagcatttctatatgccaacagggaacaaactggaaaagaaataaaaaagtaatcccatttacaatagccacaaataaaattaaatacctaggaattaatcaaaacatgcacaatctctacaatgaaaactataaaacactgatgaaagaaattgaagcagacaccaaaatgttgaaaaattttccacgttcatgtattggaagaatcaatattgttaaaatgcccatactacccaaggcaatttacagattcaatgaaatccctatcaaaacaccaatgacattcttcccagagatagaaaaaaatgatcttaagatttatatggaaccacaaaagacccagaatagccaaaactatcctaagcagaaagaacaaaactgcaggtatcattttatttaacttaaaattatattgcagagctgtagtaaccaaaacagcatggtatcagcataaaatcaaacacacagaacaatggaacagactagagaacctagaaacaaatccacagacttccagtgaactcatttgcaacaaaggtgccaagaacatacactggggaagagacagtttcttcaataaatggtgctgggaaaactggatatccatctgcagaagaatgaatatccttcattcttctagatagatagatagtctatctcttgtcacattctatcacttgccacattcaaaaatcaaatcaaaatggattaaacacttaaatctaacacctcaaacaatggaactattgcaagaaaacattggggaaaatctccaagacattggtctgatcaaaaatttcttgagcagtaccccataagcacaggcagccaaagcaaaaatgaacaaatgggatctcaagttataaagcttctacacagcaaaggatacaatcaacaaagtgaagagatgacccacagaacaagagaaaatatttgcaaactactcatctgacaagggattcataaccagaatgtataaggaacacaaacagctctataggaagaaatctaataatcaaattaaaagatgggcaaaagatttgaacagacatttctcgaaagaagacatatgagtggcaaacaggaatattaaaaggtgttcaacatcattgatcatcagagaaatgcaaatcaaaaccacaacaagctatcatctcatgccagttaaaatggcttaaatccaaaaaaccggcaatagcaaattctggagaggatgtggagaaaagaaaacacttgtacactgttccccctcttggtggtgggaatggagattactacaaccactatggagaacagtttggaggttcctcgacaaactaaaaattgagctatcgtatgatccagcaatcccattgctgggtatatacccaaaagaaataaatcagtatatttaaaagacatcttcactcccatgtttgtttccgtaccattcacaacagctaagatttgaaagcaacctaagtgtccatcaacagatgaatgcttaaagaaaatgtgctactcatacacagtggagtatggaatactgttcagccagaaacagccagaatgagatcctgtcatctgcaacaacatggatggaactggagataattatgctaagtgaaagaatgaataagacataccatttgatcccacaacaaggtgactatagtcaataataactgtacatttcaaaataactaatagagtgtaattggattgtttgtaacacaaaggataaatgcttgaggggatggataaccgattctccatgatgtgattatttcacattgcatacctgtatcaaaacatctgatgtattccacaaatatatacacctattatgtactcacaaaattaaaaattgaaaaaaaattaaaatttatcaaaaaagggggacaaggggagggatagctttaggacacatacctaatgcatactgggcttgaaacctagatgatgggttgacgggtacagcaaaccaccatggcacatgtatacccaggtaacaaacctgcacattctgcacatgtatcccagaacttaaagtaaaataaacagaaaaattatcaaaaaataaatttcacaaatagtttgcaatctcttaaattttttaaacattattttgtaatcattataatgtactctttatagtctgtgtgtgtgtgtacatatatatatattctccttagagcatattttcagaattaaaagagaaaaatgttttcaattactattggcaaacaatgagtttgtgtgggactcagattagtgtgagtttttactttggtgtttttcttttggaaattgaatatattaattttcatttacagagaaaggatggaagtagggagagaagaaggagaagaagggaagaaaaggaaatacataggaa

SEQ ID NO: 7785 - DNA, 2584 bp, artificial
  synthetic oligonucleotide
ccatcatggaagcgcctattcttcataccccttatcacagctgcaactactcatttacttgtctgacaatttgatttatgtccacctactttgctaggtactaagttcaatgctggcagtcgtttcttctttttttttcttttctgttttgctcaccgatttctcgttagcacttagcacagtgtctggcacacgatagatgctccgtcaacttctcagttggataccagcatcccgaagggaacatggattaaggcagctataagcacggtgtaaaaacaggaataagaaaaagttgaggtttgtttcacagtggaatgtaaagggttgcaaggaggtgcatcggcccctgtggacaggacgcatgactgctacacacgtgttcaccccaccctctggcacagggtgcacatacagtaggggcagaaatgaacctcaagtgcttaacacaatttttaaaaaatatatagtcaagtgaaagtatgaaaatgagttgaggaaaggcgagtacgtgggtcaaagctgggtctgaggaaaggctcacattttgagatcccgactcaatccatgtcccttaaagggcacagggtgtctccacagggccgcccaaaatctggtgagagagggcgtagacgcctcaccttctgcctctacgggtcacaaaagcctgggtcaccctggttgccactgttcctagttcaaagtcttcttctgtctaatccttcacccctattctcgccttccactccacctcccgctcagtcagactgcgctactttgaaccggaccaaaccaaaccaaaccaaaccaaaccaaaccagaccagacaccccctcccgcggaatcccagagaggccgaactgggataaccggatgcatttgatttcccacgccactgagtgcacctctgcagaaatgggcgttctggccctcgcgaggcagtgcgacctgtcaccgcccttcagccttcccgccctccaccaagcccgcgcacgcccggcccgcgcgtctgtctttcgacccggcaccccggccggttcccagcagcgcgcatgcgcgcgctcccaggccacttgaagagagagggcggggccgaggggctgagcccgcggggggagggaacagcgttgatcacgtgacgtggtttcagtgtttacacccgcagcgggccgggggttcggcctcagtcaggcgctcagctccgtttcggtttcacttccggtggagggccgcctctgagcgggcggcgggccgacggcgagcgcgggcggcggcggtgacggaggcgccgctgccagggggcgtgcggcagcgcggcggcggcggcggcggcggcggcggcggaggcggcggcggcggcggcggcggcggcggctgggcctcgagcgcccgcagcccacctctcgggggcgggctcccggcgctagcagggctgaagagaagatggaggagctggtggtggaagtgcggggctccaatggcgctttctacaaggtacttggctctagggcaggccccatcttcgcccttccttccctcccttttcttcttggtgtcggcgggaggcaggcccggggccctcttcccgagcaccgcgcctgggtgccagggcacgctcggcgggatgttgttgggagggaaggactggacttggggcctgttggaagcccctctccgactccgagaggccctagcgcctatcgaaatgagagaccagcgaggagagggttctctttcggcgccgagccccgccggggtgagctggggatgggcgagggccggcggcaggtactagagccgggcgggaagggccgaaatcggcgctaagtgacggcgatggcttattccccctttcctaaacatcatctcccagcgggatccgggcctgtcgtgtgggtagttgtggaggagcggggggcgcttcagccgggccgcctcctgcagcgccaagagggcttcaggtctcctttggcttctcttttccggtctagcattgggacttcggagagctccactgttctgggcgagggctgtgaagaaagagtagtaagaagcggtagtcggcaccaaatcacaatggcaactgatttttagtggcttctctttgtggatttcggaggagattttagatccaaaagtttcaggaagaccctaacatggcccagcagtgcattgaagaagttgatcatcgtgaatattcgcgtccccctttttgttaaacggggtaaattcaggaatgcacatgcttcagcgtctaaaaccattagcagcgctgctacttaaaaattgtgtgtgtgtgtttaagtttccaaagacctaaatatatgccatgaaacttcaggtaattaactgagagtatattattactagggcattttttttttaactgagcgaaaatatttttgtgcccctaagaacttgaccacatttcctttgaatttgtggtgttgcagtggactgaattgttgaggctttatataggcattcatgggtttactgtgctttttaaagttacaccattgcagatcaactaacacctttcagttttaaaaggaagatttacaaatttgatgtagcagtagtg

SEQ ID NO: 7786 - DNA, 800 bp, artificial
  synthetic oligonucleotide
aaaagagatgcactaatggagattgttagattcaatctaacaatcttgcctgtaacattttgttagaggcaaaatgatggttggcacagtatttgtctttcctacccagctgtgctggagccaatcattcctaagtagctgctcccccatcactttatagcagaggagttcccttgttgggtatcagatactttgcttccctgatcccttattcagtgtgggcaggacccattgaatttccatccatttggtacatgaggaaagattcatctctacactcctcaaatgaggacccaggactcctgtgagtcctgggctaagaaatgcctctgggcaagaataggccagaaggaaataaaaggatatattgttttccttccagaaatagacatgaggatgggtgtagagttcatctgtctttaggagtgaggtcttggcagtggtcacaccagcagctggccactccaaggggttggcaagctacaggtgcagcccagggctttaagtacaacaatgcctacagcgcaaggagagaggagaaatcaaactgctggtagtgttgtgaggttcttcctcttctagttcattttcagcaaaattaaatgatcacctgctcatttgatttttctcacaaatgcataaaccactaacaaagaagttatggaacacaatagatatgcactgagttcactgagttatgctaatttcctcaaaaaattgtgccttttgaaagagaaaataatcattcttaggacagtatggaataacttcctttaaaaaatttaaatctatttttaaat

SEQ ID NO: 7787 - DNA, 414 bp, artificial
  synthetic oligonucleotide
agtgctggcaggaatctttttaataataatttatcaggatatatctggattatatatcgatcttagttcaattttgtctgaaatgtggaaaatggcaatcctctccaaatccaatttcagataatttttctgaactgaaaattttcttcgattataactttgattgttgtttctaatccatttgctccatttatttcctcagaagcaactggtactggtaggtagaatatgtcacctatcttccacaatgggtattttgttctctaatccctaccaagcattttcgagatgtttttcgatataattctctgtttcaatgattcagctttctgttgtgtcaagtctacttactccttttgatttattctttcatcttgattattgcatttttctgtttggttgcatcatgggaat

SEQ ID NO: 7788 - DNA, 711 bp, artificial
  synthetic oligonucleotide
taactatatttaccatgttgtacaatagatctcttgaacttattcctcttattgaattgaagttttatatcctttgaccaacatttccccagccacactatagccacctcagcctctggtaattaccattctactatatttctatgaggtcaacttttttagcttccacatatgagggggatcgtgtggtatttgtttttctgtgtctggcttatttcacttaggtaatgtcctctaggttcatccgtgttgttgcaagttacacgattccttcttttttatgactgaatagtatttgtttgtgtatataccacattttctttatacagtcattaattggcagacacttaggttgattctatatcttggctattgtgaataatgctgcaatgaatatgggagtgtaggtatccctttgacataccaatttcatttcctttggatatatacccaatagtaggattgctagatcatatgatagttttatttttaattttttgaggaatctccataccattttccataatggctcgactaatttagatttcccccaagagtatgcatgtgtgtccttttctccacatcctttccaacacttgttatcttttgtctttttgattatagccattctaacaggtgtgaggggatatctcattgtggttttaattttcattttcctcatcattaacaatgctgagcattttttcaaat

SEQ ID NO: 7789 - DNA, 1387 bp, artificial
  synthetic oligonucleotide
tgcagatttgaggtttgctattgaaagccacagagatgagatatcagaactgttccctgtaaaattggaagcattatatacggactaaacatgtgcatgaaatccaagagggcaggagaagcaaatctggttccaaacctgatgagcataatgcctccttcctctggtttctttccaatctttcctagcattctggtagctagaatttacagccttgggaacctattaaaatgagtttcacagtattatggaattaaaaatgaggagttaggaggaaaatttgcttggaaccaggcaaatttatcaatacttgcattcattttgattttgttccaccttgaaacatctgagcatagaagtgatagaaaaatagactcatcagtacaagtcagatgctaatattacaactgagaagctgaccttgataaccctgaagggagagttggatgttggtgcttccgcttttatccttcataggttgagtccccttagaaactgttacttttggggttagacgttgattataatcagactttccacttgactatgggttgttatgttcttgttgaaggatagacaggaaacatcaagagagaccattgttgtcaagaggactgggtaatccccattcactatcaagagaaggaaggaagtccagttttcatttccttctgtgagatggagtatataacaaatatgaaaaccatcaaagaatctatggaggcttctgtttagtctacagccaagaataagttaagtctcaatgtgaagagtaaagatatatctttagtaactcatataatttaacaaagcagctcctgaatgaaataaatgtgaggaagtgtgatgtgaatcttaatagaaaggaggaactggtagcacaaataaacagttttctagattgtcaggacacttatgggttcatgtaaatccaatccagaatatgagctagggattcccaactctcctttagtggcggtgctctcttacttaacaatcttctgtcccagccccatttctctaaatacaagtagtgaatgacatttgtttgttatatttcagattaaagcaaggataaaattattatttttaatgagggataatacaattctacagtgctctttaagatcactggaggcattctgaggtgtcacaaaaccaatattgggaaactaaactaactcttccgttaaatttggtttaaagagttggcaactttcaaatgtgtaataagtatgtttagaaatcatgaggacaaacttcctttgggtttttaccaatttcaccttttaccacagctcttccaactctgtggccatctgttttgaggcggagactgataagtcccacaggaaacttcagattcttatctattcttactgatgta

SEQ ID NO: 7790 - DNA, 295 bp, artificial
  synthetic oligonucleotide
ttctgagagtcctttgtcatcatgacttcctttgactactgaatgttggaattcttcagagctaagacctgctcctcttctcttctggctttgtatttctgctccaggtggtttctcccattgtcatgattttaaatactatttggatgcagatgcctctcacattttgatctctagtacgaacctcttctttaaaatccaggtttacacacccagctgccttacttgacatctctactagaatgtttcacaggcatctcacactcaacaggtctacacagagctcttgacttcc

SEQ ID NO: 7791 - DNA, 6476 bp, artificial
  synthetic oligonucleotide
ttgaagcagcagccggcaccacttgtctcttctctccttcccgcaggcacttctgttcatagtgctgcctcttgctggctccttctgcttctgcttggtcctcctgctgattgggaagaaagtgcaccagtgaggtgatggggggctggaactcttaaaggggcagctttatttctgttgaaaatttgtttgcctagcatgttatttttttttctatctttccccattaaatacaattttgtgagaaaagtaaaccagaaataaagtgaccataatcaccatttaaatgttaattgtaggtgttctggctttcctctaaggattttcaagcagatcaagtactaatgctggcaaccatcatcagcaatcaaatccaatttgaggattttttactgaaggcataaaggtcgggggccacagatctgagcgaggccgtccttgttgctttaagggctctcagtccagggctgaatactagaattccatgaataaataagtcacagagataatttgaaaatccccagcaccatttttgccaataactgtttctccatagagtctttttgaccagaggagtttacaggtagccaaatctacaagccactttgagatgtcgtctccccttggctgcccactggttgattttccatcagtcaaccagcatctgttgaggacttggtcccatgcaaagtaaatagacatctaagcaaagtcccagtggatgcttgagttgcagaatcttagagccttgtttctctatgttaatgatgtgctttctttccccccgtaaaacaatgtgaaagagaccagaccctgggccccttgtagctcaaatgctgaagtcattcatgcttggagctgaggcaccttctactggctccagccctggaagagcttcccaggttctaggttctaatctgggatccccctctaggggaaatatcagatcttgagcattttaatgtcttagggtctctgtttcttcaggaaaaaaatgaagttaaaaggtatttggatgattttggtaatatgagataatactgtagaagcatattcaaatagaagggagaatgtcagagaagtatgagccagagggctgctgggtgttttatggagaaactgaggcccagataagtgacttgcttggagtcacacacagagctaccggcaccctgctctgtcagggctcagtctgctgtccttcccaagagagttctagccttaggatttgaaaaatgtgccaatactattccctctgtataacgacacgaagaaggcaaattacatgcctaggactccagaatgctcatgtcctgaaatgccagaaagcggtcccgccccttcccacagacctttctctgcacggaggccagggaacctttccctccagggaattggctaaagggatccactccttcctggatcagaggtggaggttgaagggagtaggaggctcggttaaaccctccacgtgcagaaagagaatttcaggccagaagggagacgggcagccggtgcgtgggatactgggcacacacccagtggttttcccatttctcagaggaggagctagcagaagtcttttgctcaaggcacctggtgaccgtgcgaggaaagtgacagtggaacccagtttaacagtatcctaaccccgaactcaaggaccacgcaagggcagtcatttgttcctatccttgctgcccactgaatccagggcctatagctcgctgacctactaggtgcgcgcctaaaggcatgcctggagggcctgggtgcgggcacgtggagccacggggctggtgaaggtgaccgccttctccttcctggacccgcgtgctacgcactacagacctgagggatgctcaggcccgcaaagtttgctccactactcgggggctcaaggagctgtgcttgaggtggcagggggcgaccttcaaccccacggctgtttgtgctgtcttttctagttcaaaactaattcccagtggtgggggtgggctgggcttcagagaggggtcccattcccgaagcccgcgtcctggtcccgccagcccacctcctgtatccctgccacggcccctgcgtcccgggtccgggtccgggtcctcagctctgtggccgctcccactagctgattttgacagtggggggtgggagagggttcccgaaaggcaggggcgggcgcggcgagcccctgccagatccggggatgataacgtgcctgctccatgtcgcggcttctagctgtccaggctccgccccctgtgagtgtgtaagtgtgtgatgctgccgcggccgccgccgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccaggcgcttgcccgcccagtgccactgccgccgcttcctcgccggagcacaggaccagacacctccagcgcccgctgctgctgccgatgcggcccggacacttttagctgggcgggagggctggagagccgggggccgccgagaaccgccagcgagctgtgccgagagccgcgccgacccgctgcgatcagggacaggcgcccgcccgccgccgccgcctggccgctatggatctattcgactttttcagagactgggacttggagcagcagtggtaggtgttgatttttgccttctcctttgatgagcgagtctcctggcgaagtctgaggttttcgcctttgttaagaggagctgaagctgtcgtggggggcgccccggactccctcccacttgctctcagccacctctggccccggccgcgctgactcctaggtcggatgccggggtggggggaggtgcgggaagagggagggatgcggacccgaaagcgtcgctttgcgctccaagtctaaagagttgcatttggctcacatcgaattcggtgccgcccgagggctgaaccgcacgacctcccaggagcttttctctcggagcggcttgccggtctggcctccttgagccccggatgccgcccgcccgaaatgtctcaactttccaggtgcccaacgcccgcggcgggccatgggggaaaggcaacggccaggtgcggccagcagccctctgcttccttggtggccaccgcccccgctgccgccacctccatccctgcgctgcgcggcgcgcacacctttccttctgccgactcagcccaagttccctgcactcccgggtggagcagcggctttgggggccaccactcaggggaccttggttcgaggccgacttcggcgcttggctttcaagactgagggttttcggagttggccccccaaatccgcagctctgatgtcaatgcacatttaattaccggatggacccccttcggcctcccactgggaggcagccgtagttttttgtaagggacctccagctcagattcaaaggttgagtcagctcttcacaaaataccctaaacttgtcgctgagacattttgaaagatggtagaaaggtgactggggacctggaaagttgttaactctcttagagatgtgcgtgcgcgtgtgcataaatactgatatacatatctattaacttttcaaaaacttcacctactacaaacattatcacagtttatttgtcataatacttaaacgtatcagattccccccgcagtctaaggaattagatggggagggggcgcagtggtaaccgcttaaaattgcattcttggttattgccttttaaaatgtatttagaatgatctgtagtacctaccaatagtgcgaaatcttttgcaatgttaaactactagcggccgttggttatgaatgctgtgtatttttacaaggatttcccctgttgatgtgatattttaggcaatttccttctttaaaaaagggtcatatgcttagccaacagcttcattatgccaatcatgcctcctttagttgcaaatccaagatagtcagaacttaaatacattttattttacagcaattccggataaatccttgaagcgcaaattatgctgtatcagtattaatctataaggcgttttggataccacggttttatcagctctgtagaaatacattgttacattaaaaaatgctgttatttgaaagtaaaaattactataaaattattgctcaattagatattatgcttctgcacacagcctttactctgcttcactaatttattttgcagacaactgataaccatagcactctatttgcatacaatttgcctaatatgtggtgtgggttacatcgttaatttaacagacattgttataattaatttcatgggtatagttcaaatgttaaacatatacaaggtattaggtttttagaaacatgttttttatattaattccggtttaatcttatgcatatgcaattgcatatttaaagggaatggactcttttatgtttgatttctttaaaaaaaatgataggctccctcacccctgtgggaggctttctttttcttatcttaaggaaaatgcaaaacctttttttcctccagatccctaactgagacacatcagttaagaagcatagacttggacacttcgtgaatattatgtgaaatactgattaattagtgtaacgcatctgcataaataagcctgtcctttccctctgtacatgatccaggaaaatttctccttcttactgctcgtgagtggcacacttcgtgatgcatctctgtttataaacatttgtaatgtggttgtgcttttgtgttttgtatagctccacagagaaaaggaacataaatgtgacaatagtggatgaactaaaaagcttgacattgtcttgagtggaaattggtacctttcccacttctctttggaagtccagagcatgccagttacgtgttcattatatgtttacttccattccttgggagtaaatagctacttaaagtgatggcctccactccccacgcccccaagcccccaggagggccaagaaaggaaaaaagaccagcaaagttaacgatcttatttaccttgaatttattcttaacattcacttatggaacagtaagctctgagctgtctctactgcaaccctagatgtctgacaataaatggatcaggacagcttaaaaacaaactcattttcctagacataatgaagaaagactttacatacacaggcatatgtgttatttgcaaacacttgactgtagtaaacaaaaagtgtgtgcccatttataaacacacacatttgttagggcaaatgcaaatggaaaggatggggtactaatgatgctgcagtgtgcatgttatgtgcagtgttttggaatgctcacatgcctaatggaacataccactggatttcacaaactgcaagaataacttaatgggtcatgctctggactcgattaaagggccaaagctcaagttctttaagattcttggatgaatgagcaatgttcacctgagtctgaatttaatataaaccattctgtgaaagaaaaagatggcacagatgtctgtctgtgtgcatgaaagacatcacttgctcttaaagaaaaagataaattaaaaaaaaatcaaatttcttcatttaaatcattccatagacttgtttttggtaaccaagtaaatgaatacttgaggtgactgaagatcaggtaatgatgtcattaatccccatttaagagggaaaaaaagcaaattcagagggcctacaaaatgtacagcctttcagttctgtaagcacctcccacccagtattgattaggtattgctttgtgacaagccaaggttctttgtggggatgcttaccttttcttcattggaaggaaggaaaggaaagaaaagaaagaaaatacagaaagggacacattcttaaaaaaaagaaaagaaaagaaaagaaaaccaccgtgatagcaaaatcagaacgttcaaaagcctagttaaaatcgtagttaagtgactgtgacagtggctggcttctcaccgcaagggacagcatcaattgtttgtagtttttatgtgatgtctcacaaatagcctaattagaggcaagcttgcaaacgggcagttatacaggaagagacttaaactcactaaactgttatataaatagaaagttcaaaggtctgtgtggggctgtcaaggctgagaaggggccatgtgccggccaggcctctcctcctccggtaaaggcagcccccagggcctgccccagcagtccgaactgcactttccccagttttcttcgaccttgcgagggcggggcagtgccggagaaggggcggggggctgctttctagacaaaagtgaactgtttcagctcc

SEQ ID NO: 7792 - DNA, 1947 bp, artificial
  synthetic oligonucleotide
tcagagtgaaatggaaatccagaaatttttattgtttaggggacccggagcattgaatactcaacataagacaattgactttggaccctgaattatctggtttgacagtagctcacattcatcacataattgcctgagtcctcttttgctgtgtgaatggagtattctcattaacacagaccaacatttgctgagggacaaccacaaaagtctcccaagaagagctttggaaacatttgtgcaaacattcttcaaagaaataccaaatgaaaatgtgttttttttctgaaataattgaaacaagtgtttgtaaattggtacaattgctagcaaaatggccatttttcaaaagaagggtatactgtagctcttgagatgttcacaaatacattgtttcttttgctctttctccttttctaaaaatataattaactgttttgtttgttaggtgtgtaccaacattttaccattagaatttcttttttcctaaaaagggagttggtgccttcgtactgtgtgaattgtgttgacatctgtgtttacgattagctgtttggccaccaagtaattctttgcctggctatgtcattgttcaaatctcaactctatctctgggaagctgctagtgagcagcaggacctcctgcttcctccgtccctcaaactcccatactcctacccagtctgttcagatgcctctcctctgtgctttcataccttcctgagctgacttccacctgggctggatcctgctttctcccttccccaactcttcccatgcaactttgttgttgtgaaagatgagaatgtgtcttttatttttgtgttcccagtccctggcccagaataataacctaatgctgccagttcagagtgcagcatcattcatttattcagttcattcaggcactatgctagttcttcaaaatattaaatctagctgagaagacctaaaaacggtattaatagtaataatttaagctaataattacaggtaacatttcctatgttacaggttctgatttgtgttatccgatttctctattaacagagcaggaaactgggacagaagggttcagcgacttgcccaaggccatactggtagtatgttgctgagcttgaattaatccacaggccatgtgaatccttagcttctctgctaatctataaggataccctaggatagatgctatactagtggcaagccctgcttgtgcttgggctctatagtagactgggctaatgaggactttaccactcatccttagtatttacaaattgggtctaagttcattatcaaatatgaggcatgactttccagatatctactccaacaagagacacacaagtctgttcctctttggtgtaagtggcagattctgatcttgggaggaaggtatactggttcaaaaacctgaacctaattcaaacttgacaagaatgtgagctcattaagggtggagagttttgttggttttattcactgctgacactgcaatgcttagaacagtgtgtggtgcacagtaggtgctcagttattttttggtgaataggtagatggaatgatagacaaaaacctgcttaatactttgtgtgattaaatttgtgaagagatagctcaagaggtgtaagaatgaggaccaagagaagtgctaaaatcacaatgagcagacaggtgggtacaggtaggtgtgttgccttgccttctgtacatacttttctgaaataggatgcttatagaaatgttataaattaaatgttctttatgtgcatcttacttgccaggaataccgtagggaagtctttgttgatgagcaaaatctctcccaaacagccctaaacttatcagatttgtgtacagcattttgagattttagatttttgtgtacagcattttcttgtcatgaggtatacctacatttaatatctgcaacagtgctttaagggt

SEQ ID NO: 7793 - DNA, 1001 bp, artificial
  synthetic oligonucleotide
atatgttatgaaatttctgccagggtcatatttatgccattattctaataagaactttaataaggcaaatctagaaattggttttactggcttcataaatttgtctttcatagtctccaactcaattttcatttgctttgacttaaaatatatcagcattctgaaaattttgaagagtgaatcattaaattcaatatttattacttaatatcttaataataaatgttaaatctcttaatggactgtatttcaaatacagctcactaagtcctctcgttttcttttaaaaaccatacttcaatgtaattcccattgccacttttgccagacatcctatttccctggcaaatctattgaggaaaaatgaagttttaaagcaaggtctgtgcttggaaaatctaattcactctaactcactaggtcacttagaaccaaatgattcaaatagaattctacctatagcaaaacaatggaagctgtacatagggatgtgagtgaaagccttgctgcttttctcagatagggtgattggatgcaacagtggcccagcacttagccacaagtctgaagacccctgcctaggaccagcttcatggctctcggcaagctgtcaaactctgtgcctgagtgtcctcatctgtgactaccatgaagatcaaatgatacacataggtgaaagttctttggaatatgaaaaggatgtaaaaatgacaagaattcagacttagttaatagagcaaggcatttaaaagttggcatcacatgtttattttggctcaaactgtggcactgcatagtctgcatttgaattccagaactatccatgttgagctatgcaaccatggacatgtcacatagttttgtaggccccaattcccacagctgtgaaatcgtgaaaataacactatccacctcataaggttgttgtaaaggttgaataaagtaatgtctggcacaaaaaaagactcttaataaaggttagatgttactactgggataca

SEQ ID NO: 7794 - DNA, 1669 bp, artificial
  synthetic oligonucleotide
gagggtggggttgaatgtgtaaactgcagagacagagccacagaatagtccaggaacttgccccaggtcacacaatctctaaatggcagaatcactctcggaggtctttccaccacatgacctcctccttctaaaagtccattctttgtatgtcctgccatatccttgttttccataaaagcacaattatgatctattagctagtcaattaataatgataacccattgtattagtctattattgtattgctgtaaagaaatagctgagactgggtatttcagtccattttcacactgctataaagacattacctgagactgggtaatttataaaggaaagaggtttaattgactcacagtttcgcatgacaggggaggcccctgaaagttacaatcatggtggaaggagaaggggaagcaaggcatgtcttacatggtggcccggaggggagagagcaggggaactgccacacttgaaaaccatcagatcttgtgagaactccctcacaatcatgagagcagcatgggggaagccacccgcatgatccaatcaccccccaaccaggtccttcccttgacacttggggattacaattcaagatgagatttgagtggggacacagagccaaagcatatcacttggcgatttataaagaaaagaggtttaattggctcactgttctgcaggcggttcacacatggcttggcttctgggggaggcctcagggagcttttactcatggcagaaggcaaagcaagagcaggcacctcacgtggcaaaagaaggagcaagggagagaggggaggtgccacacacttaaacaaccagatctcatgagaactcattcactatggcaagtacagcaccaagccatgagggatctgcccccgtgacctaagtacctcgtgagatttggtgctttttgtcaaatatccaaactatatcacccaaagaaagctactctctaaaaaccttaaaataatgtccctttgctctaacacttaggacctctttctacattctagatgaacagaatttgaaagcattttacaatgagagcagggggtggtatagaagaaaaattaactgcacctggactcagacaatctgcattcatattctggttttgccctgcattacctgagtgacagtgaatgctaagcagtcagcccttctgggtctcagtgccttcatctgtgaaatgggaagtcagagtgcctgtctggcctatttctgaagattgctgcaagttttgtgtaagatcatatttgtgtaaggaattgctcagtgaaaagtaccaggcaaatggaagagtctgttgcttttcaaaagagaaacatttaaaaatcccggtatgccccatatttattcatttgtttatttggtaatgacatcaataatctgtgaatttactcaccttcaaaaaaaattcagccatgacagataaggctaatatcatctcaatatacccccagctccgcctgtcacttgcttaactacctactgctagtttgcttgatacaagcatttagtcaaagaaagaacatttgtattaaggcccagtgctagataggagacaagcaattggtgcacacatagttttgaatggaaggctgagctggtgaccccaggtaagcagaggcctctcacctccacaacagaaaacat

SEQ ID NO: 7795 - DNA, 910 bp, artificial
  synthetic oligonucleotide
cctcatggattctgcctagttaatttgcctgctttctctgacatgatttatttgttcactctccgtgcatgttgcttatttcaactggggttgctgtaacaaagtaccgtaaactagaaggcttataaacattaggaatttatttctcacagttccagaggctgagaagtcccagatcacagtgccagcagatttgatgtctagtgatgtcctcttacattcttagtatcttcttgcggcaatcctcatgtggcagaaaatgcagaaaagcaaggcagctctctgaagcctcttttatcggggtaccaatcccattcatgaaggaggagccctcatgacctaatcacctcccaagggcaacatcttctaataccatagtattgagggtgaggatttcaacatatgaatttgggggaatgtaaacattcagactatagtacatgtactattcccactgccaggaataccatcctattttccctgctaataatcgactctacctttgacaacagagcaaacaagttataatatgaactttgttagtcattgtcttttatctgctgctgggcttttcacctacctttgtatccagtacttaccaggatgtcctgaacccaggatgagctctcttaatgtctgcagaaggaaggaagacaagggaggagaagtgggcaatttagtcaaaccactggggaatcaaacaacttgttaataatcccaactatggagtttgtccatctagtcctagccctgaatagcatcccaattttttaaaaaatgaatttcaagtgagagaatgtcatgttcacattagtattgaatgagccacagcacgtccctgatttatttatgttgtgtgaaaatttaagtagtgatgtaagaacatatcactttggggacatttgctgtt

SEQ ID NO: 7796 - DNA, 1699 bp, artificial
  synthetic oligonucleotide
tgtgctaaacatcagtgatgatgtgtgatgggggaaaaactgcaaaggacaaacatttatcatgattggattagacactgccttggtgtggcttgcagattaggagagaaaatcatgcgtgtggcatgatattcacacaagcatctatagctcaaggtagaaactgctaggagaggtgtagattaactccagccagtgttgctggggatggcttcagaagcagaagattatatttgagaaaaatcagcagctcattctatacgtggacatcctgaatttgaaaactgatattttcttatatcaaatgacacaaataaaattgttactcctagatacactttaatcctgtttggcagggtcccacacacttgaaatatcagtgggatttgtaattgtaaagttgggggtatcattccaagagcaggaggtactacaaatggaggaactgttaataaaaacatggacaaagaggtagaaacttgtgcaaatttaaatcacataataagtgatattgtacagcagtccataatctattgataagtgggagggattttcctggctcctgtcgtctggaagggcctcacacaagtcttcaatagaacatatgaagagctgggagaaagcctctcactcctttgtgaggatggtaaaacatgttttaatgcagatacttccttgatctgcttatgatgacctttctgttgctgaaattatttgcagcttaatatggtgtaaatgtatttcactgcaggagtattggtgcagaaaagagttaacattgcagtactgaaactgtagtttcctgaagcgcctgcttacaagattggcctgtggctggcctctgggaatatggctttgaaaatgttccctaacggaaaaaatgtggctcactgtgcctcaattgtttgtacaaatgttgtgattcatgctgaatacctgctttctttcacaggatctggaatttttgtacatgctgggcagaaggtgcctatgtggctagtcccaaatgaaaagattcagtgctaattctataatgcgcttccatgagcagaacttctcatgagatggagagaacacaaggaagcccgcatatggattcctccagactctgcctatttcttttttccttattttcctatcataagccttagtcgtgagtgaactatatgttgaattccatgggtgttcctagtgattctccaaatgtgtgggtggtcttatggaccctgccaaacataattaaagtgtatctaggagtaactatcttctttgtgttatttgagagaagaaaataccagttttcaaattcaggatgtccaattatagaatgtgcagctgatttttcacaaacagaatcaagacctgcatttcctccttacattcattttctccttctcttttccatgtgtaattgcaagagaatggcccctgatttttatattgaactgcctagtaatgagcattcctccaacacactgaattctcagaaaagaagccctttcaggcttgtgaccatcttgtctctgttgtgattggcagtaatccaagtaaagacagtagtaaatatgttttctcctctcacaccaggtgatcctcagtgaatctgattgttgactcatttgctctctcactgtaacagatgttgcttttggagatggaaatcaatgttacaaagtattaacaaggggagaacttacaa

SEQ ID NO: 7797 - DNA, 7730 bp, artificial
  synthetic oligonucleotide
ctacaaagtagtatagccctctttcttcatttagatacgtttgataatcaggggatatatttgttataaaaattgattaggtggccagcaaagagtcttatatctatcttggtttataactttttacctataagttctgtgtaatatgcatgttttacctataagttctgtataatatgcatgttctactctggtatctgaaaatagcttataaaattagaactatcgaaacagacaagctggaataataatgacctgtgtgctggcatgcactttgccttctttgacagcacttggtaagtgctatataaatgttagcatttattgtttttacttaaacttttcacattaaatctgtgaggtaggcatggttagccccatttgccagtgaagcaaagtgaggaccaaggttatatagtttctctatggcaagtgtaacaaattaccaaaaactgggtaacttaaaataacagaaatttgtcacctcctagttttgaaggttagaagtccaaaatcaaggtgactgtggaactttccagaagcttttggagagaatctttccttgcctcttttagcttctggtagctgctggcagtctttggcttgtggcctcattgctccaatctgtgcctctatcttcacatcgatttcgtctctgtatgttttgtgtgtcttctattcttctccttgtgtctgtccccaaactccctctgcctctctcttataaggatatgggtgattatatttagggtctaccagataactcaggataaatgcatcctctcaagatccttaacttttttttttcatgtactttaagttctgggatacatgtgcagaacatgcaggtttgtcacataggtatacatgtgccatggtggtttgctgcacccatcaacctgtcatttacattaggtatttctcctgatgctctccctccccttgccccccacaccccaacaggcctgagtgtgtgatggccccctccctgtgtccatgtgttctcgttgttcaactcccacttatgagtgagaacatgcagtgtttggttttctcttcctttgttagtttgctgagaatgatggtttccagcttcatccatgtccctgcaaaggacatgaactcattcatttttatggctgcatagtattccatggtgtatatgtaccacattttctttatccaatctaacattaatgggcatttgggctggttccaagtctttcctattgtgaatagtgctgcaataaacatatgtgtgtatgtgtcattatagtagaatgatttataatcctttgggtatatacccagtaatgggattgctgggtcaaatggtatttctggttctagatccttgaggaatcgccacactgtcttccacaatggttgaactaatttacacacccaccaacagtgtaaaagcattcctatttctccacactctctccagcatctgttgtttccttactttttaatgattgccattctaactggtgtgagatggtatctcattgtggttttgatttgcatttctctaatgatcagtgatgattagctttttttcatgtttgttggctgcataaaggtcttcttctgaaaagtgtctgttcctatacttcgcccactttttgatggggttgtttttttttctcaaaacttgtttaagttccttgtagattctggatattagccctttgtcagatggatagattgcaaaatatttctctcattctgtaggttgcctgttcactctgatgatagtttcttgtgctgtgcagaagctttttagttgaattagatcccatttgtcaattttggcttctgttgccattgcttttggtgttttagtcataaagtctttgcccatgcctctgtcctgaatggtattgcctaggttttcttctagggtttttacggttttagttcttatatttcaatctttaatccatcttgagttgatttttgtatacagtttaaggaagggggaccagtttcagttttctgcatatggctagccagttttcccaacaccatttattaaatagggaatcctttccccattgcttgtttttctcatgtttgtcaaagttcagatggttgtagatgtgtggtgttatttctgaggcctctattctgttccattggttatatatctgttttggtaccagtaccatgctgttttagttactgtagccttgtagtatagtttgaagtcaggtagtgtgatgcctccagctttgttccttttgcttaggattgtcttggctatacgggctcttttttggttccatatgaaatttaaagtagttttttctaattctgtgaagaaagtcaatggtagcttgatgggaatagcattgaatctataaattactttgggcagtatggccattttcaggatattaattcttcctatccatgagcatggaatatttttccatttgtgtcctctcttatttctttgagcagtggtttatagttctccttgagtaggtccttcacatcccttgtaagttgtattcctaggtattttattctttttgtagaattgtgaatgggaattcactcatgatttggctctctgtttgtcgattattgatgtatagaaatgcttgtgattttcacacatcgattttgtatcctgagactttgttgaagttgcttatcaacttaagaagattttgggctgagatgatagggttttctaaatatgaagccatgtcatttgcaaacagagataatttgacttcctctcttcctatttggatacactttatttctttctcttgcctgattgccctggccagaaattccaacactatgttgaataggagtggtgagagagggcatccttgtcttgtgccaattttcaaagggaatgcttccagcttttgcccattcagtatgatattgtctgtggttttgtcataaatagctcttattatcttgaggtatgttccattaatacctagtttattgagtgtttttagcatgaagcagtgttgaattttatcaaaggccttttctgcatctatggagataaccatgtggtttttgtcattggttctgtttatgtgatggatcctgtttattgttttgcgtgtgttgaactagccttgcatcccagggatgaagccgacttgatcgtggtggataagctttttgatgtgctgctggattcggtttgccagcattttattgaggatttttgcatcgatgttcgtgagggatattggcctgaaattttctttttttgttgtgtctctgccaggtttttgaatcaggatgatgacggtgtcatagaatgagttagggaggagtccttttttttctgttgtttggaatgatttcagaaggaatggtaccagctcctctttgtacctctggtggaattgggctgtgaatctgtctggtcctgggctttttattttttaattttttggttggtagtctattaattactgtctcaatttcagaatttgttattggtctattcagggattcagtttcttcctggtttatgtgtccaggaacttattcatttcttctagattttctagtttatttgcgtagagggttttatagtattctctgatgatagtttttatttcagtgggatcagtggtgatctcccctttatcgttttttattgtgttgatttgattcttctctcttttcttctttattagtctggctagtgatctatctattttgttaatcttttcaaaaaaccagctcctgaattcatttatttttttgaagggtttttcgtgtctctatctctttcaattctgctctgatcttagttatttcttgtcttctgctagcttttgaatttgtttgctcttgcctctctagtttttttaattgtgatgtcaattttagatcttcctcactttctcctgtgggcatttagtgctataaatttccctctaaacactgctttagctgtgtcccagagattctggtacattgtgtctttgttctcattggtttcaaaaaacttacttatttctgccttgatattgttatttacccagtcatcattcaggagcaggttgttcagtttccatgtagttgtgcggttttcagtgagtttcttaatcctgagttctaatttgattgcactgtggtctgagagtctgtttgttatgattttcattcttttgcatttgctgaggagtgttttacttctatttatgtggtcgattttagaataagtgctttgtggtgctgacaaaaatgtatgttctgttgatttgaggtagagagttctgtagatgtcaattaggtccacttggtccagagttgagtttaagtcctgaatatccttgttaattctctgtctcattgatctgtctaatattgacagtggggtgttaaagcgtcccactattattgtgtgggagtctaagtctctttgtaggtctctaagaacttgctttatgaatctgggtgctcctgtattgggtgcatatatatttaggatagttagctcttcttgttgcattttttttgctttcaatttgcttgataaatattccttcatccctttattttgagcctatgtgtgtctttgcacgtgagatgggcctcctgaatacagcacaccaatgcgtcttggctctttatccagtttgtcaatctgtgtcttttaattggggcatttagcccgtttacatttaaggttaatattgttatatgtgaatttgatcctgtcgttacgattctagctggttattttgcctattggttggtgcagtttcttcatagtgttgatggtctttacattttggtttgtttttgcagtggctgctaccagtttttcctttccatatttagtgcttccttcaggagctcttgtaaggcaggcctggtggtgacaaaatccctcagcatttgcttgtctgtaaagcattttatttctccttcacttatgaagcttagtttggctggatatgaaattctgggttgaaaatccttttctttaagaatgttgaatattggcccccactctcttctggcttttagggtttctgcagagagatctgctgttaatcgaataggcttccctttgtgggtaacccaacctttctctctggctgcccttaacattttttccttcatttcaaccttggtgaatctgatgattatgtatcttggggttgctcttctcaaggagtatcttagcagtgttctctgtatttcctgaatttgaatgttggcctgtctttgtaggttggggaggttctcctggataatatcctgaagtgtgttttccaacttggttccattctctcctgcactttcaggtacatcaatcaaacgtccgtttggtcttttcacatagttccatatttcttggaggctttgttcattacttttcattattttttctctaatcttgtcttcatgctttatttcattaagttgatcttcagtctctgatatcttttcttcagctttatcaatttggctattgatacttgtgaatgcttcacaaagttctcttgctgtgtttttcagctccataaggtcatttatgttcttctctaaaccggttattctagttagcaattcctctaaccttttttcaaggttcttagcttccttgcattaggttagaacatgctcctttagctcggaggagtttgttattacccagcttctgacgcctacttctgtcagttcgtcaaacttattctttgtccagttttgttcccttgctggcgaggagttgtgatcctttggaagagaagaggcattctggtttttggaattttcagccattttgcactggtttttcctcattcttcatggatttatctaccttcagtctttgctgttggtgaacttcggatggagtttttgcatggtcatcctttttgtggatgttgatgctattgctttctgtttgttagttttcttctaacaggcccctcttctgaagatctgctggagtttgctggggttttccgccagactctgtttgcctgggtatcaccagcggaggcttcagaacagcaaagattgctgcccgttccttcctctggaagcttcgtcccagaagggcacccgccagattccagctggagctctcctgtatgaggtgtctgtcaactcctgctgggaggtgtcagggacccacttgaggaggcagtctgtcccttagcagagctctaacgctgtgctgggagatccactgctctcttcagagcctgcaggcaggaacgtttaagtctgctgaagctgcgcccacagctgccccttctcccagttgctctgtcccagggagatgggagttttatatataaacccctgattggggcttttgcctttcttttagagatcccctgcccagagaggaggaatgtaaataggcagtctgactataccggctttgtggtgctatggtgggctctgcccagtccaaactttgtggtggctttgtttacactgtgagaggaaaactgcctactcagtcctcagtaatggcatcccaggtcgacttcagactgctgtgctggggcagtgagaatttcaagccagtggatcttagcttgctgagatccatgggggtgggatccactgagcaagaccacttggctccctggcttcagccttctttccaggggagtgaatggttctgtctcgctggcattccaggtgccactgggatatgaagaaaaagctcctgcagctagctcggtgtctgcccagatggccacccagttttgtgcttgaaacccagggcccttgtggtgtaggcacccgagggaatctcctggtctgtgggttgcaaagaccatgggaaaagcatagtatctgggctggatagcaccgcccctcacagcttcctttagttaggggagggagttccctgaccccttgcacttccaggatgaggcgacgccccatcctgcttctgctcgccatccttgggctgcacccactgtctaaccagtcccaatgagatgaactgggtacctcagttggaaatgcagaaatcacctgccttctgcattggtctcgctgggagctgcagaccagagctgttcctatttggacatcttgcctggggagtctttaagatcctcaatcacattttttccatataaagtaatataagttaatgttcacagattccagggatttgacgtggacatatcttttgggaaccattttctgatcttccacaaaggatatccaaccaataagtgacagagctgagatgattaactgaaatttaggtatcttgatagacaagcctgtgttcttctaatcctgtagcaaactacccctatctctgctctagaataaatttggagaccagtcaatgttacgtctacattttggaagttaggaactgagtccccaaaaggagagatgttttgatatctggttaagaaatattaataacaaacaaaaagacaaatcagattcacagttaatatagcaggatggtttttcccatttctctttaaggaattaaggattttgcttggtatattttattttaaagacttctggatattgtttggattaaactaagctaaaaataatattttattttattatgcattttagtgagcttattatcagtaatatgtttagcataaaatttattagtgacatgccctttaatttagcctaattggtactaatttagttagattgcattaaattacaccatttaatgtagttatacgtgggtcaagaaatttatttca

SEQ ID NO: 7798 - DNA, 1751 bp, artificial
  synthetic oligonucleotide
actatgaaccttgactcataataatatgtagtttggttggggtggggggagaatcaaatttcccattgtcttagtctacttggactgctataacaaatactataaacaacatggcttataaacaatagaaatttacttcccatagttttggagcctgagaagtttgagatcaatgcaccagcataaagggtatcttgtgagggaccatttcctcatagaaagctgttttcttactctaatcccacatggtagaaggggtgaggggtctctctcaggcctcctcttataagggcagtaatcccattcatgagggctcaactctcatgtcatgatcccctccccaaatacccatgtcctaatactatcaccttgggggtgaggattttagcatattaattttggagtaatacaaacagattataggacccataataaataaataacagtaaaagttaatgagatcaccattaagttctctaagtttgtaaatacagaccaggtcaatacctgggatacgaaaacaactgtgatttcagtgaaaaaataaatctctagatggcttgtttcccacattttaactagttcaaacactgtatagtatcagctaaagacattattttacacaatattcagtcaccactgactaggatggacgagggaatctaagcagccatgattggacatgaaatgttgagtggattgctatggccagtcagcccaagacctcactatttgcaggtcatcaggcacctgtatattaaagacaaacaagggcatccaggaagagccggaataagatattacatgatggtagtttgaagttcagaagccagggccctgcaattcattcagcactgtcttcattttttattaatgctaactgaaggaggggtttggagaaaccaatttcctcatattaactattgtagattttctaatatccatttgtccaagagagtatcaagggagtattatttctctcacaacttctttcatacctaataatagaaaatggaagtcgatttttttgtgtaataggcacatacttggaatttttcaaaatgaaataatttatgacattcaagtggcctaatggcacacttgaagtgaattgctcaccttttggaagatcatgaataattgcataaaaaaactgggaatgactcccaaatagactgaggatttgagaaagtaagtggcatttctacgttcttggtgcagtgcagtagcaaagccccaaagccctgaccccatcactggtccatttatttgcttttctagactgatctgtgccttctaattcaaagttcaatttcaacaaccaagaattctcaattttaagaagcaagaaaaaacaagagaaggggataataaaaccataatcccgatttaaggaccgaattatatgaaaacacaaaaatcaaaatcatctttgatgctgtatgttttagcttttccattaatcacattttgaattgccctcccccttgttattctaggaaacaatagatctaatcctccctgctttcactcctgcctcacttcatccccattaaaaagtcaataagattcacacacatacacatacacacacacacacacacacacacacacactcacatgcatttaggaaatcaacacaagtttccaaacttgaaaaaaatataaaaatagattttcctatgtaaaattatcttactcctaaagcaagagtattaggctcccactgtgaaatatgctgctttccatat

SEQ ID NO: 7799 - DNA, 1134 bp, artificial
  synthetic oligonucleotide
cccttgtattttaagcatgcccagttcagacatttaaaatcgagcaatttataatgtgttagcagtcagaactccatcatgttttaaataaatttatttttctacttcttgtgagactctaagtcactctaagaagactcatgacatttcactgtacaaggcaggtcacaaattgaataatgtgaaataactttattagagaactgaagaaaatgatatggcaataatgtgttttacagtaaaatttgatagccctctaaagatcaatgagtgtgtttgtttactttgaagtgaaaggacaaaggcttcataatggaattcagagaaatgcctgaattaaaggcatcattgccagataaaatggctttcctagtctgtggtgaattcagaaaacctaccacgtactttgcagtagaaagaatagcctaggtactgtctgtgataatatgtcattataaagctgccctagaatgaatgaaagtcctcttgtggccacacagaataaaacaagctgcaagtcacaaggttcttgtcctgtcccaaacattgattgaaagggcactttataaagggagaaagaaacagcgggggcaccctcatttgcatcaccaaaccctaatgatggaggcgcttttatggacacactgtgtacacagaataggttcaattaaaaagaagccattttacactggcctttaccccaccaggattttttcttaaagacaaaacaaagaccatttatctgggtaacaatacattactttaaaaaatgaggcagagtgtagaacatagggtaggcaagaggcgtgggtctcccatggttttatctttgccacttcttttcttagccagtgcactgtagatgtcatgaaagcatatctttgtcaaaataaggtaaatatgaatgacgattggagtaggcaggaatcttgtagctgaccctgactaggaagagcaagattcagaacttcacttgagtttaaaatgaagttccattagcagggaccaaaatgaattgctgtctgataattctggcctcgataaaacgagttgggcatttgagttcaatgcctatggacagatgttccacagacaaaaaacgaggctcttaattggcactaattagcacccttg

SEQ ID NO: 7800 - DNA, 1700 bp, artificial
  synthetic oligonucleotide
cctggtttgtggttgatcaccagtcagctttcaaaataaaatagctgggtgttttaaagaaaacattttttctgtccaggttatctgtactcatcagcttctgtccaccatcaaagtaaaatggccataaccgatcttatccagatgggggtttaggcagttgatggactcactcatgtgacctttacttccgtgaatgcagttttgtttggcctccattccgcttttgacagtttcaagagctggattagtaaatcttcaaggtcttctacacccatatgattctatgatactgcgattctgccacgttgctatgaaattgttattagaaggccatttaccccttaaacctgggtattcaaagaactagaaacctaaatgatgatgacagatatcttacttaaatttcatataagaattaattccaagtcaattcaacgtagcatagtagtaaaagatcatacagcctttgtgattggaaagagtctcattcgaaccttgatgcaagttgcttaacgcctctacacctcagttgctcacctgtaaagtgaaggtaataacagcatgtgcaccatacttgtattataaggatgaagtgaggtttcatgaaaagtagttagcatattacctgacacacagtatgtctcataaaagtagctatcaccatcaccatcaccatcatcatcatcatcattgttattaactgaagaatcatagataaacatgcattttcaattgtcattgaaaggcggagagaaggctgcaaataattttatgaaagcatatgtttaaagattttaggactagctcttcaatgggtttgtctgaatatacatatatggatgggtgattggttgaaatagagcataatttttcaaagtgtgtttaggcaaaacaaaaacaaccgaaaagcctaattttttttttctagccatttactggctgtgataccttggacaaagtcatggcacacattaagaactcaacaaacaaagttttattggtattatcattattttacatatatatatatacacacacacacacataatggtgacaaaagaaccatgttggacaaaaaatatttatatgcatgatgtcctaataactttgttaggtcttacactcaagcgttagactcagaagagagaggaacataacatattttgaaattaggtttatataagactttctctttataagctacagattgttgataggctaacaataagcttaaacttgtgtcatttgaaactacacacacacacacacacacacatatatatgaatctgtgcattcttatacaattctatgcccaaatttcatattcctatcatccttttctatatcagtagctcattttcagaggtaatgttattagtgctcttcactctcatggacaaattaagtccaaatcaacacataccagaccttcctgaagctctcagcggacacccaacttcgtgatccttggtttcgtgtgaaattgcctcctcctaaaggccagacgggaaatcaggacttggaataagcacagctctccagctctgctcctgccttggcaattttgatatttcacaagaattgctgtgttttttataagaatgataaaaaggcagatataaaggcaaatatcaagaagacttctggctgacaaaagcagaatttggagagaaatgtgaaaatagtgacttacttc

SEQ ID NO: 7801 - DNA, 911 bp, artificial
  synthetic oligonucleotide
tgggacagctcagtcttaatagcagtggagtaggggcccaaaaaccgttgacctggtgctgaagctgcccttggcttacagggtaagctaagagggccccttcctctatctgggcttgttctttatcgctaaaatgaaggggttggacccaatgccctcgaagtcccactgaagagatgtctcttatagagagtgagttcgaatcccagttctgtgtcagctgtgaagttagctaacttgcctgagcatcagtttctcctctgatttccaaataccccttaccagcccaagcccacacccctcagtgatgggaagggaaactagatgactgtggacatagaccgctttataactccaagctgctttttcagtttttcatcatttcaaaattcctgcatctctgatcaaaataatttcttcaagaataaaacagtctctactgccactttataaatatctagaaaacgtactccaaaagcaacgggacaatgaactctactttgaaatcataaaaacattcagtgcgagggaacagatccattgaaaactacacattaactcaattacttcactgaaaggaagcactgtttaaaatgttgaattaggtcttactcttatattgacgaacaaaagagaaagagtgcttctctcttaagagaaaaaataagttcagaaaataaaaataaccggagaaaggcccagctctgttttccctgagcacagagtaaagtaagggcaagggcaggtaagcagctattaaagaatcactggggaaaaaagcgtttttttaaaaaaaattctgaaacgcaagaactcaaacacaacctaagcttgggaagttgcatgaaaagcctcctgaaatgattcttaagcagattttgcatgaagaaagcacattccctttggtaggc

SEQ ID NO: 7802 - DNA, 1549 bp, artificial
  synthetic oligonucleotide
aagatcaggcattggattggcagagctatttatctatgtatttatttatttgagacagggtctcattctgttgcccaggctgcagtgcagtggcacaataacagctcactgcaacctccacctcccgggatcaagtgatcttcctgtcagaggtgtttgaaccagagcagctctatcttgaataggggctaggtgaaataaggctgagacctactgggttgcattcccaggaggttaaggcatcttagtcacaggatgagatagcagttcggcaaaagatacagatcacaaagaccttgctgataaaagagtttgcagtaaagaagctggccaaatcctgcaaaaccaagatggcaacggaagtgacctctggtggtcctgacttctcattatacactaattataatgcattagcatgctaaaggacattcccatcagcaccatgatagtttacaaatgcaatggcaacctctgcaagttaccctatatggtcttaaaaggggaagaaccctcagttccaggaagtgcccacccctttcccagaaaactcatgaataatctaccccttgtttagcacacaatcaagaaataaccataaaaatggccatccagcagctcatgctactgctctgcctatggagtagccattcttttattcctttactttcttaataaatttgctttcactttattctatggatttgcctgaattctttcttgcatgatatccaagaaccctctcttggagtctggatcaggatacctttccaataacactcccacctcagcctccagagtagctgggactacaggtgcgaggcatcatgtccagataatttttgtatttttagtaaagataggatttcaccatgttgcccaggctggtctctaactcctgcgctcaagtgatccattcacctcggcctcccaaagtgctgggattacaggcatgaccactgtgcctggccgattggtagagttttaaaatcagttcactttaagacaggtccagccccaccctaactcctaccccttgcctctgaggtacagacactggttcagaagggaagtagaacatcccagaggagtgagtcccctgggcttttggcaggattttaaatgaggttctcactgcctgaattaagtgagacatgtaagaggaagaaagccccgctttcttcctcgtaaaatgaagttggtcatatccaccttctccctgctacccagagatgagcaagatgttatctagactggtgtttcccatcctacattctctcttggaaaccctgaggttttccaaataatttcttctgacacactgtcattaccaaggccaagagacttaatcctctgagggtgtaagagtagtgaggcaacttcaaggttgcctgtctagcaggggatatgccacaagtggcacagtgtatcacacagagggctaggaatacactgaggctcatgctttggggaaagaatatgtttagttttgtgagtttctccaggaaacacattttagcttaggtgggagattttgtttcaaccccttttt

SEQ ID NO: 7803 - DNA, 1346 bp, artificial
  synthetic oligonucleotide
aatgtggttaaggactatttctatacctacttatgaattgcctgctcatgtctttttcatatttttctattagatttgggtccattgtccaaaaatttgtcagtctttaaaattaaggatattagccctctaagctacacatatttgcagacctctacattacaattttcccccaatttgtcagttgtcttctgatttatttcatgttgtgttttgcttttccttctaaaattttaagaaatgtaatgcattttgagtgagaaggcaatcagtggacaccaggaagtaagtgcttcacaggacaccctgggaagccccactatgccaaataggtgtgtgctcaggtgaggaccacaaactggctcaatttgctagtcaattaggaacctaagggctggggtaaaccccaccatgcctttcctccaggtccataaacccaaatgagagatcctacttggggagctatatggacaggacttgatcacatagtgtctccttcaggaagctggaagcttgttataactagagccaacttcgtaagcatgcaacctatatactcgcacagggcctgaagcttagaagggctccgtgtacttgatttaatgctctactgtaggagtcttgaattttgtaataatttttgaacagaagtcatattttcattttacacttgccttgaaaattatgtaattggtttcttccccaccctcaggcttctagaatcggtatttctgtggtgagtgctagacctagaagtaaaaaggcttcagtctcattgctctactacttcccagctgcaaataattctgtgactttttcctcctatttcacatgggaaacacataaagacatagaaaacaaatatgttcctcaggatactccccccaggaggtcctcatgctggcctgttgcgacttccaatctggcatgcatgcaaaaccaagacaccagctgttggagtctcctgtctccatcaggaaaactcatatggaacttgttctttcactttccagttgaacttataccttgaaaccacaggcagcctggcaagtaggcaatatggactgactcccgggagttgaaatccttgaatacttttcacttctaagttctgaaatgaggccatgatctgctggagtattgtggtatcctttgcctctgagtcagaagaaaggaactggcaaaggctttgtaggttgtcaggacatcaaaagttccttatgacctttttgtaattgtaaaggattcagcaagatttggatgagattttgcctcaagcacttacagattctaccatgaggaaaaagtgatcagcaaaatatgttggtcagatatcaaaagcagca

SEQ ID NO: 7804 - DNA, 1479 bp, artificial
  synthetic oligonucleotide
ttcatggcaatcctatgaggtcagttttacttttaacctatgataaggatgaggaaactgaggctcagagatgttacactgtttacctaagttcacacagctagtaggtggtgagtttggtatttgaacccatgtaatctggctctagagcattcattttcaagagagttcatatcactaccaagaggacaataatttattttttgcaggatgaaaaattattactcttatatataagacccaaatatacatacagtacctaaatagtatattagtcaatttctccagagaaacagaactaataggatatgtgtatatatttatacaaagatatagatattataaggaattggctcacgtgattatggagactggcaagtccaaaatcggcagggtgggctggcagcctggaaatccaggagagtcaatgttccagttcaagtctgaaagccatctgctatagaacaagaaagcactgatgttgcaaatgaaatctaaagataatttgctggggaattctctcttgcttggaggaggcttggtccttttgttttattcatcctttgaactgattcgatgaagcctacccatatcataaagggtaatctgatttactcaaagttcactgattttaaatgttaaatccatccaaaaacaccttacagaggcacctaaaataatgtttgaccaaaatatctgggaacgttagggcccaaccactataacacgtaaaactaaccttcacaaatagatgtacagtatatctgtggtattaacatctcatggggaaagaaaattggattttttttttaagtttgaaaggctccttgagtggagggtgtatgggcaataatgaaaaaagagattgagaaacactgtgctagagtgtgccttcaatcatcacagtttaggacagccaatcagctaaagaaaccacataggtggacaagtggcttagctattataactggctaactaatacttattgccagcatgtaatgtgcagatactatggttagatttttacatacatgtgcagggagtatgggagtatggctaaccactgtcatggttccagcttgctctatttagctccttcctccccctccaggggtagaggctcttacaggtgtaggggctacctctactacccaaattccccttctttgagatcaaggtgtcatgggcattatgggctggtgtccactgagataataaggcaaggacagaacaaagcatgactgggcatctctcctgctggagttcagaaccccacccttaatgtacagataggggtggtgaagaggttataggctctaggtgggaagttcatgggcaagcaagactgtgacttgtgggccctttaagacaacttcactgatatcagatcccaggattttagggcccaccccaaaagcgttctcacttgtgcctcactggggagctgttaaaatttcccattcccaggtcacacactta

SEQ ID NO: 7805 - DNA, 308 bp, artificial
  synthetic oligonucleotide
agggactaaaggaacttgacctcaaagaagctgctggacctagtcaacctgaactaaccagcaggagtcaggagaatgtgcatgggactgaattcagaaggtactggatcaaaaggaagtcagaatattaaactggataaaaggtatttatatgagagcaccaatagacacaagatttaacactctggcaaggaccccgggagatgatacgaaaatgctgcctaagatgatgcttagaaatatggaaaaaaacagtagtctgcaccaattaaggtagaaatgccagaattgagacaggcagtagcaaa

SEQ ID NO: 7806 - DNA, 1562 bp, artificial
  synthetic oligonucleotide
tttctcattaattattattcgaaatgaaatgtaatgccactagctgtagtatgccagaagtataagaaggaaatatatcgtcatgtatttaaaaatccttacagagtataaaaataattaagaaattatgacactactgatcttttagaagcaatgtagccacctgttcattcctttattaatcaccaattttcttcctctttaacactgcacattaaagattattaaagggaagaatacaaaaatagaggtagggagagataatttatattatgtagcaaaagtatattaaaacgtatcagtttaattaagactttcactaggagagaaagtcatatttttggtctggtttataacaacatataattcgacttaaaagaatagcaatgcatattaataattattattgttggtattattaatttgctctaaaattagctgtaagtgattcttttttctcctttgagcagcaagcaatccctatcataaaactgtgtttactgggtggttgagagagatgcattcagtcagggctgtaaataggaggacggtagtgagattctcagggggaatgatggggtagggtgctgcctgtgcgggaaagcttggtccatatgtcccaatcagctgagtttctgccttagaaactggtgtgtgaccctcatagctaccgggcagacattgatgccacagggggcagcaacaaaggcccgtttaaagacgctggaaaggaaagtggaagttagagtcacaaatcgctattcaagttctaaacgggcaatttttttttatcatgtaaccctgagccagtcagattcaattactttttttttttctttcaaaatctttccaggctttattaaaaatatcccaaaggtcttgattgttatttttaaaactatgaatttggaaactgcttgttaacaaaataaagcaatcaacataatcatttattctggtaataattatcatataaacattaaattgttttattggttgaattgtgagaactctagctatcactgcttattcacaaacttgatttttaattttatttttaaagttaacataaagtaaaattgacttttgggggtgtatagtcctatgaattttaacacgtgtatatttgtgtaactaccaacacaataaagaaacagaataaatccatcaccccataaaacttccccctgctattcctttatagtaacaactctcctacccctttacagtggcactctctcccacccttccctggcaaccaccgatctgttctccatcactataattttgtcttttcaaaaatgtcacataagtggaatcgtacagtataccaccttttgaaactgtcttctttcactcagcatgcctttgagattcatccaagttactgtgcttagctaaagttctcccctttaatggttgtgtggtattccattgcataaatgtaccacaatttgtttaaccaatcatttacccattgaagaacatttgggttgtttccaggttttggtgattataaatatatctgctatgatctgtgattatgcgtaggcttttgtgtg

SEQ ID NO: 7807 - DNA, 1585 bp, artificial
  synthetic oligonucleotide
gagctcaggggttattcttggcagcagcagagaaaactgatattcctgtgctgaggtgagagtgctgcctcactctcctgttggcaccaggtcagaatccagggtatggagagaagcctttagctccaagaaaactcaggaggtagacctaactgtgagatatttaccctgagttgcctttaggaaccctggagtccaggtacaggtatataaaggaagagaagcccaatcttcaagccaaatccctaggaaggcttcatcaaaagaggatctccccccatgctcctagccccatctacaagaggggtctccaaaggctgaacattgcttgtgggtagcaaggaatagagtagtgaagagtgattccttcttgggacaatggccacactcccctatagtttctgccataaatcaaatttagaggcccaaggaattcatcacactacaacaaagcaatagcctaaacaaacgcactgatgatgacgagtacagaaatttccacaggctagtaaggagctctgatatgtgtcttgagggtacataaagaacagactgaactggatggtaggtcccagaccatggtgttccttgaaggtctttttgaaaggtttgggctttatcctgaaggcagtttgaggagtagggggtgtaatccatgaaagagtttaggcagggaggtgacataatcagcttttgatctgcagtcactttggtggcaatgtggaaaacagactggatggaagcaagatttaggtacagaggaacaaagaagagattgcgaaggtttcactggcaccatatatatggagggaacctgggaaaagtggatcatcaagagatgcttaagggatagacttaatagaaccaggacagtggcaagggaatgtagagcaggactagatttcaaacagatgatgggaaatcgtggaagatgggtcggagttgaaggaagatttgaaggaaagaggcaagagttgagtcagaggtgactcaagctttacaaagagccaggaacagaaaagataaacaaaaggtcctcagggaagtgttggtgtggttggagggctttggggacaacaggagtgcagaagcctgtcttgaccagttaaactgggggtctcagctgtcagcctagtgtaaatgcccagcaggcagttgggaagagaggtcagcactggaaagagcaacctgaatttgacagcatgagatgactcagcccacaagccgggccagtgctatgtcactgatccagaacacaggctcagacaaattggacaatcctagcctgcaacttggcacaaggcacatgccatgctgcctcccagcaacaggttctcacaatctaaaatccacctcctatatgtatggcttgaaggagatgcatttaacttagatttggaatataaaatgtgtatacaaccatttattccattagtacatttactttccacctcagaactaaatgcctctactaattaaatacatttattttaacttcagaagcatttatttccaaaataaggacacgttaattatctgcaaagtgaaattaaccccaggatgctaatctatatattcatctgcc

SEQ ID NO: 7808 - DNA, 942 bp, artificial
  synthetic oligonucleotide
tgccctcggagaagaacgtttcttgtgagcccctgccctgcctccctttcttgagtattttggttccttctaatgctaatttttcaactgctctctctagagttaattccaaactcctaaagttaaaaggaaaacaggttctcctggtggagagatgcagctgttctattatttgtcttcattcaaaaaatagctatcccccagcccattaccatatccatgcatttctactatgctgcacagctaatgactacattaagcatttggaaggtctgcattattgtattactgatagctcagtggctgaatacaattatactatggattgcttaggctgttggggtgatgggaagaaataaactttctggaggggcagtgtagattcagtgttaccacggtggtggggtgccaccggaactgccagatctacatccctattattgaaagcgaaaaccaaagatgagattttagaaatactgcttccatgttggggctacacgcattatcacttacacactatagaggaagttcagctgtctttgttttttagtagatatggggttgtgtggttttaatgatgcaaagaaatggaggaattatggattttcctaaaatgtaacagcttcagcagtcgaaggctgtcccaaggtcatttcactgatcaggaaaaaatctaggttatcatgaacaattagcagacgacaagaaattgagattagcattaaaattagaaattctaaattgggaactgatggccagcaaggcctcacttccccagttttgccgtatccctagaaccaagttcagggtccacagctttaggattttgtgtgtttgcttattttaacagcttcattgagatataatttacatactatgaaatttattaattttaaatgtacaattcaattgtttttattaaattcacagttgtgcaaccat

SEQ ID NO: 7809 - DNA, 1719 bp, artificial
  synthetic oligonucleotide
aaaaagtgaaaaatggaacattacctccagttactgtacagatctcttcctctgagaccccttcccaacaggcaggtctaagagcctatttgttctctgtgagaacatgtgacacatattaccgcccacattggaatagaactctgtgctcagcttcagttctgaccacttcccagctctgagtgccctcagggcaccagggtacctccttgctacctcaccggagtcaccctttctgtgaagggaggccagattttacggataaaaacacaggactcccaattaaatttgaatttgagataaacaatgaataattatgtcgtataaatatgatccatgtactacgtgggacatacttatattaagcaattatttattgttcatctgaaattcatatttaactgggcatcctgcattttatccagcagctgtattcctgcggcccacgtggtggttggcacctgccgccaatactgcttgatagagaaaatagcataatattttgcaatagtatttggggatgaatactataggctgcaagggtaacatttgtgcatttgtgtcgtttttggaagacgtttccatcatgtataaagcctgtgcctcgtggattgcaaatgagacccagttccggggggggtgggaatgagaaagcagttagaaaagaaccccaggggatctgagacccgagcttcatctgccgagtattttattctcgttaattcataacagtgtctttaaaatcctggactagaatttgagaacagtcagtgtgtgcgacagtcattactccttggagactcccactccgccagccgggcgcccttcgtgcgttcttggtgccacagcggcctccagtggttctctgaggaaccacacgctgtctccaccgccaggctccagcttgtccctaaagccagggcggaaggcggcggcgccctgtggctgcccaggggcctgggctgtgtggccggatcagagctgtaaggcacaaatccaagtgcgcgccgccgtggaaacaaagcccttccctgttgctgtgaagctcagaccagacagggttctatttcatcttccacgccaacgtgtaacgtatctgctgacccaattttacagatgttctcttcaaaacggactcggctttgtgaatatttttctctatcaagctgtggtgatagaaatgtcaaaaagcaggttggggggggcttgaaatagaatgagacactgttctgctcagaattgattcttattctatcaattggttggactggaatgaatagtgggaaaggtaaaaccactggaattaggaccccctacccctgcccagtgcctcttaccgccaacctagcaacagcctcgcttcatttcctagaaagggcggcaccagcgatccattattgaaaacacgcgactcccataaccttgttcattttcatatgtgtagctcagggcaagaggttctctgctacggcttccctttgatttgaaagcaatacaaagaataaaggaaaatcaaaactgtggccatagcaaggctgacgcttgatccttccacacacatgtgtgccccccagttactacaaaggcaattttccaaacgggtggtcgccagccttcttcctttcacaaagtgattttctggcggtttcatagctttgaggtggctcctttgcacatcatttcagctgaaatctactccctggatcgggagacccaaga

SEQ ID NO: 7810 - DNA, 1667 bp, artificial
  synthetic oligonucleotide
gcaacaggacacagacacagattccagaggctttagacaaaatggtactaggccactgctgggtacataagaggtgctcactacacttgctgaatgaacaaaacaaagcaaggcccactgaggtggtccagaacaatgtgctgaaggatccagaggactgtgtggatgtgagaggaattcaggggcatcaagcagacatgggggcagggagcagaggaggaggaggtgttgaggaacccaagggtgactccaggtttcacattcagctggtggcataattcgctggcatttgggggcagggggcgcaagaggaggaggaggaaggagaaaaggcagggcaggggtggtggcctgaccacgcggaagcctatggagctgaggtctccagggtcatctgcctaggaatggctctcacaggcaggtcaacacacatatctgaaaatcaggagagacctgggctgaaggggtagttctggagtcatctgccaaggctcaactgagcccagcaggggaagaagaggtggaaaggatatagtggggggcctgggaagtggcacctaagtggcagacacagaaaggattgggaggccaacagtcccagaaggggtggagctggccaacagtgaggaagtgacacagagctcaaggaaggtcaggacctacacagatagattttactggccaccaaggtcagtgctgaggtgagagtttagtggattggggaggtggaagcctgtgtagaggatggtgaagaacaaatggacaatgaggccacagacacagccagaacagcccagtgtgcactcgctctgccttggaggtcagttgaaggagtggaaagcagaaacaggcaggggcaagggggctggcacttttgcagctgggagggatgagagtggatggagaggctgcagggtaggtaggtgagaaggaagatcttgctcattctgcttgcagacgtgggaagcagggacagtggtggggagttgagggaagaggcctcgagcccagaacatgcatacacaaaattccaggtctcagtgacagagattattaatagagcccattcagcaagtacacactaggtggcatctgatcctgtgaacggcacattaaggactccaagactcagaaaggttaacttgcccagagtcacacagctgataaggggcacagccaggatgcgtacccacatccaccctgtccgatcccctacctctggctgtccaccagcttccatttctacaagaggaaaggtgctatccactgagaaatggggcacaggggtggcaaaggcctggaggggagcagtgaaagggagtagagaagaggtcatgcaaacggagcagctgcagaggacaagtgaggtgagctgagcagagagcttgcctgggctgctggggctggaggcggggcatctgagggcctccctgcttcgtgggggcatggattttctccagcagctttcaggacttggactacagagcagagggtgtggctggagtgtctgacgataaaggtactgcaggaggggcaaggataaatggacaagtatggtgagctgggcggctgggaagtacagtaagtcacctgccaccaggccttagctatttagggaagcaacaaagccaacaggacctggacacaagggggagatagaaatccat

SEQ ID NO: 7811 - DNA, 1879 bp, artificial
  synthetic oligonucleotide
ggtggggccctgagctggactccacccaacactgccacctccccagcctgtgtcctccctaccacccgaggagctgaaagacccaacagcacaccctcagtggtttctgaaaggaagcaaagctctttctaccctttttcactttgggtgaaaacgtggctgggttgacaagtcagttttttagaaaggaagcactgactagcgagggactcgcccagccagaagagggctctgcaaagacagccccatccccaggatgggaatgctggattcagacaccacaaaccaagagaacccagactctggacatggagcagtaccagggtgaaagacttttcccaccgacatggtcacatagccattctccttgaagtactgggggatggtggagaagtttccagcgtgcaccctccagtaggagttgaagtcgtacaggcgggtggtgtcaggtctcctgccagtgaggaaagaaacgcggctcggggcgcacactgcttgctgttagggagcagaagcagaggtaagcatcgccacagcaaaacatgtctgccatctcttaggtaaccaagcaaccgccctcccgaggctcctagcaaacagcttggtagctgagtcatgcagagctcaaaccagacactgggatttgggtgtcacctaggcaacagactgcttccgggagagaaaagggaagcaatcagcccctgaaaccagcagatgcttatctcctcctacgcaatggcctccccaggcacacagagcggccagtgttgctgggggcagagccatgagggggttcagggagcagggccaccctggctagctctcacctgaggcccagcctgcagacctgtgggtgcccttctgcagcaccccttccttctgagcaccaggcaagcgcccgttctgggagaaagctggccagggctgccatgaacacatcagggccagggcgcaccttgcacccaaggagaaggccacccttgaaggtcaagctttcccatgagtggaaaaccagattttctccactaccattttccagactatgcttccctctaacaagatgtcccgcacaatctgtgccatctgacaatagctgaagctccccgcccccaaccctcagtgcacgaagcagcacacacccacagctagaggttcccagacatacctgcgcaaaggcattctggaagaggaggctgtgggatgccagttggtcaatatttggggacctcaccagcttatccccataacagcccagggaggggcgcaggtcatccacgatgatgagaagaacgttcagagcatctacacaggagggaggggctttggtgaggtaacctgcactgacactgaaccctccctcatggtaggtgctaggttactaagaggcccaaggctggaccctgcaccttaacagcctagccagggagggcgctgtgcctcagcaagggtgggagtggggctcgaggaggaagcctgagtcctgggtggcagggttaggctttggtcatggcctccaacctgggtgaggaagcgagatagtgagtgaaagatggtggaaaggaaagatgaatttaggaaaaaaagagaatgatgtatgcaggaaaggacagatggttggatggaggaagataaggaggaaaagatgaatagctgaagggaagaaaggatggagagaaggaggggagaagagagagaaatatgaatggatagaaggtaaaagggacggatggaccaatggagggaggaaaggagggggaaagatggatggatagagatgggaaagatggggggaaagaggaagggaagcacggagggataggagatggatggatgaatagatggaaagagggaagggagggatgaagggacggtaggaagg

SEQ ID NO: 7812 - DNA, 15058 bp, artificial
  synthetic oligonucleotide
atctttggaagtattgcattgcactgtcactgagtgatgtatgactggctgtctttctgtttggactgcattcatctgaatggagtgggtacattggctaccgccttttctcctggttttcgctgtttctctttgatctagaaacgatttattcttactcccccagatttctttataaagagccacagggaagggaaacaatgatggccgtttgggaataaaggagggctctcacagttgaagttttctccatctgggcttgggtaaggagaagggcttctggtccctcaggcctgtcagtcatatacctgggacctgtcccgtggtcatatagaccagaccctgcacacctgcagtctcaggttctgacaagcagatatcttgcaaagcggagcccacagctggaattcaaggcaaagcccatcccctcttgccagcaaggcaggagtgtcccttctgaagtaaaagccagaggacaagatggactgggaaacactgcaaagacattgctcctcggcctttggtgacgttcctccaaggtcccctctcacaggtgtgttatgagacatacctcaggcatgagtggacgcatcaacaaaaggaatagctaaacacagcctgaaataggatgccttcaaggggacaaacagaagtgtaggaggaaggatcttcaaagacatgccaaattaccgtgactcattaccatggccctcttaagatcagtgctcgcaagaagtcagtagtttatgccaaacaagtatagcaagaagagcaaccttgctgggtgggtgaggaaaatcagtcctcttttctatgacatgagactaattattaaaagaatttcaattttgtctttaccaagacatgagttccttatgtactgcatgctgtcttctgctttttatttgaagaaatgtggcatttgggaagcagcagatgtcccccctgtggaatcaatgtgaaatgatatttttgtaacatcattaaaaagtctatcaaaatgggaaatttctctaacactttctaagggaccaataaaaacactcagaggaggaaggcttatcagcggagattcttgctaaagggcaagtgtattcacatatgaaacatagttttcaaagtcctcagagcccacagctgggatttctttccatcgaatcttggagcctaagcattgcagttaaatcctgggcaggagcaaagcctcgaggcccccagtcttaacccttactttgtatcccaatgcagaaaccaccagcttgcccccagctggctgcctggttcccacctttctgattgatggtggctaagcagtcacatgatagggcagtctaaagagtataaactctgttggcacaatgtctcacacctgtaatcccagcaggcgtgggagggcaaggcaggaggatcacctgaggtcaggagttcaagatcagcctgaccaacatagtgaaactccgtctctactaaacacaaaaaaattagcgtggcatggtggtgggcgcctgtaattccagctacttaggaggctgaggcaggagaatcgcttgaacccgggaggcagaggttgcagtgaaccgagattgcaccactgaactccagcctgggcaacaacagcgaaactctgtctcaaagaaaagaaaaaaaaaaaaaagtatgaactctggaatcagacaggcctgatttcaaccctagctcctctgtgaccctgagccactgctaaacttccctgggccccatcaggaaatgtgaatcccacaaacagccagcagagggacccactcccagcctccagaaagtactcaatcaactgggcctttgtgaagcaggttctgcctgcctggccagagactagcctgtggagttccagatcctagccttcttagcctgcttcagctccagcccagatgaggcaaagctgtagcaattgctggctctcctgagccccacatggcttgtatcatggctagtgaacttcagagagatgcataagggccagtgaaatattttcagttctgaagccacagcctgtgtcatgtgggggttttcaccctgcactgaggtgatgcatctggctaggctccagggctttgtgagcattttcctgagggccccatctatggctaccatcatgcagtgtaacttgttttcaacatcaacaacgagctgctcaaagaataagttctcttttgagaccagcctggccaacatggtgaaaccctgtctctactaaaaatacaaaaattagccaggcatggtggtgcaagcttgtaatcccagctactcaggaggctgagaaggaagaatcgcttgaacctgggaggcagaggttgcagtgagccgagatcatgccactgcactccagtctgggttaccgcgtgagaccctgtctcaaagaaaataaaataaaaataaaaaaagattaagttctcacaacagcaggctggagggaggatgacattagcactcttcataccactgtcagtccacagtggggtccaaagtcaaacaaaagaccccaacaccaggattgttttggtattcttttccgataacatctttgcggatcaaattcatcccagacttttcaactcattgaatcctcactgctgcccgagggactgtgcactacttttctctccagagtagcaatgcacaaactgaggcttggagagggtcattgctggcccaaggtctcatagcccctggcttcttaatcactatgcaacactgccacgggccagggctctgggctgggctgctaggccctgtgctttaagggtaaccatgatctgctctcataggcaaccagggcacatggaaggtcacaaggctgagagcaggggtggataggcaagagagtttccagaacataggctgtcagaaaaccccaattttacatgggggaaaagtacattttacaattcaggatccagattagttctaagttattactgttagctaccaagtctgagtgagtaagccctgagcaccactgtctaaagaactttatggccctacaatgctgagatgtgggttctaccatcctcatgttacgtgatgagaaagtggacgtaagctgtctaaggtcacacagctagtaagtgacaaaggcaggactcaaacccagtttcagctagtgaaaagccacctcacttatcccctgtgctctacacagatttggtgaagaaggaaacgacagaacgcgtgaccacaataagcaccatgaagagaccctgggccatgcacttgctataagccagatcctgtgctaactatttcagttttgtggccaagtggtgtcacctagccatcttgcctccttaatgttcacccaagtcaggtgctagtcatgataaggtctgcattcggactcctgtcagggagaaaaacggagaccacaaaaacaaaagcaagacttcccttgaaaagctgctttcaggcatctttccatcctgccaaaaattaaccacaaacttcctagggacaaagagagctgccagcagagtaatgttgagaaggctgccgcacagcatcctgtgacttcatctcctgcaattaattgtgtctcccactcggcacctgtgaggaacatgctatgatagtagcaactgggtgtcatgaccacatttcaaaattggactcttaaagcaagtgacaccccagaattttgtgggtggacccaggctctgtgtgattgcactgggaggccacacagagtgcaggatttcccgacagaagactttgcgggcagatttcagttatctgaaatgactggtgtacacacatgcttgccaagggctcttcctatttttttagccctatgttcagccaatttcctccaaggaaaaccgtggatggaactaaatgagatttcacccacttggtgcaatttggtcagagggtggaatatccagccatccaggttgacccggggcagggcctcagtctcacctgtcctgggaagggtgtcctcatgaggtcaaggctggagaaaaagcacatatccaggaactctagccctctgcaaggcctcaacaaatggtggctcttactggtgttagtatcacatatgcacagataattttcagaatccagaaaggggatgaagtgtacagatcagtaagtagcacctctcagagtctagccaacacattgacatttaagcagtgagatgtatgaatattaatacaaaatatgataaatgaagaaaattcagtattttataaacagtttcgtatcatccattttaggttttactagcaagagaatttagagcaggcttatgaaaaagccttgccagagctttatggattagggttttgtgaataacagatcatgggtatgtattgccctaggcatcaatttccacacagatcaaaaaagaggcttcccgccttacagattcctggtactgaaatagccttcaattttcaaacctgtcagtttacccaagtcagaactctcactgcctccctattggcctggagccactacacatatttggttataacccatggatggaatctaagtccccaaacaggccatatcctgtaggaccttcaggactggaaacctatggtctcacggctcttcttccttctccccaagctggaggcttttcactatctgcccatttcccatctacaggctttgaggctcaggccagcatccccacatgcttattcaaaggtcattcctgggaaaacagaaatgtatcttcaccactattagtaatactgtgctttatagtttacagatcgctcccacaggaatctcatctcccaggagacagactgagaagtttcattactcctgcaggtaggtggttaatattgtacccatcttctggatgaggtaattataactcagagaggtatagtgactttctcagagtcacacatccattgagtgatggagccaggggtcaattccaggtttataactacaaagtctgtgcttcctgccctgcttcccctgtggaggacagcagcctgactatctttatctgggtagctttctctttctctctctctctctctctcacacacacacacacacacacacacacacacacacacacacacacacacacaactttcctttataggacgaaatctcatagtttaccaaaatctctaaagctcccttgccagcaatccctcagtggacttgaactgatggtgccaggtttgggtcatggggtagcataaaagcaggcacctccatcaaagcagagcccctcttccgtttactctctttccatcatgaggatgattttatctcatctgtcagagtgaccacttcctttcatggagatggtaggaggcaagttgctaaagaacctgacaaagacttagagaagcctagaaactcagtcccagggaccatccctcctctacctccacacagactcacacacacacacctatactcacacacactcccaacaaattgggagcctacatctcccaggcagtttccacagcagagctgtgctgagagcccatgtctcccaactcccaggacaggctcagacacaggagccaaattcttcttgcagccacataaaggctgtggtgataaaagagagatgtttggcgagacacagcatgaagcaaatatatcctttaaccaagttctggccttaccctttgcagaaagatatggaaacaaataatcatttgactacaagaattggccctgtgggttctaaagtgggaagtggtgggaggaagccaagaacagggaagtgtaacagtgacacttggacccctcttcccccctcataggtaaagtactctgccgattctgttttacccatgtatccgtcaaacagggggtgatatctgagtcctccaccattttcttaagtgggcttgtaagtgtccaaacagcaggtgcctacagggcaggagacagctagggacaggcagaagtgtcgaagcttgtccttggagtctatcccacttggcccctaatacatgccatgtcaagctctagttctccttcccattccaaaaattccttaacctttagacccttttctttctcctggccaagtcacttctctcccacctctccctgcttccccgaggtccgggcttatctagtctcttgcaggagcagtttcaagagcaggcatcagagacttttggtgttaggtcagcagtttccttcaatctttgtttttgtcatagtgggggctggaggcatgatattcaggataaaagtaagagcaacatgttgggggagaatacacagtaaaacaaccagatcaagtcttcatgtgtgaccctccaacagtcctcccacaagtacagctttgtaacctccagaaaaagatagcctcttctatcttaggtgttttatcctaaaaaataggggctacataggctcaaagtaaagggatgaagaaagatctatcacacaaacagaaaacaaaaaaacagccagggttgttattctaatattagataaaacagactttaaaccaacaacagtaaaaaaggacaaagaagggcgttatataatgataaatggttcaattcaagaagacttaactatcctaaatacatatgaacccaacatagagcacacagattcgtaaaacaagtacttctggacctacaaaaagatttacacagctacacaataatagtggaggagttcaacacctcactgacagcattggacagatcattgaggcagaaaactaacaaagaaattctggactgaaatttgacacaaacaattggatctaatagacatctacagaatactctatccaacaaccatagaatatctatttttttcatctgtacatacgctaagattgatcacgtgatcagccataaagcaagtcccaatacattcaaaaaaactgaaatcatatgaagcaggttcttggaccacagtgaaacaaaaatagaaatcaacaccaagagaaattctcaaaaccacacaattacctggaaaccaaacttgctcctgaatgacttttgtgtaaaaaacaaaattaaagcagaaatcaaaaaaattactttaaataaatgaaaacagagatacaatataccaaaatctctgggatgcagcaaaagcagtgttaagaggaacgtttatagcactaaatgcttacatcaagaaaatagaaagatctcaaattaacaatctaatattgcagctagatgaactagaaaaacaagaacaaattaaccccaaagctagaaggaaagaaataactaaaatcagaacagaactaaatgtaattgaggctcaaaatccagacaaagaatcaatgaaacaaaaagttaattatttgaaaagataaacaagattaatagtctgccagctagattaacaaacaaaaaaaagaaaagattcaaataagtacaatcagacatagcaaaggtgacattataacccacagaaatacaaaagatcctcagagactattctttttttttttttcaatagagacagggtctcactatgttgcccaggctggtctcaaactcaagcaatccacctgcctcagtgttgcaaagtgctgggattacaggcatgagccaccgtgcccagctgttcagagattattaagaacacctcgatgaacacaaactaggaaatctagaggaaatggatacattcctagaaacagaggaaatggataaattcctaggaacagaggaaatggataaattcctagaaaaacacaacctcacaagattaaatcaggaagaaattaaaagcctacacagaccataacaagttctaaaattgaattagtaatgcaaaaaaacctgccaacaagactgggcacaatgactcacgcctgtaatcttagcactttgggaggctgaggcgggcagataacttgagctccggagttcatgaccagcctgggcaacatagtgagaccctgtctctactaaaaagacaaaaaaaaaaaaaaatagccaggcgttgtggtgtacacctgtagtcccagctactaaggaggctgaagtgggaggatggcttgagcctgtgggtcagaggttgcagtaagctgaatttgcaccactgtactccagcctgcgtgacaaagagagaccctgtcacaaaacaaacaaaccaaacaaacaaaaaagaaaaacacctaccaacaaaaaaagtcctggaccaaatggattcacagccaaattctaccagacatccataaaacagagctggtattcatcctactaaaactattccaaaaaactgagagagactcctctttaactcattctacaaaaccagcatcatcctgataccaaaatctggcaaagtcatgacaagaaaaaaaaagaaggcctggcacaatggctcatgcctgtaatcccagctacttgggaggctgaggcatgataatcacctgaaaccaggatgcagaggttgcagtgaaccaagattgcaccttgcgccactgcactccagcctgggcgacagagtaagactctgtctcaaagaaaaagaaaagaaaagaaaaagaaaaagaaaaagaaaactacaagccaatatccctgatgaacatagacacaaatatcctcaaaaaaaaaatactagcaaactgaattcagcagcacatcgaaaagttaattgtgcataatcaagtaggctttattcctgggatgcaagattggttccacatacatgaatcaataactgtgattcaccacataaacagaagtaaaagcaaaaatcattatcatctcaccagatgcagaaaaaacttttgataaaaatctaacatctcttcatgatgggcaaaagctgaaagcattccccttaagaactggaacaagacaaggacgcccactctcaccactcctattcaacatagtactggtagtcctagccagcaatcaggcaagataaagaaataaaaggcatctaattaggaaaagaagggctggaagggccaggcgcggtgactcatgcctgtaatcccagcactttgggaggccgaggtgggcggatcacctgagatcaggagttcgtgatcaccccagccaacatggcgaaatcccatctctactaaaaatacaaaaaatcagctgggcgtggtggcgggcacctgtaatcccagctactctggaggctgaggcaggagaattgcttgaacctgggaggcagaggttgcagtgagccaagatcgcaccactgcactctagcctgggcgagagagcgagactccatctcaaaaaaaaaaaaaaagaggaaaagaagaagtcaaattgtctctctttgttgatgagatgattctatgcctagaaaaccttaaagattcagccaaaagtcacctagaactgaaaatgatttcagtaaagtttcagcatacaaaatcaatgtacaaaaatcagtagcatttttatacaccaaaaatgttcgagctgggagccaaatcacgaacacaattccatttataatagctgcaaaaaattaaaatacctaggaacacatctaaccaaggaggtaaaagatctctccaaggagaactccaaaacagtgctgaaagaaactatagatgacttaaacaaatgaaaaatcattccatgctcatagattggaagaatcagtattattaaaatatgcatatatccacattctacagattcaaaattattcctatcaaaataccaatgtcatttttcacagaattagataaaactagcctaaaatttgtatggaaccaaaagaaaaaaaaaagtccaaatagccaaaagaatcctaagcaaaaagaataaagccagaagcaacacattatccaacttcacgcgatactacaagcctacagtaaccaaaacagcatagtacgagtacaaaaacagacacacacaccaatagaacagaatagagagcccaggaataatgaagcacacctacaacaaagtcttcgacaaagtcaacaaaaataagcaataatgaaaggaattactactcaataaatggttctgggaaaactggctaaccacatgcagaagaatgaaactggacccttacctatcaccttatacaaaaattaactcaagatggattaaagatttaaatgtaagacctaaaactacaaaaatcctagaagaaaattctggacatcagcattggcagagaattcatgactaagtcctcaaaagcaattgcaacacaaacaaaaattggcaagtgggacctagttaaactaaagagtttctgcacagcaaaagaaactgtcaacagagtaagcagacaacctacagaacaagagaaaatacttacaaagtatgcatccaaaaatgtctaatatccagaatctacaaggaactaaaatcaacaagctaaaaacaaccccattaaaaaccaggcaaaggacatgaacagacgcttctcaaaagacgacatacaagcgccaacaaacatgataaaatgctcaacatcacatctgagaaatgcagatcaaaaccacaatgagataccatctcacaccagttagaatggctattattaaaaagtcaaaaaacagcagatgctggtgaggctgtggagaaaagaaaacacttatatactgttggtgggagtgtaaattagtgcagccactgtgaaaagcagtttggagatttctcaaagaacttaaaacagaactaccatttaactcagcaatcccattgctggatatatatccaaaagaaaataaattgttctaccaaaaagacacatggactggtgtgttcattgtagcactattcacaatagcaaagagatgaaatcaacctaagcttccatcaccggtggactggataaagaaaatgtggtgcatctgtatcaccagtacttcacagccataaaaagatgatatcatgtcctttgcagcaacacggatggagctggaggccgttatcctaagcaaattaacgcaggatcagataccacatgttcttgcttgtaagtcggagctaaacattgggtacacatggacataaagacgggaacaacagacactgggaaccgcaagagacgagagggaggaaggatgtgggttaaaaaactacctattaggtactatgctcactacctgggtgacaggttcaatcgaaccccaaacctcagcatcatgcaatacacccttataacaaacccacacatgtaccccctaaatctaaaatatttatataagttgaatgtttttaaaaagaataggggctagtggggcaatgattgtacaattatgtgaaggtactgaatgccaccaaactggacatttaaaaatggttaagacggtgacttttatatgatatatattttaacacagtttcaaaaagaataggagctggggacactgtccaagctctgttcggtggtataacccccagtgccccacaggcaccacagctgcacatggagctatgtgttatctttcctggatgcttccaccagctgagaatatgtcagttttgaggcagatgtgtttgttggaggactgggggtaggtatcatctatatgtcttctcccggccctgtcctggagcaggggcccttatgtagaaattgggtacttagctcttctggccctccctgcaccccatggcatccttggtgttcccctgggtcagggactgaggacaaagtcatggataggcctgtttctcagcactgcaggtcatcattctgtcctctgttcactgcctgtctccctattctgactcacagctggactcgcaccttccatgaaatcaaagttagctgctgttactttttgcttgggaacatgtccttcctgcctctgccaatctctttgacatctaggtgctcaagggaagcttcccttgtaagatctctgaggagccataggttatttctgcagagtccctgaactgctcctgttccacccactctggttccttattttgtccccaaccacactaacatgggcagtgtctgggcctccagctgtcagcttatatgtcctattcctcactctccatcccatagctgtggccaccattgcctagcttgattttggcagtttgtccctaagactagcagtccccaagaaaggttccaatacatgtgtcatctctatctttcacccccgaactagaatcaatggctgccaaacatcaaaagtacgaggtaaaaatccaatggtcttgtttctggcccactgtgggtatgcaacaggaaattcatgtgcgccttcactgctctttttctcagggacattctcccagcatgttagcaaggcccagttaaattcctcagggtgagggtccccttggagaagggagtgagttggtgtggatttctgtactcaaggtagagcacttccaataaccaggagctctgggcatcccgcccctgatctgggcaaatctggcatgaagtctacacactaaaaatagctttcccagcacaggaaagcaatggtagaggcttcctgatctggcttgcacaccacaggtgaagtaattggtcacttaccagtgtctccccacttagattccaaagtccactgtatcaatgacatcatgctaacaactggatgagcaagacatggcagagattttagaggcctttgaaagacataagcacttcagagagtggtagattaagcccacgaagattcagagaccttccatatcaatgaagtatttaaggggctactggtcaggggcatgctaggaccacccctccaaagtcagaggcaaatgattgtatctcacacctcctacaactaagaaggaagcacaatgccatgtaggcctctttgggtctggaagcaggggaccaaggggtgaaatgaccccacttattatctctcctagtgatccacatgggaatttgtgcttcctgtccccacaatacagtcaccactagccaaattcatctatttaaatttaaattaagataaaattagttgttattttatctgaattttagataattaaaattcagttcttcagacacaccaggtacatttcaagtactcagtaggcacatgcagctagtggctaccttattgaacagtggatcctggctattcaaatggaaatgcttccaccagtagacacagtaggagccccactgaattacgagccatggctgataactgaattacaagtcatgggaaccttgggttcattcctcctgctatggctgtgggactaagcaggtgtaaagaagagtagccactctgtcaggggtattggctctgatcatcaggaggaggcagggttgttcttacacactgtgaacagagaaggatatatttggcacccaggtgatccatttgaatgtctcctaataattccctgcccaatttttatggtaaatggacacatgcaatttccacagtctgagaagggcacggggaccatgggctcagaaacaatcctcagggataaaggtctgttactcgaccagccaggtcactgagaacggcagacatggtggctgagactgagggtactctagaatggatagtagatgaagaagaccatgagcatcagttgtggcttcaaagccagctgcagtcatgcaggccatacactgtcccactaccctgcctcatgttcacctccctaggaaaagggccaagccaaaccctggagaagttattcccaaatgaggggagcatcctgtgtgaagcaagcccatctgaggcctgcaaggcatgggctgtagtcgatgctgtggtcgttccacagcccagcccaatggcggaggtcatcattccactgcctgccaaaggtgttgcttgatgatggcacataactaagtctctctccaaatatcagtcaaggggtcaatgaagggtggagagtaccaacacctggactccagcctctacttgcaacatctctatagaatcttcccaaccatagagctccctcagggactgactgagacgtctgattcaactgtcataaaacaactccactttcctcccaattctacttccctcactctattacaggtggtttctttttttttctttttttttctttttgaaatggagtttcactcttgttgcccaggctggagtgcaatggcgcagtctcggctcaccacaacctccacctcccgggttcaagcggttctcctgcctcagcctcttgagtagctgggattacaggcatgcaccaccacacccagctaattttgtatttttagtagagatggggtttctccatgttgatcaggctggcctcgaactcctgatctcaagtgatccacctgcctcagcctcccaaagtgctgggattacaggcatgagccactgtggctggctacaggtgttattttccaaagcacatgtcctatcctttcaagttgcagggatgaactagtgaaggccccaaacattgaccaactggcatcccacagcctcctcttccagaatgcctttgcgcaggtatgtctgggaacctctagctgtgggtgtgtgctgcttcgtgcactgagggttgggggcggggagcttcagctactgtcagatggcacagattgtgcgggacatcttgttagagggaagcatagtctggaaaatggtagtggagaaaatctggttttccactcatgggaaagcttgaccttcaagggtggccttctccttgggtgcaaggtgcgccctggccctgatgtgttcatggcagccctggccagctttctcccagaacgggcgcttgcctggtgctcagaaggaaggggtgctgcagaagggcacccacaggtctgcagactgggcctcaggtgagagctagccagggtggctctgctccctggaccccctcatggctctgcccccagcaacactggccgctctgtgtgcctggggaggccattgcgtaggaggagataagcaactgctggtttcaggggctgattgcttcccttttctctcccggaagcagtctgttgcctaggtgacacccaaatcccagtgtctggtttgagctctgcatgactcagctaccaagctgtttgctaggggcctcgggagggcggttgcttggttacctaagagatggcagacatgttttgctgtggcgatgcttacctc

SEQ ID NO: 7813 - DNA, 1860 bp, artificial
  synthetic oligonucleotide
tttactgagcacgtcttcccaactggcaaataagggaaacggatactcctttcggagagtagtgcatttaagagatcagttaggccaactcctcattttacagaagggccaaagaagggcagagaatcacccagttacatatggcctcgtctccaatccaagtctttgggctcagtttagttccacaaacattttatatgtgcctactatgtgccagatacggtgggtgggaggcgctggggacactgagatgagcaggagatggtctcagcttcagggagctcacagcctggggtaaagaacagttacaaaacagtcgggcaagtgcaaggacaggcgcttgagtgcttagccagtgttttctccacactgtccactgggtgttccccatctggaaaagaaggacagcaatatctacttcctgcaaataaacttgtagtgaagactgatgagaaaatgagtatggaaaatgatcaggctcacccagaaatgcattatataaggtattgccataccccgacactgactccaaggattcaacagtgtttcaggtatccgttcaacaaagaagcaaacaagagagggatgggcataaacccaaggaaaaccccaaggactgcgaggaactggaggaaacagctggggtgggggtaggggtgttgggtcgagtgagacggccctgacgcggagaatggagggcccgcagcggcgcagaagaggatggaaccgagacgaagaagttgggacaccaatgagggacagcaagcagaaaagaatggggttcccttggggcaggacggggctcgcggccgggcccttccggccgtggccgggcaggggctgaaagcaccgggcacgggaggaggaagcgggcgggcgccgaggccgactgttttgcctggggaccgcttgcacccgcagggaggctcgggcaggcgcccgggtcctcgggctgcagcatctcgcccgccgtgcctccccggagccgaacaccagcccgcgcccgagcccgcagcgcggactcccgggggcgccaacgacgccgcctcacctcgggttgaagtcctggaagaggcccctcaggttcatggcggagaacttcaccgcggcgtcctcctcctcctcccccgcaccccgtgctgcacagcctgcgccttacagcgggttcatggcgccagcgccagccgcgtccacgctgctgctcccgctactgctgccgtccccgctgccgtcgccgtcgccgtcgccgccgccgccgccgcccggagaaacctgagccaccgccccctgcccctccttccgggcttccgtacgagggccgcgcatgcgtccggagccccgcccagagcgctcctcgctgggaggtccccatccttgtgtccgcacgcgaccggcggaggagatggcagggggatggaggctgggagtgagcagggccccgaggaaggggatgctgacgggctgaaggcctgcagggagggagcgcgccgcccgggagtctggcgggcagatcttggcagacacctgtcaccttggcccgcgctaccttctggagattttccccagtgacgactgagccctgggagtagtgacaatgagtgagacgttgcatttttggcgatgtcatcccaggcttcacctgtcacatctgtcaacgactccaaagtttgggtcccaacttcccttccaattcccaagccagcgtgtccagatatgctggctattccctactcaagttacctagcaccaaagtcacttcccgtgccaaccgccttcccctcctgggttccctttttcccttagcagcaggcctattcgtacgcaggggggtattcaagcaggagacgtggaaatcatcct

SEQ ID NO: 7814 - DNA, 321 bp, artificial
  synthetic oligonucleotide
gggaaatacccaagttctgtgagcctctggttcttcatctgtgaagcaggtatgatgaggcccttccactaggacggttagagtgcgtgcaatgtaagtgaagcatctggctcagggcctggcattaagttagaagtttaaggaatggcggatggctgtcatatctaatactatttgaccctagaccctagcactctgggatttcgtaaatgttgttgttctccaagacttaccagagaatatacagctcagtaggacatgggataatcagccccaacaggaagtttcgtcaataaaattaagtatttcctcttagcgaac

SEQ ID NO: 7815 - DNA, 1412 bp, artificial
  synthetic oligonucleotide
ggttctcatctacaagaactagtgcaccaagggagagagtactccagctgtggcgtcctggactttgaatcctgggatgagggggcaggtagggtagaggattcaagaacagaggaattatggagggatggaagctgggagggaggaagaaagagtaagaatctaaaaatgaaccaagggaggagccaaagagtgttggtcttgagccagatcacaggcagttgggtcagggttagaggtaacagttgtaaggaacaagtctaagccagccaaaccctggttgagccatggtgtccgaccttgtgggggacccctcagtatctttcttaatgcaacacattgttaaactttggtctgaccccagggagaggctgagcagctcagtaagcaggccattctttaaaagcctgagtgtctattcactgacaaccctgtggatctttctttgtatcagtaaattaccctatacaactcatgtccagacattttatagcagtctcacttttggtgggggtgatatagtgtgctgggaagagctctccatggagatttgtgggagagggggcaagaggcttgggttttagccagtgctctgccactaattggccatgaaacattaggcaagtcatctaaatgtttggtgcctcagtttccccatatatacaatgaggatcaaggaggcacagatgtatagttcatctatcagttgtgagttctaaagcatagaaaagaattctgtggctttggcatttggcttttttgacttgagaaaaataaatataccctaagcactacatttgagttgaacctatgaaaaccctgagagtcaaaactaaactataaatagtaaaatcctttccccagcttcttcgttagagccaggagtgttgaagacagtcaactttttagcatttgtggaaatggcaggaagcaaattgaatagggttgaacagttgtgctccttgacctctgagatgcaatatcttacataccagtactaaaccagaggttcactgtgttccagggactctgatggagttgatagaccccctagtgacgcacataccaccagcaagctgggtgaccttcctcctttgccaaaatcacacatggctcatttgctgagggctacagtaaaattaagtgctgcttcttgcttcttctgaactggcaccctgttggtcctgccagtgtgagacaaaagatgtaagggctaccagtggactttaaaatgttaattttaaaaatagcccttaattattaaaagtagccctaattatagcttactataggcaggccacacgtttctgaatagtttaacaaatgaggaaataagtgaagagttgataagtgctggtagattcatttgcatgctttcctacacccaaatggtaatactgcaacaccacagt
